(12) United States Patent
Morris et al.

(10) Patent No.: US 7,820,447 B2
(45) Date of Patent: Oct. 26, 2010

(54) COMPOSITIONS AND METHODS FOR CANCER

(75) Inventors: David W. Morris, Davis, CA (US); Eric K. Engelhard, Davis, CA (US)

(73) Assignee: Sagres Discovery Inc., Emeryville, CA (US)

(*) Notice: Subject to any disclaimer, the term of this patent is extended or adjusted under 35 U.S.C. 154(b) by 1646 days.

(21) Appl. No.: 10/035,832

(22) Filed: Dec. 26, 2001

(65) Prior Publication Data

US 2007/0037145 A1 Feb. 15, 2007

Related U.S. Application Data

(63) Continuation-in-part of application No. 10/034,650, filed on Dec. 20, 2001, now abandoned, and a continuation-in-part of application No. 09/997,722, filed on Nov. 30, 2001, now abandoned, and a continuation-in-part of application No. 10/052,482, filed on Nov. 8, 2001, now abandoned, and a continuation-in-part of application No. 10/004,113, filed on Oct. 23, 2001, now abandoned, and a continuation-in-part of application No. 09/798,586, filed on Mar. 2, 2001, now abandoned, and a continuation-in-part of application No. 09/747,377, filed on Dec. 22, 2000, now abandoned.

(51) Int. Cl.
| | |
|---|---|
| G01N 33/48 | (2006.01) |
| G01N 33/566 | (2006.01) |
| G01N 33/567 | (2006.01) |
| G01N 33/53 | (2006.01) |
| C12Q 1/42 | (2006.01) |

(52) U.S. Cl. .................. 436/64; 436/63; 436/501; 436/503; 436/813; 435/4; 435/7.1

(58) Field of Classification Search .......... 435/4, 435/7.1; 436/63, 64, 501, 503, 813
See application file for complete search history.

(56) References Cited

U.S. PATENT DOCUMENTS

| | | | |
|---|---|---|---|
| 4,179,337 A | 12/1979 | Davis et al. | |
| 4,301,144 A | 11/1981 | Iwashita et al. | |
| 4,469,863 A | 9/1984 | Ts'o et al. | |
| 4,496,689 A | 1/1985 | Mitra | |
| 4,640,835 A | 2/1987 | Shimizu et al. | |
| 4,670,417 A | 6/1987 | Iwasaki et al. | |
| 4,791,192 A | 12/1988 | Nakagawa et al. | |
| 4,816,567 A | 3/1989 | Cabilly et al. | |
| 5,034,506 A | 7/1991 | Summerton et al. | |
| 5,124,246 A | 6/1992 | Urdea et al. | |
| 5,216,141 A | 6/1993 | Benner | |
| 5,235,033 A | 8/1993 | Summerton et al. | |
| 5,359,100 A | 10/1994 | Urdea et al. | |
| 5,386,023 A | 1/1995 | Sanghvi et al. | |
| 5,445,934 A | 8/1995 | Fodor et al. | |
| 5,545,730 A | 8/1996 | Urdea et al. | |
| 5,545,806 A | 8/1996 | Lonberg et al. | |
| 5,545,807 A | 8/1996 | Surani et al. | |
| 5,569,825 A | 10/1996 | Lonberg et al. | |
| 5,571,670 A | 11/1996 | Urdea et al. | |
| 5,580,731 A | 12/1996 | Chang et al. | |
| 5,591,584 A | 1/1997 | Chang et al. | |
| 5,594,117 A | 1/1997 | Urdea et al. | |
| 5,594,118 A | 1/1997 | Urdea et al. | |
| 5,597,909 A | 1/1997 | Urdea et al. | |
| 5,602,240 A | 2/1997 | De Mesmaeker et al. | |
| 5,624,802 A | 4/1997 | Urdea et al. | |
| 5,625,126 A | 4/1997 | Lonberg et al. | |
| 5,633,425 A | 5/1997 | Lonberg et al. | |
| 5,635,352 A | 6/1997 | Urdea et al. | |
| 5,637,684 A | 6/1997 | Cook et al. | |
| 5,644,048 A | 7/1997 | Yau | |
| 5,661,016 A | 8/1997 | Lonberg et al. | |
| 5,681,697 A | 10/1997 | Urdea et al. | |
| 5,681,702 A | 10/1997 | Collins et al. | |
| 5,700,637 A | 12/1997 | Southern | |
| 5,759,776 A | 6/1998 | Smith et al. | |
| 5,776,683 A | 7/1998 | Smith et al. | |
| 5,928,870 A | 7/1999 | Lapidus et al. | |
| 6,074,825 A | 6/2000 | Rundell et al. | |
| 6,153,441 A | 11/2000 | Appelbaum et al. | |
| 6,812,339 B1* | 11/2004 | Venter et al. | 536/24.31 |
| 2003/0143539 A1* | 7/2003 | Bertucci et al. | 435/6 |

FOREIGN PATENT DOCUMENTS

| | | |
|---|---|---|
| WO | WO 87/05330 | 9/1987 |
| WO | WO 90/10448 | 9/1990 |
| WO | WO 91/04753 | 4/1991 |
| WO | WO 95/25116 | 9/1995 |
| WO | WO 95/35505 | 12/1995 |
| WO | WO 97/27212 | 7/1997 |
| WO | WO 97/27213 | 7/1997 |
| WO | WO 01/94629 | 12/2001 |
| WO | WO 02/22660 | 3/2002 |
| WO | WO 02/46467 | 6/2002 |
| WO | WO 03/008583 | 1/2003 |
| WO | WO 03/053224 | 7/2003 |

OTHER PUBLICATIONS

Muramatsu, T. et al. Biochemical and Biophysical Research Communications, 188: 265-271, 1992.*

(Continued)

*Primary Examiner*—Alana M. Harris
*Assistant Examiner*—Anne L Holleran
(74) *Attorney, Agent, or Firm*—Lisa E. Alexander; David Gay

(57) ABSTRACT

The present invention relates to novel sequences for use in diagnosis and treatment of carcinomas, especially lymphoma carcinomas. In addition, the present invention describes the use of novel compositions for use in screening methods.

2 Claims, No Drawings

OTHER PUBLICATIONS

Tockman, M.S. et al. Cancer Research, (Suppl.) 57: 2711s-2718s, 1992.*

Lakshmikuttyamma, A. et al., Journal of Cellular Biochemistry 95: 731-739, 2005.*

Kihara, H. et al, International Journal Oncology 12: 629-634, 1998.*

Padma, S. et al, Clinica Chimica Acta, 321: 17-21, 2002.*

Yamamoto, M. et al. Leukemia, 13: 595-600, 1999.*

McClean and Hill, Eur J of Cancer, 1993, vol. 29A, pp. 2243-2248.*

Fu et al, EMBO Journal, 1996, vol. 15, pp. 4392-4401.*

McGarrity, T.J. et al., Gut, 32: 1121-1126, 1991.*

Billingsley, M.L. et al., Proc. Natl. Acad. Sci., USA, 82: 7585-7589, 1985.*

Mondragon, A. , et al, Biochemistry, 36: 4934-4942, 1997.*

Altschul, S. F. and Gish, W. (1996). "Local Alignment Statistics" In *Methods in Enzymology* vol. 266. Academic Press, Inc., pp. 460-480.

Altschul, S. F. et al. (1990). "Basic Local Alignment Search Tool," *J. Mol. Biol.* 215:403-410.

Aplin, J. D. and Wriston, Jr., J. C. (1981). "Preparation, Properties, and Applications of Carbohydrate Conjugates of Proteins and Lipids," *LA Crit. Rev. Biochem.* pp. 259-306.

Arenberg, D. A. et al. (2001). "The Murine CC Chemokine, 6C-Kine, Inhibits Tumor Growth and Angiogenesis in a Human Lung Cancer SCID Mouse Model," *Cancer Immunol. Immunother* 49:587-592.

Ausubel, F. M. et al., eds. (1992). *Short Protocols in Molecular Biology*. Greene Publishing Associates and John Wiley & Sons, pp. iii-xviii (Table of Contents Only).

Beaucage, S. L. and Iyer, R. P. (1993). "The Functionalization of Oligonucleotides Via Phosphoramidite Derivatives," *Tetrahedron* 49(10):1925-1963.

Boener, P. et al. (1991). "Production of Antigen-Specific Human Monoclonal Antibodies from in Vitro-Primed Human Splenocytes," *J. Immunol.* 147(1):86-95.

Bolli. M. et al. (1994). "α-Bicyclo-DNA: Synthesis, Characterization, and Pairing Properties of α-DNA-Analogues with Restricted Conformational Flexibility in the Sugar-Phosphate Backbone," Chapter 7 In *Carbohydrate Modifications in Antisense Research*. Shanghvi, Y. S and Cook, P. D, eds, American Chemical Society, Washington, pp. 100-117.

Brill et al. (1989). "Synthesis of Oligodeoxynucleoside Phosphoridithioates via Thioamidites," *J. Am Chem soc.* 111:2321-2322.

Brower, V. (1998). "New German Government Muddies the Biotech Waters," *Nature Biotechnology* 16:1304-1305.

Carlsson, C. et al. (1996). "Screening for Genetic Mutations," *Nature* 380:207 (1 page total).

Cole, S.P.C., et al. (1985). "The EBV-Hybridoma Technique and Its Application to Human Lung Cancer," In *Monoclonal Antibodies and Cancer Therapy*, Reisfeld, R. A. and Sell, S., ed., Alan R. Liss, New York, p. 77-96 (Includes Table of Contents).

Creighton, T. E., ed. (1983). "Posttranslational Covalent Modifications of Polypeptide Chains," Chapter 2 In *Proteins: Structure and Molecular Properties*. W. H. Freeman & Co., San Francisco. pp. 79-86 (Includes Table of Contents).

David, G. S. and Reisfeld, R. A. (1974). "Protein Iodination with Solid State Lactoperoxidase," *Biochemistry* 13(5):1014-1021.

De Mesmaeker, A. et al. (1994). "Comparison of Rigid and Flexible Backbones in Antisene Oligonucleotides," *Biooroganic & Medicianl Chem. Lett.* 4(3):395-398.

De Mesmaeker, A. et al. (1994). "Novel Backbone Replacements for Oligonucleotides," Chapter 2 In *Carbohydrate Modifications in Antisense Research*. Shanghvi, Y. S and Cook, P. D, eds, American Chemical Society, Washington, pp. 24-39.

Dempcy, R. O. et al. (1995). "Synthesis of a Thymidyl Pentamer of Deoxyribonucleic Guanidine and Binding Studies with DNA Homopolynucleotides," *Proc. Natl Acad. Sci. USA* 92:6097-6101.

Devereux et al. (1984). "A Comprehensive Set of Sequence Analysis Programs for the VAX," *Nuc. Acid. Res.* 12(1):387-395.

Doudney, K. et al. (2001). "Comparative Physical and Transcript Maps of~ 1 Mb around *looptail*, a Gene for Severe Neural Tube Defects on Distal Mouse Chromosome 1 and Human Chromosome 1q22-q23," *Genomics* 72(2):180-192.

Eckstein. F., ed. (1991). *Oligonucleotides and Analogues: A Practical Approach*, Oxford University Press, vii-xvii. (Table of Contents Only).

Edge, A. S. B. et al. (1981). "Deglycosylation of Glycoproteins by Trifluoromerathneusulfonic Acid," *Anal. Biochem.* 118:131-137.

Elgholm, M. (1993). "PNA Hybridizes to Complementary Oligonucleotides Obeying the Watson-Crick Hydrogenbonding," *Nature* 365:566-568.

Elgholm, M. et al. (1992). "Peptide Nucleic Acids (PNA). Oligonucleotide Analogues with an Achiral Peptide Backbone," *J. Am. Chem. Soc.* 114:1895-1897.

Evan, G. I. et al. (1985). "Isolation of Monoclonal Antibodies Specific for Human c-myc Proto-Oncogene Product," *Biology* 5(12):3610-3616.

Fan, L. et al. (2000). "Cutting Edge: Ectopic Expression of the Chemokine TCA4/SLC is Sufficient to Trigger Lymphoid Neogenesis," *J. Immunol.* 164(8):3955-3959.

Feng, D. F. & Doolittle, R. F. (1987). "Progressive Sequence Alignment as a Prerequisite to Correct Phylogenetic Trees," *J. Mol. Evol.* 35:351-360.

Field, J. et al. (1988). "Purification of a RAS-Responsive Adenylyl Cyclase Complex from *Saccharomyces cerevisiae* by Use of a Epitope Addition Method," *Mol Cell. Biol.* 8(5):2159-2165.

Fishwild, D. M.et al. (1996). "High-Avidity Human IgGk Monoclonal Antibodies from a Novel Strain of Minilocus Transgenic Mice," *Nature Biotechnology* 14:845-851.

Gao, X. and Jeffs, W. P. (1994). "Unusual Conformation of a 3'-thioformacetal Linkage in a DNA Duplex," *J. Biomolecular NMR* 34:17-34.

Germer, S. et al. (2000). "High-Throughput SNP Allele-Frequency Determination in Pooled DNA Samples by Kinetic PCR," *Genome Res.* 10:258-266.

Goding. (1986). Monoclonal Antibodies: Principles and Practice, Academic Press pp. 59-103.

Hansen, G. M. et al. (2000). "Genetic Profile of Insertion Mutations in Mouse Leukemias and Lymphomas," *Genome Res.* 10(2):237-243.

Heid, C. A et al. (1996). "Real Time Quantitative PCR," *Genome Research* 6:986-994.

Herdewjn, P. et al. (1994). "Hexopyranosyl-Like Oligonucleotides," Chapter 6 In *Carbohydrate Modifications in Antisense Research*. Shanghvi, Y. S and Cook, P. D, eds, American Chemical Society, Washington, pp. 80-99.

Higgins, D. G. and Sharp, P. M. (1989). "Fast and Sensitive Multiple Sequence Alignments on a Microcomputer," *CABIOS* 5(2):151-153.

Hoogenboom, H. R. and Winter, G. (1991). "By-Passing Immunisation Human Antibodies from Synthetic Repertoires of Germline VH Gene Segments Rearranged in Vitro," *J. Mol. Biol.* 227:381.

Hopp, T. P. et al. (1988). "A Short Polypeptide Marker Sequence Useful for Recombinant Protein Identification and Purification," *Biotechnology* 6:1204-1210.

Horn, T. et al. (1996). "Oligonucleotides with Alternating Anionic and Cationic Phosphoramidate Linkages: Synthesis and Hybridization of Stereo-Uniform Isomers," *Tetrahedron* 37(6):743-746.

Hwang, H. C. et al. (2002). "Identification of Oncognes Collaborating with p27$^{Kip1}$ Loss by Insertional Mutagenesis and High-Throughput Insertion Site Analysis," *PNAS* 99(17):11293-11298 (Includes supporting information).

Jenkins, G. N. et al. (1995). "The Biosynthesis of Carbocyclic Nucleosides," *Chem. Soc. Rev.* pp. 169-176.

Jones, P. T. et al. (1986). "Replacing the Complementarity-Determining Regions in a Human Antibody with Those from a Mouse," *Nature* 321:522-525.

Joosten, M. et al. (2000). "Phenotyping of Evi 1, Evi 11/Cb2, and Evi 12 Transformed Leukemias Isolated from a Novel Panel of Cas-Br-M Murine Leukemia Virus-Infected Mice," *J. Virology* 268:308-318.

Jung, M. P. et al. (1994). "Hybridizationof alternating Cationic/Anionic Oligonucleotides to RNA Segments," *Nucleosides & Nucleotides* 13(6&7):1597-1605.

Karlin, S. et al. (1993). "Applications and Statistics for Multiple High-Scoring Segments in Molecular Sequences," *PNAS USA* 90:5873-5787.

Köhler, G. and Milstein, C. (1975). "Continuous Cultures of Fused Cells Secreting Antibody of Predefined Specificity," *Nature* 256:495-497.

Kohno, T. et al. (2000). "Identifcation of Genes Associated with the Progression of Adult T-Cell Leukemia (ATL)," *Jpn J. Res.* 1103-1110.

Lee, S. Wong et al. (1999). "Cloning of Mouse *Sepiapterin reductase* Gene and Characterization of its Promoter Region," *Biochimica and Biophysica Acta* 1445(1):165-171.

Letsinger, R. L. et al. (1986). "Effects of Pendant Group at Phosphorus on Binding Properties of D-ApA Analogues," *Nucl. Acids. Res* 14:3487-3499.

Letsinger, R. L. et al. (1988). "Cationic Oligonucleotides," *J. Am. Chem. Soc.* 110:4470-4471.

Letsinger, R.L. and Mungall, W. S. (1970). "Phosphoramidate Analogs of Oligonucleotides," *J. Org. Chem* 35:3800-3803.

Li, J. et al. (1999). "Leukaemia Disease Genes: Large-Scale Cloning and Pathway Predictions," Nature Genetics 23:348-353.

Lockhart, D. J. et al. (1996). "Expression Monitoring by Hybridization High-Density Oligonucleotide Arrays," Nature Biotechnology, 14:1675-1680.

Lonberg, N. and Huszar, D. (1995). "Human Antibodies from Transgenic Mice," Intern. Rev. Immunol. 13:65-93.

Lonberg, N. et al. (1994). "Antigen-Specific Human Antibodies from Mice Comprising Four Distinct Genetic Modifications," *Nature* 368:856-859.

Lund, A. H. et al. (2002). "Genome-Wide Retroviral Insertional Taggin of Genes Involved in Cancer in Cdkn2a-Deficient Mice," *Nature Genetics Advance online Publication* pp. 1-6.

Lutz-Freyermuth, C. et al. (1990). "Quantitative Determination That One of Two Potential RNA-Binding Domains of the A Protein Component of the U1 Small Nuclear Ribonucleoprotein Complex Binds with High Affinity to Stem-Loop II of U1 RNA," *Proc. Natl Acad. Scie. USA* 87:6393-6397.

Maddry, J. A. et al. (1994). "Synthesis of Nonionic Olgonucleotide Analogues," Chapter 3 In *Carbohydrate Modifications in Antisense Research*. Shanghvi, Y. S and Cook, P. D, eds, American Chemical Society, Washington, pp. 40-41.

Mag, M. et al. (1991). Synthesis and Selective Cleavage of an Oligodeoynucleotide Containing Nucleic Acids Res. 19:1437-1441.

Marks, J. D. et al. (1991). "By-Passing Immunization, Human Antibodies from V-Gene Libraries Displayed on Phage," J. Mol. Biol. 222:581-597.

Marks, J. D. et al. (1992). "By-Passing Immunization: Building High Affinity Human Antibodies by Chain Shuffling," Bio/Technology 10:779-783.

Martin, G. A. et al. (1992). "GAP Domains Responsible for Ras p21-Dependent Inhibition of Muscarinic Atrial K+ Channel Currents," Science 255:192-194.

Meier, C. et al. (1992). "Peptide Nucleic Acids (PNAs)—Unusual Properties of Nonionic Oligonucleotide Analogues," *Angew Chem. Int. ed. Engl.* 31(8):1008-1010.

Mikkers ,H. et al. (2002). "High-Throughput Retroviral Tagging to Identify Components of Specific Signaling Pathways in Cancer," *Nature Genetics Advance Online Publication*, pp. 1-7.

Moore, A. S. (2001). "The Role of Chemoattraction in Cancer Metastases," *BioEssays* 23:674-676.

Morrison, S. L. (1994). "Success in Specification," *Nature* 368:812-813.

Müller, A. et al. (2001). "Involvement of Chemokine Receptors in Breast Cancer Metastasis," *Nature* 410:50-56.

Needleman, S. B. and Wunsch, C. D. (1970). "A General Method Applicable to the Search for Similiarities in the Amino Acid Sequence of Two Proteins," *J. Mol. Biol.* 48:443.

Neuberger, M. (1996). "Generating High-Avidity Human Mabs in Mice," *Nature Biotechnology* 14:826 (1 page total).

Nygren, H. (1982). "Conjugation of Horseradish Peroxidase to Fab Fragments with Different Homobifunctional and Heterobifunctional Cross-Linking Reagents," *Histochem and Cytochem* 30:407-412.

Paborsky, L. R. et al. (1990). "Mammalian Cell Transient Expression of Tissue Factor for the Production of Antigen," *Protein Engineering* 3(6):547-553.

Pain, D. et al. (1981). "Preparation of Protein A-Peroxidase Monoconjugate Using A. Heterobifunctional Reagent, and its usein Enzyme Immunoassays," *J. Immunol. Meth.* 40:219-230.

Pauwels, R. et al. (1986). "Biological Activity of New 2-5A Analogues," *Chemica Scripta* 26:141-145.

Pearson, W. R. & Lipman, D. J. (1988). "Improved Tools for Biological Sequence Comparison," *PNAS USA* 85:2444-2448.

Pierce (1994). "Cross-Linking," *Pierce Catalog and Handbook* pp. 155-200.

Presta, L. G. (1992). "Antibody Engineering", *Current Opinion in Structural Biology* 2:593-596.

Rawls, R. L. (1997). "Optimistic About Antisense," *C & E. News* 35-40.

Riechmann, L. et al. (1988). "Reshaping Human Antibodies for Therapy," *Nature* 332:323-327.

Sambrook, J. et al., eds. (1989). *Molecular Cloning, a Laboratory Manual*, Second Edition. Cold Spring Harbor Laboraroty Press. pp. xi-xxxviii. (Table of Contents Only).

Scopes, R. K.,ed. (1982). *Protein Purification: Principles and Practice*. Springer-Verlag,:New York, Heidelberg, Berlin, pp. xi-xiii.

Smith, T. F. and Waterman, M. S. (1981). "Comparison of Biosequences," *Adv. Appl. Math.* 2:482-489.

Sojar, H. T. and Bahl, O. P. (1987). "A Chemical Method for the Deglycosylation of Proteins," *Archives of Biochemistry and Biophysics* 52-57.

Sorensen, A. B. (1993). "Amplification and Sequence Analysis of DNA Flanking Integrated Proviruses by a Simple Two-Step Polymerase Chain Reaction Method," *Journal of Virology* 67(12):7118-7124.

Sorensen, A. B. et al. (1993). "Sequence Tags for Provirus Integration Sites in DNAs of Tumors Induced by the Murine Retrovirus SL3-3," *J. Virology* 70(6):4063-4070.

Sorensen, A. B. et al. (2000). "Sint1, a Common Integration Site in SL3-3-Induced T-Cell Lymphomas, Harbors a Putative Proto-Oncogene with Homology to the Septin Gene Family," *J. Virology* 74(5):2161-2168.

Sprinzl, M. et al. (1977). "Enzymatic Incorporation of ATP and CTP Analogues Into the 3' End of tRNA," *Eur. J. Biochem* 81:579-589.

Stein, C. A. and Cohen, J. S. (1988). "Oligodeoxynucleotides as Inhibitors of Gene Expression: A Review," *Cancer Res.* 48:2659-2668.

Suzuki, T. et al. (2002). "New Genes Involved in Cancer Identified by Retroviral Tagging," Nature *Genetics Advance Online Publication* pp. 1-9.

Suzuki, T. et al. (2002). Retroviral Tagging in the Post-Genome Era Identifies New Genes Involved in Cancer. (1 page total).

Thotakura, N. R. and Bahl, O. P. (1987). Enzymathis Deglycylation of Glycoproteins, In *Methods in Enzymology* vol. 138. Academic Press, Inc., pp. 350-359.

Tijssen (1993). "Overview of Principles of Hybridization and the strategy of nucleic acid assays," Chapter 2 In *Laboratory Techniques in Biochemistry and Molecular Biology*, vol. 24 Vliet, P. C., ed. Elsevier, Amsterdam, London, New York, and Tokyo, pp. 20-78.

Van der Krol, A. R. et al. (1988). "Modulation of Eurkaryotic Gene Expression by Complementary RNA or DNA Sequences," 6(10):958-976.

Varmus, H. E. (1983). "Using Retroviruses as Insertional Mutagens to Identify Cellular Oncogenes," In *Oncogenes and Retroviruses: Evaluation of Basic Findings and Clinical Potential*. Alan R. Liss, Inc., New York. pp. 23-35.

Vaughn, J. et al. (2000). "Genomic Structure and Expression of Human *KCNJ9* (Kir3.3/GIRK3)," *Biochem. Biophys. Res. Commun* 274(2):302-309.

Verhoeyen, M. et al. (1988). "Reshaping Human Antibodies: Grafting an Antilysozyme Activity," *Science* 239:1534-1536.

von Kiedrowski, G. et al. (1991). "Parabolic Growth of a Self-Replicating Hexdeoxynucleotide Bearing a 3'-5'-Phosphoamidate Linkage," *Angew. Chem. Int. Ed. Engl* 30(4):423-426.

Washington University. (2002). "Washington University BLAST Archives" located at http://blast.wustl visited on Dec. 15, 2002.

Wolford, J. K. (2001). "Analysis of Linkage Disequilibrium Between Polymorphisms in the *KCNJ9* Gene with Type 2 Diabetes Mellitus in Pima Indians," *Mol. Genet. Metab* 73(1):97-103.

Zhang, W-X and Yang, S.Y. (2000). "Cloning and Characterization of a New Member of the T-Box Gene Family," *Genomics* 70(1):41-48.

Zlokarnik, G. et al. (1998). "Quantitation of Transcription and Clonal Selection of Single Liviing Cells with β-Lactamase as Reporter," *Science* 279:84-88.

International Search Report mailed on Dec. 1, 2003, for PCT patent application No. PCT/US02/33835 filed on Oct. 22, 2002, 4 pages.

GenBank Accession No. AF357835. Sasaki, S.et al. (2000 ). "Cloning and Expression of Human B Cell-Specific Transcription Factor BACH$_2$ Mapped to Chromosome 6q15," *Oncogene* 19:3739-3749. (Abstract Only).

Sasaki, S.et al. (2000). "Cloning and Expression of Human B Cell-Specific Transcription Factor BACH$_2$ Mapped to Chromosome 6q15," *Oncogene* 19:3739-3749.

International Search Report mailed on Jun. 15, 2004, for PCT patent application No. PCT/US02/36071 filed on Nov. 8, 2002, 5 pages.

International Search Report mailed on Jun. 16, 2004, for PCT patent application No. PCT/US03/40082 filed on Dec. 15, 2003, 5 pages.

International Search Report mailed on Jul. 26, 2004, for PCT patent application No. PCT/US02/38582, filed on Dec. 2, 2002, 8 pages.

S. Katoh et al. "Sepiaterin reductase in blood of various animals and of leukemic rats." Biochimica et Biophysica Acta 370:378-388, 1974.

G. Smith et al. "New inhibitors of sepiaterin reductase." The Journal of Biological Chemistry 267(8):5599-5607, 1992.

Database GenCore Accession No. U78076, created on May 14, 1999, last visited on Oct. 24, 2004. Lee et al. "Cloning of Mouse Sepiapterin Reductase Gene and Characterization of its Promoter Region," Gene Sequence, *Biochim. Bioph. Acta.* (1999). vol. 1445, No. 1, pp. 165-171. MPSRCH Search Report, 2004 1 page.

International Search Report mailed on Nov. 10, 2004 for PCT patent application No. PCT/US02/41414 filed Dec. 26, 2002, 8 pages.

Search Report from EP08020946.3—2403, mailed Jun. 19, 2009.

Campbell, A. M. (1984). "The Production and Characterization of Rodent and Human Hybridomas," Chapter 1 In *Monoclonal Antibody Technology*. Burdon, R. H and van Knippenberg, P. H., eds, Elsevier, pp. 1-32.

Database GenCore on STN, Accession No. U52152, Schoots et al. "Cloning of Four Inwardly Rectifying Potassium Channels from Human," Direction Submission Mar. 25, 1996 amino Acid and Nucleic acid Sequences.

Datebase GenCore on STN, on Accession No. AF275818, Yang et al. Jul. 23, 2000. "A Family of Novel PR-Domain (PRDM) Genes as Candidate Tumor Supressors".

Hunter, W. M. and Greenwood, F. C. (1962). "Preparation of Iodine-131 Labelled Human Growth Hormone of High Specific Activity," *Nature* 194:495-496.

Jiang, G-L et al. (2000). "The Yin-Yang of PR-Domain Family Genes in Tumorigenesis," *Histol. Histopathol.* 15(1):109-117.

Sawai, H. et al. (1984). "Synthesis and Properties of Oligoadenylic Acids Containing 2'-5' Phosphoramide Linkage," *Chem. Lett.* pp. 805-808.

Schoots, O. et al. (1999). "Co-Expression of Human Kir3 Subunits Can Yield Channels with Different Functional Properties," *Cell Signal* 11(12):871-883.

Skinner, R. H. et al. (1991). "Use of the Glu-Glu-Phe C-Terminal Epitope for Rapid Purification of the Catalytic Domain of Normal and Mutant *Ras* GTPase-Activating Proteins," *J. Biol. Chem.* 266(22):14163-14166.

\* cited by examiner

COMPOSITIONS AND METHODS FOR CANCER

The present application is a continuing application of U.S. Ser. Nos. 09/747,377, filed Dec. 22, 2000 and 09/798,586, filed Mar. 2, 2001, and applications entitled Novel Compositions and Methods for Cancer filed Oct. 23, 2001, Nov. 8, 2001, Nov. 30, 2001, and Dec. 20, 2001, all of which are expressly incorporated herein by reference.

The Sequence Listing (containing SEQ ID NOS:1-1613) is submitted in accordance with 37 CFR §§1.821-1.825 and §§1.52(e) and 1.96(c) on three compact discs labeled "Computer Readable Form (CRF)", "Copy 1" and "Copy 2", the contents of which are the same and are expressly incorporated herein by reference. The file names are A71249.ST25, contain 16,870,127 bytes, and were recorded on May 29, 2002.

FIELD OF THE INVENTION

The present invention relates to novel sequences for use in diagnosis and treatment of cancer, especially carcinomas, as well as the use of the novel compositions in screening methods.

BACKGROUND OF THE INVENTION

Oncogenes are genes that can cause cancer. Carcinogenesis can occur by a wide variety of mechanisms, including infection of cells by viruses containing oncogenes, activation of protooncogenes in the host genome, and mutations of protooncogenes and tumor suppressor genes.

There are a number of viruses known to be involved in human cancer as well as in animal cancer. Of particular interest here are viruses that do not contain oncogenes themselves; these are slow-transforming retroviruses. They induce tumors by integrating into the host genome and affecting neighboring protooncogenes in a variety of ways, including promoter insertion, enhancer insertion, and/or truncation of a protooncogene or tumor suppressor gene. The analysis of sequences at or near the insertion sites led to the identification of a number of new protooncogenes.

With respect to lymphoma and leukemia, murine leukemia retrovirus (MuLV), such as SL3-3 or Akv, is a potent inducer of tumors when inoculated into susceptible newborn mice, or when carried in the germline. A number of sequences have been identified as relevant in the induction of lymphoma and leukemia by analyzing the insertion sites; see Sorensen et al., J. of Virology 74:2161 (2000); Hansen et al., Genome Res. 10(2):237-43 (2000); Sorensen et al., J. Virology 70:4063 (1996); Sorensen et al., J. Virology 67:7118 (1993); Joosten et al., Virology 268:308 (2000); and Li et al., Nature Genetics 23:348 (1999); all of which are expressly incorporated by reference herein.

Lymphomas are a collection of cancers involving the lymphatic system and are generally categorized as Hodgkin's disease and Non-Hodgkin lymphoma. Hodgkin's lymphomas are of B lymphocyte origin. Non-Hodgkin lymphomas are a collection of over 30 different types of cancers including T and B lymphomas. Leukemia is a disease of the blood forming tissues and includes B and T cell lymphocytic leukemias. It is characterized by an abnormal and persistent increase in the number of leukocytes and the amount of bone marrow, with enlargement of the spleen and lymph nodes.

Breast cancer is one of the most significant diseases that affects women. At the current rate, American women have a 1 in 8 risk of developing breast cancer by age 95 (American Cancer Society, 1992). Treatment of breast cancer at later stages is often futile and disfiguring, making early detection a high priority in medical management of the disease.

Accordingly, it is an object of the invention to provide sequences involved in cancer and in particular in oncogenesis.

SUMMARY OF THE INVENTION

In accordance with the objects outlined above, the present invention provides methods for screening for compositions which modulate carcinomas, especially lymphoma and leukemia. Also provided herein are methods of inhibiting proliferation of a cell, preferably a lymphoma cell. Methods of treatment of carcinomas, including diagnosis, are also provided herein.

In one aspect, a method of screening drug candidates comprises providing a cell that expresses a carcinoma associated (CA) gene or fragments thereof. Preferred embodiments of CA genes are genes which are differentially expressed in cancer cells, preferably lymphatic, breast, prostate or epithelial cells, compared to other cells. Preferred embodiments of CA genes used in the methods herein include, but are not limited to the nucleic acids selected from Tables 1-112. The method further includes adding a drug candidate to the cell and determining the effect of the drug candidate on the expression of the CA gene.

In one embodiment, the method of screening drug candidates includes comparing the level of expression in the absence of the drug candidate to the level of expression in the presence of the drug candidate.

Also provided herein is a method of screening for a bioactive agent capable of binding to a CA protein (CAP), the method comprising combining the CAP and a candidate bioactive agent, and determining the binding of the candidate agent to the CAP.

Further provided herein is a method for screening for a bioactive agent capable of modulating the activity of a CAP. In one embodiment, the method comprises combining the CAP and a candidate bioactive agent, and determining the effect of the candidate agent on the bioactivity of the CAP.

Also provided is a method of evaluating the effect of a candidate carcinoma drug comprising administering the drug to a patient and removing a cell sample from the patient. The expression profile of the cell is then determined. This method may further comprise comparing the expression profile of the patient to an expression profile of a healthy individual.

In a further aspect, a method for inhibiting the activity of an CA protein is provided. In one embodiment, the method comprises administering to a patient an inhibitor of a CA protein preferably selected from the group consisting of the sequences outlined in Tables 1-112 or their complements.

A method of neutralizing the effect of a CA protein, preferably a protein encoded by a nucleic acid selected from the group of sequences outlined in Tables 1-112, is also provided. Preferably, the method comprises contacting an agent specific for said protein with said protein in an amount sufficient to effect neutralization.

Moreover, provided herein is a biochip comprising a nucleic acid segment which encodes a CA protein, preferably selected from the sequences outlined in Tables 1-112.

Also provided herein is a method for diagnosing or determining the propensity to carcinomas, especially lymphoma or leukemia by sequencing at least one carcinoma or lymphoma gene of an individual. In yet another aspect of the invention, a method is provided for determining carcinoma including lymphoma and leukemia gene copy number in an individual.

DETAILED DESCRIPTION OF THE INVENTION

Novel sequences are also provided herein. Other aspects of the invention will become apparent to the skilled artisan by the following description of the invention.

The present invention is directed to a number of sequences associated with carcinomas, especially lymphoma, breast cancer or prostate cancer. The relatively tight linkage between clonally-integrated proviruses and protooncogenes forms "provirus tagging", in which slow-transforming retroviruses that act by an insertion mutation mechanism are used to isolate protooncogenes. In some models, uninfected animals have low cancer rates, and infected animals have high cancer rates. It is known that many of the retroviruses involved do not carry transduced host protooncogenes or pathogenic trans-acting viral genes, and thus the cancer incidence must therefor be a direct consequence of proviral integration effects into host protooncogenes. Since proviral integration is random, rare integrants will "activate" host protooncogenes that provide a selective growth advantage, and these rare events result in new proviruses at clonal stoichiometries in tumors.

The use of oncogenic retroviruses, whose sequences insert into the genome of the host organism resulting in carcinoma, allows the identification of host sequences involved in carcinoma. These sequences may then be used in a number of different ways, including diagnosis, prognosis, screening for modulators (including both agonists and antagonists), antibody generation (for immunotherapy and imaging), etc. However, as will be appreciated by those in the art, oncogenes that are identified in one type of cancer such as lymphoma or leukemia have a strong likelihood of being involved in other types of cancers as well. Thus, while the sequences outlined herein are initially identified as correlated with lymphoma, they can also be found in other types of cancers as well, outlined below.

Accordingly, the present invention provides nucleic acid and protein sequences that are associated with carcinoma, herein termed "carcinoma associated" or "CA" sequences. In a preferred embodiment, the present invention provides nucleic acid and protein sequences that are associated with carcinomas which originate in lymphatic tissue, herein termed "lymphoma associated", "leukemia associated" or "LA" sequences.

Suitable cancers which can be diagnosed or screened for using the methods of the present invention include cancers classified by site or by histological type. Cancers classified by site include cancer of the oral cavity and pharynx (lip, tongue, salivary gland, floor of mouth, gum and other mouth, nasopharynx, tonsil, oropharynx, hypopharynx, other oral/pharynx); cancers of the digestive system (esophagus; stomach; small intestine; colon and rectum; anus, anal canal, and anorectum; liver; intrahepatic bile duct; gallbladder; other biliary; pancreas; retroperitoneum; peritoneum, omentum, and mesentery; other digestive); cancers of the respiratory system (nasal cavity, middle ear, and sinuses; larynx; lung and bronchus; pleura; trachea, mediastinum, and other respiratory); cancers of the mesothelioma; bones and joints; and soft tissue, including heart; skin cancers, including melanomas and other non-epithelial skin cancers; Kaposi's sarcoma and breast cancer; cancer of the female genital system (cervix uteri; corpus uteri; uterus, nos; ovary; vagina; vulva; and other female genital); cancers of the male genital system (prostate gland; testis; penis; and other male genital); cancers of the urinary system (urinary bladder; kidney and renal pelvis; ureter; and other urinary); cancers of the eye and orbit; cancers of the brain and nervous system (brain; and other nervous system); cancers of the endocrine system (thyroid gland and other endocrine, including thymus); cancers of the lymphomas (hodgkin's disease and non-hodgkin's lymphoma), multiple myeloma, and leukemias (lymphocytic leukemia; myeloid leukemia; monocytic leukemia; and other leukemias).

Other cancers, classified by histological type, that may be associated with the sequences of the invention include, but are not limited to, Neoplasm, malignant; Carcinoma, NOS; Carcinoma, undifferentiated, NOS; Giant and spindle cell carcinoma; Small cell carcinoma, NOS; Papillary carcinoma, NOS; Squamous cell carcinoma, NOS; Lymphoepithelial carcinoma; Basal cell carcinoma, NOS; Pilomatrix carcinoma; Transitional cell carcinoma, NOS; Papillary transitional cell carcinoma; Adenocarcinoma, NOS; Gastrinoma, malignant; Cholangiocarcinoma; Hepatocellular carcinoma, NOS; Combined hepatocellular carcinoma and cholangiocarcinoma; Trabecular adenocarcinoma; Adenoid cystic carcinoma; Adenocarcinoma in adenomatous polyp; Adenocarcinoma, familial polyposis coli; Solid carcinoma, NOS; Carcinoid tumor, malignant; Branchiolo-alveolar adenocarcinoma; Papillary adenocarcinoma, NOS; Chromophobe carcinoma; Acidophil carcinoma; Oxyphilic adenocarcinoma; Basophil carcinoma; Clear cell adenocarcinoma, NOS; Granular cell carcinoma; Follicular adenocarcinoma, NOS; Papillary and follicular adenocarcinoma; Nonencapsulating sclerosing carcinoma; Adrenal cortical carcinoma; Endometroid carcinoma; Skin appendage carcinoma; Apocrine adenocarcinoma; Sebaceous adenocarcinoma; Ceruminous adenocarcinoma; Mucoepidermoid carcinoma; Cystadenocarcinoma, NOS; Papillary cystadenocarcinoma, NOS; Papillary serous cystadenocarcinoma; Mucinous cystadenocarcinoma, NOS; Mucinous adenocarcinoma; Signet ring cell carcinoma; Infiltrating duct carcinoma; Medullary carcinoma, NOS; Lobular carcinoma; Inflammatory carcinoma; Paget's disease, mammary; Acinar cell carcinoma; Adenosquamous carcinoma; Adenocarcinoma w/squamous metaplasia; Thymoma, malignant; Ovarian stromal tumor, malignant; Thecoma, malignant; Granulosa cell tumor, malignant; Androblastoma, malignant; Sertoli cell carcinoma; Leydig cell tumor, malignant; Lipid cell tumor, malignant; Paraganglioma, malignant; Extra-mammary paraganglioma, malignant; Pheochromocytoma; Glomangiosarcoma; Malignant melanoma, NOS; Amelanotic melanoma; Superficial spreading melanoma; Malig melanoma in giant pigmented nevus; Epithelioid cell melanoma; Blue nevus, malignant; Sarcoma, NOS; Fibrosarcoma, NOS; Fibrous histiocytoma, malignant; Myxosarcoma; Liposarcoma, NOS; Leiomyosarcoma, NOS; Rhabdomyosarcoma, NOS; Embryonal rhabdomyosarcoma; Alveolar rhabdomyosarcoma; Stromal sarcoma, NOS; Mixed tumor, malignant, NOS; Mullerian mixed tumor; Nephroblastoma; Hepatoblastoma; Carcinosarcoma, NOS; Mesenchymoma, malignant; Brenner tumor, malignant; Phyllodes tumor, malignant; Synovial sarcoma, NOS; Mesothelioma, malignant; Dysgerminoma; Embryonal carcinoma, NOS; Teratoma, malignant, NOS; Struma ovari, malignant; Choriocarcinoma; Mesonephroma, malignant; Hemangiosarcoma; Hemangioendothelioma, malignant; Kaposi's sarcoma; Hemangiopericytoma, malignant; Lymphangiosarcoma; Osteosarcoma, NOS; Juxtacortical osteosarcoma; Chondrosarcoma, NOS; Chondroblastoma, malignant; Mesenchymal chondrosarcoma; Giant cell tumor of bone; Ewing's sarcoma; Odontogenic tumor, malignant; Ameloblastic odontosarcoma; Ameloblastoma, malignant; Ameloblastic fibrosarcoma; Pinealoma, malignant; Chordoma; Glioma, malignant; Ependymoma, NOS; Astrocytoma, NOS; Protoplasmic astrocytoma; Fibrillary astrocytoma; Astroblastoma; Glioblastoma, NOS; Oligodendroglioma, NOS; Oligodendroblastoma; Primitive neuroectodermal; Cerebellar sarcoma, NOS; Ganglioneuroblastoma; Neuroblastoma, NOS; Retinoblastoma, NOS; Olfactory neurogenic tumor; Meningioma, malignant; Neurofibrosarcoma; Neurilemmoma, malignant; Granular cell tumor, malignant; Malignant lymphoma, NOS; Hodgkin's disease, NOS; Hodgkin's; paragranuloma, NOS; Malignant lymphoma, small lymphocytic; Malignant lymphoma, large cell, diffuse; Malignant lymphoma, follicular, NOS; Mycosis fungoides; Other specified non-Hodgkin's lymphomas; Malignant histiocytosis; Multiple myeloma; Mast cell sarcoma; Immunoproliferative small intestinal disease; Leukemia, NOS; Lymphoid leukemia, NOS; Plasma cell leukemia; Erythroleukemia; Lymphosarcoma cell leukemia; Myeloid leukemia, NOS; Basophilic leukemia; Eosinophilic leukemia; Monocytic leukemia, NOS; Mast cell leukemia; Megakaryoblastic leukemia; Myeloid sarcoma; and Hairy cell leukemia.

In addition, the genes may be involved in other diseases, such as but not limited to diseases associated with aging or neurodegenerative diseases.

Association in this context means that the nucleotide or protein sequences are either differentially expressed, activated, inactivated or altered in carcinomas as compared to normal tissue. As outlined below, CA sequences include those that are up-regulated (i.e. expressed at a higher level), as well as those that are down-regulated (i.e. expressed at a lower level), in carcinomas. CA sequences also include sequences which have been altered (i.e., truncated sequences or sequences with substitutions, deletions or insertions, including point mutations) and show either the same expression profile or an altered profile. In a preferred embodiment, the CA sequences are from humans; however, as will be appreciated by those in the art, CA sequences from other organisms may be useful in animal models of disease and drug evaluation; thus, other CA sequences are provided, from vertebrates, including mammals, including rodents (rats, mice, hamsters, guinea pigs, etc.), primates, farm animals (including sheep, goats, pigs, cows, horses, etc). In some cases, prokaryotic CA sequences may be useful. CA sequences from other organisms may be obtained using the techniques outlined below.

CA sequences can include both nucleic acid and amino acid sequences. In a preferred embodiment, the CA sequences are recombinant nucleic acids. By the term "recombinant nucleic acid" herein is meant nucleic acid, originally formed in vitro, in general, by the manipulation of nucleic acid by polymerases and endonucleases, in a form not normally found in nature. Thus an isolated nucleic acid, in a linear form, or an expression vector formed in vitro by ligating DNA molecules that are not normally joined, are both considered recombinant for the purposes of this invention. It is understood that once a recombinant nucleic acid is made and reintroduced into a host cell or organism, it will replicate non-recombinantly, i.e. using the in vivo cellular machinery of the host cell rather than in vitro manipulations; however, such nucleic acids, once produced recombinantly, although subsequently replicated non-recombinantly, are still considered recombinant for the purposes of the invention.

Similarly, a "recombinant protein" is a protein made using recombinant techniques, i.e. through the expression of a recombinant nucleic acid as depicted above. A recombinant protein is distinguished from naturally occurring protein by at least one or more characteristics. For example, the protein may be isolated or purified away from some or all of the proteins and compounds with which it is normally associated in its wild type host, and thus may be substantially pure. For example, an isolated protein is unaccompanied by at least some of the material with which it is normally associated in its natural state, preferably constituting at least about 0.5%, more preferably at least about 5% by weight of the total protein in a given sample. A substantially pure protein comprises at least about 75% by weight of the total protein, with at least about 80% being preferred, and at least about 90% being particularly preferred. The definition includes the production of an CA protein from one organism in a different organism or host cell. Alternatively, the protein may be made at a significantly higher concentration than is normally seen, through the use of an inducible promoter or high expression promoter, such that the protein is made at increased concentration levels. Alternatively, the protein may be in a form not normally found in nature, as in the addition of an epitope tag or amino acid substitutions, insertions and deletions, as discussed below.

In a preferred embodiment, the CA sequences are nucleic acids. As will be appreciated by those in the art and is more fully outlined below, CA sequences are useful in a variety of applications, including diagnostic applications, which will detect naturally occurring nucleic acids, as well as screening applications; for example, biochips comprising nucleic acid probes to the CA sequences can be generated. In the broadest sense, then, by "nucleic acid" or "oligonucleotide" or grammatical equivalents herein means at least two nucleotides covalently linked together. A nucleic acid of the present invention will generally contain phosphodiester bonds, although in some cases, as outlined below (for example in antisense applications or when a candidate agent is a nucleic acid), nucleic acid analogs may be used that have alternate backbones, comprising, for example, phosphoramidate (Beaucage et al., Tetrahedron 49(10):1925 (1993) and references therein; Letsinger, J. Org. Chem. 35:3800 (1970); Sprinzl et al., Eur. J. Biochem. 81:579 (1977); Letsinger et al., Nucl. Acids Res. 14:3487 (1986); Sawai et al, Chem. Lett. 805 (1984), Letsinger et al., J. Am. Chem. Soc. 110:4470 (1988); and Pauwels et al., Chemica Scripta 26:141 91986)), phosphorothioate (Mag et al., Nucleic Acids Res. 19:1437 (1991); and U.S. Pat. No. 5,644,048), phosphorodithioate (Briu et al., J. Am. Chem. Soc. 111:2321 (1989), O-methylphophoroamidite linkages (see Eckstein, Oligonucleotides and Analogues: A Practical Approach, Oxford University Press), and peptide nucleic acid backbones and linkages (see Egholm, J. Am. Chem. Soc. 114:1895 (1992); Meier et al., Chem. Int. Ed. Engl. 31:1008 (1992); Nielsen, Nature, 365: 566 (1993); Carlsson et al., Nature 380:207 (1996), all of which are incorporated by reference). Other analog nucleic acids include those with positive backbones (Denpcy et al., Proc. Natl. Acad. Sci. USA 92:6097 (1995); non-ionic backbones (U.S. Pat. Nos. 5,386,023, 5,637,684, 5,602,240, 5,216,141 and 4,469,863; Kiedrowshi et al., Angew. Chem. Intl. Ed. English 30:423 (1991); Letsinger et al., J. Am. Chem. Soc. 110:4470 (1988); Letsinger et al., Nucleoside & Nucleotide 13:1597 (1994); Chapters 2 and 3, ASC Symposium Series 580, "Carbohydrate Modifications in Antisense Research", Ed. Y. S. Sanghui and P. Dan Cook; Mesmaeker et al., Bioorganic & Medicinal Chem. Lett. 4:395 (1994); Jeffs et al., J. Biomolecular NMR 34:17 (1994); Tetrahedron Lett. 37:743 (1996)) and non-ribose backbones, including those described in U.S. Pat. Nos. 5,235,033 and 5,034,506, and Chapters 6 and 7, ASC Symposium Series 580, "Carbohydrate Modifications in Antisense Research", Ed. Y. S. Sanghui and P. Dan Cook. Nucleic acids containing one or more carbocyclic sugars are also included within one definition of nucleic acids (see Jenkins et al., Chem. Soc. Rev. (1995) pp 169-176). Several nucleic acid analogs are described in Rawls, C & E News Jun. 2, 1997 page 35. All of these references are hereby expressly incorporated by reference. These modifications of the ribose-phosphate backbone may be done for a variety of reasons, for example to increase the stability and half-life of such molecules in physiological environments for use in anti-sense applications or as probes on a biochip.

As will be appreciated by those in the art, all of these nucleic acid analogs may find use in the present invention. In addition, mixtures of naturally occurring nucleic acids and analogs can be made; alternatively, mixtures of different nucleic acid analogs, and mixtures of naturally occurring nucleic acids and analogs may be made.

The nucleic acids may be single stranded or double stranded, as specified, or contain portions of both double stranded or single stranded sequence. As will be appreciated by those in the art, the depiction of a single strand "Watson" also defines the sequence of the other strand "Crick"; thus the sequences described herein also includes the complement of the sequence. The nucleic acid may be DNA, both genomic and cDNA, RNA or a hybrid, where the nucleic acid contains any combination of deoxyribo- and ribo-nucleotides, and any combination of bases, including uracil, adenine, thymine, cytosine, guanine, inosine, xanthine hypoxanthine, isocytosine, isoguanine, etc. As used herein, the term "nucleoside" includes nucleotides and nucleoside and nucleotide analogs, and modified nucleosides such as amino modified nucleosides. In addition, "nucleoside" includes non-naturally occurring analog structures. Thus for example the individual units of a peptide nucleic acid, each containing a base, are referred to herein as a nucleoside.

An CA sequence can be initially identified by substantial nucleic acid and/or amino acid sequence homology to the CA sequences outlined herein. Such homology can be based upon the overall nucleic acid or amino acid sequence, and is generally determined as outlined below, using either homology programs or hybridization conditions.

The CA sequences of the invention were initially identified as described herein; basically, infection of mice with murine leukemia viruses (MLV) resulted in lymphoma, although many of these sequences will also be involved in other cancers as is generally outlined herein.

The CA sequences outlined herein comprise the insertion sites for the virus. In general, the retrovirus can cause carcinomas in three basic ways: first of all, by inserting upstream of a normally silent host gene and activating it (e.g. promoter insertion); secondly, by truncating a host gene that leads to oncogenesis; or by enhancing the transcription of a neighboring gene. For example, retrovirus enhancers, including SL3-3, are known to act on genes up to approximately 200 kilobases of the insertion site.

In a preferred embodiment, CA sequences are those that are up-regulated in carcinomas; that is, the expression of these genes is higher in carcinoma tissue as compared to normal tissue of the same differentiation stage. "Up-regulation" as used herein means at least about 50%, more preferably at least about 100%, more preferably at least about 150%, more preferably, at least about 200%, with from 300 to at least 1000% being especially preferred.

In a preferred embodiment, CA sequences are those that are down-regulated in carcinomas; that is, the expression of these genes is lower in carcinoma tissue as compared to normal I tissue of the same differentiation stage. "Down-regulation" as used herein means at least about 50%, more preferably at least about 100%, more preferably at least about 150%, more preferably, at least about 200%, with from 300 to at least 1000% being especially preferred.

In a preferred embodiment, CA sequences are those that are altered but show either the same expression profile or an altered profile as compared to normal lymphoid tissue of the same differentiation stage. "Altered CA sequences" as used herein refers to sequences which are truncated, contain insertions or contain point mutations.

CA proteins of the present invention may be classified as secreted proteins, transmembrane proteins or intracellular proteins.

In a preferred embodiment the CA protein is an intracellular protein. Intracellular proteins may be found in the cytoplasm and/or in the nucleus. Intracellular proteins are involved in all aspects of cellular function and replication (including, for example, signaling pathways); aberrant expression of such proteins results in unregulated or disregulated cellular processes. For example, many intracellular proteins have enzymatic activity such as protein kinase activity, protein phosphatase activity, protease activity, nucleotide cyclase activity, polymerase activity and the like. Intracellular proteins also serve as docking proteins that are involved in organizing complexes of proteins, or targeting proteins to various subcellular localizations, and are involved in maintaining the structural integrity of organelles.

An increasingly appreciated concept in characterizing intracellular proteins is the presence in the proteins of one or more motifs for which defined functions have been attributed. In addition to the highly conserved sequences found in the enzymatic domain of proteins, highly conserved sequences have been identified in proteins that are involved in protein-protein interaction. For example, Src-homology-2 (SH2) domains bind tyrosine-phosphorylated targets in a sequence dependent manner. PTB domains, which are distinct from SH2 domains, also bind tyrosine phosphorylated targets. SH3 domains bind to proline-rich targets. In addition, PH domains, tetratricopeptide repeats and WD domains to name only a few, have been shown to mediate protein-protein interactions. Some of these may also be involved in binding to phospholipids or other second messengers. As will be appreciated by one of ordinary skill in the art, these motifs can be identified on the basis of primary sequence; thus, an analysis of the sequence of proteins may provide insight into both the enzymatic potential of the molecule and/or molecules with which the protein may associate.

In a preferred embodiment, the CA sequences are transmembrane proteins. Transmembrane proteins are molecules that span the phospholipid bilayer of a cell. They may have an intracellular domain, an extracellular domain, or both. The intracellular domains of such proteins may have a number of functions including those already described for intracellular proteins. For example, the intracellular domain may have enzymatic activity and/or may serve as a binding site for additional proteins. Frequently the intracellular domain of transmembrane proteins serves both roles. For example certain receptor tyrosine kinases have both protein kinase activity and SH2 domains. In addition, autophosphorylation of tyrosines on the receptor molecule itself, creates binding sites for additional SH2 domain containing proteins.

Transmembrane proteins may contain from one to many transmembrane domains. For example, receptor tyrosine kinases, certain cytokine receptors, receptor guanylyl cyclases and receptor serine/threonine protein kinases contain a single transmembrane domain. However, various other proteins including channels and adenylyl cyclases contain numerous transmembrane domains. Many important cell surface receptors are classified as "seven transmembrane domain" proteins, as they contain 7 membrane spanning regions. Important transmembrane protein receptors include, but are not limited to insulin receptor, insulin_like growth factor receptor, human growth hormone receptor, glucose transporters, transferrin receptor, epidermal growth factor receptor, low density lipoprotein receptor, epidermal growth factor receptor, leptin receptor, interleukin receptors, e.g. IL_1 receptor, IL_2 receptor, etc.

Characteristics of transmembrane domains include approximately 20 consecutive hydrophobic amino acids that may be followed by charged amino acids. Therefore, upon analysis of the amino acid sequence of a particular protein, the localization and number of transmembrane domains within the protein may be predicted.

The extracellular domains of transmembrane proteins are diverse; however, conserved motifs are found repeatedly among various extracellular domains. Conserved structure and/or functions have been ascribed to different extracellular motifs. For example, cytokine receptors are characterized by a cluster of cysteines and a WSXWS (W=tryptophan, S=serine, X=any amino acid (SEQ ID NO:1613) motif. Immunoglobulin-like domains are highly conserved. Mucin-like domains may be involved in cell adhesion and leucine-rich repeats participate in protein-protein interactions.

Many extracellular domains are involved in binding to other molecules. In one aspect, extracellular domains are receptors. Factors that bind the receptor domain include circulating ligands, which may be peptides, proteins, or small molecules such as adenosine and the like. For example, growth factors such as EGF, FGF and PDGF are circulating growth factors that bind to their cognate receptors to initiate a variety of cellular responses. Other factors include cytokines, mitogenic factors, neurotrophic factors and the like. Extracellular domains also bind to cell-associated molecules. In this respect, they mediate cell-cell interactions. Cell-associated ligands can be tethered to the cell for example via a glycosylphosphatidylinositol (GPI) anchor, or may themselves be transmembrane proteins. Extracellular domains also associate with the extracellular matrix and contribute to the maintenance of the cell structure.

CA proteins that are transmembrane are particularly preferred in the present invention as they are good targets for immunotherapeutics, as are described herein. In addition, as outlined below, transmembrane proteins can be also useful in imaging modalities.

It will also be appreciated by those in the art that a transmembrane protein can be made soluble by removing transmembrane sequences, for example through recombinant methods. Furthermore, transmembrane proteins that have been made soluble can be made to be secreted through recombinant means by adding an appropriate signal sequence.

In a preferred embodiment, the CA proteins are secreted proteins; the secretion of which can be either constitutive or regulated. These proteins have a signal peptide or signal sequence that targets the molecule to the secretory pathway. Secreted proteins are involved in numerous physiological events; by virtue of their circulating nature, they serve to transmit signals to various other cell types. The secreted protein may function in an autocrine manner (acting on the cell that secreted the factor), a paracrine manner (acting on cells in close proximity to the cell that secreted the factor) or an endocrine manner (acting on cells at a distance). Thus secreted molecules find use in modulating or altering numerous aspects of physiology. CA proteins that are secreted proteins are particularly preferred in the present invention as they serve as good targets for diagnostic markers, for example for blood tests.

An CA sequence is initially identified by substantial nucleic acid and/or amino acid sequence homology to the CA sequences outlined herein. Such homology can be based upon the overall nucleic acid or amino acid sequence, and is generally determined as outlined below, using either homology programs or hybridization conditions.

As used herein, a nucleic acid is a "CA nucleic acid" if the overall homology of the nucleic acid sequence to one of the nucleic acids of Tables 1-112 is preferably greater than about 75%, more preferably greater than about 80%, even more preferably greater than about 85% and most preferably greater than 90%. In some embodiments the homology will be as high as about 93 to 95 or 98%. In a preferred embodiment, the sequences which are used to determine sequence identity or similarity are selected from those of the nucleic acids of Tables 1-112. In another embodiment, the sequences are naturally occurring allelic variants of the sequences of the nucleic acids of Tables 1-112. In another embodiment, the sequences are sequence variants as further described herein.

Homology in this context means sequence similarity or identity, with identity being preferred. A preferred comparison for homology purposes is to compare the sequence containing sequencing errors to the correct sequence. This homology will be determined using standard techniques known in the art, including, but not limited to, the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, PNAS USA 85:2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., Nucl. Acid Res. 12:387-395 (1984), preferably using the default settings, or by inspection.

One example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, J. Mol. Evol. 35:351-360 (1987); the method is similar to that described by Higgins & Sharp CABIOS 5:151-153 (1989). Useful PILEUP parameters including a default gap weight of 3.00, a default gap length weight of 0.10, and weighted end gaps.

Another example of a useful algorithm is the BLAST algorithm, described in Altschul et al., J. Mol. Biol. 215, 403-410, (1990) and Karlin et al., PNAS USA 90:5873-5787 (1993). A particularly useful BLAST program is the WU-BLAST-2 program which was obtained from Altschul et al., Methods in Enzymology, 266: 460-480 (1996); http://blast.wustl]. WU-BLAST-2 uses several search parameters, most of which are set to the default values. The adjustable parameters are set with the following values: overlap span=1, overlap fraction 0.125, word threshold (T)=11. The HSP S and HSP S2 parameters are dynamic values and are established by the program itself depending upon the composition of the particular sequence and composition of the particular database against which the sequence of interest is being searched; however, the values may be adjusted to increase sensitivity. A % amino acid sequence identity value is determined by the number of matching identical residues divided by the total number of residues of the "longer" sequence in the aligned region. The "longer" sequence is the one having the most actual residues in the aligned region (gaps introduced by WU-Blast-2 to maximize the alignment score are ignored).

Thus, "percent (%) nucleic acid sequence identity" is defined as the percentage of nucleotide residues in a candidate sequence that are identical with the nucleotide residues of the nucleic acids of Tables 1-112. A preferred method utilizes the BLASTN module of WU-BLAST-2 set to the default parameters, with overlap span and overlap fraction set to 1 and 0.125, respectively.

The alignment may include the introduction of gaps in the sequences to be aligned. In addition, for sequences which contain either more or fewer nucleotides than those of the nucleic acids of Tables 1-112, it is understood that the percentage of homology will be determined based on the number of homologous nucleosides in relation to the total number of nucleosides. Thus, for example, homology of sequences shorter than those of the sequences identified herein and as discussed below, will be determined using the number of nucleosides in the shorter sequence.

In one embodiment, the nucleic acid homology is determined through hybridization studies. Thus, for example, nucleic acids which hybridize under high stringency to the nucleic acids identified in the figures, or their complements, are considered CA sequences. High stringency conditions are known in the art; see for example Maniatis et al., Molecular Cloning: A Laboratory Manual, 2d Edition, 1989, and Short Protocols in Molecular Biology, ed. Ausubel, et al., both of which are hereby incorporated by reference. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology-Hybridization with Nucleic Acid Probes, "Overview of principles of hybridization and the strategy of nucleic acid assays" (1993). Generally, stringent conditions are selected to be about 5-10° C. lower than the thermal melting point (Tm) for the specific sequence at a defined ionic strength pH. The Tm is the temperature (under defined ionic strength, pH and nucleic acid concentration) at which 50% of the probes complementary to the target hybridize to the target sequence at equilibrium (as the target sequences are present in excess, at Tm, 50% of the probes are occupied at equilibrium). Stringent conditions will be those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g. 10 to 50 nucleotides) and at least about 60° C. for long probes (e.g. greater than 50 nucleotides). Stringent conditions may also be achieved with the addition of destabilizing agents such as formamide.

In another embodiment, less stringent hybridization conditions are used; for example, moderate or low stringency conditions may be used, as are known in the art; see Maniatis and Ausubel, supra, and Tijssen, supra.

In addition, the CA nucleic acid sequences of the invention are fragments of larger genes, i.e. they are nucleic acid segments. Alternatively, the CA nucleic acid sequences can serve as indicators of oncogene position, for example, the CA sequence may be an enhancer that activates a protooncogene. "Genes" in this context includes coding regions, non-coding regions, and mixtures of coding and non-coding regions. Accordingly, as will be appreciated by those in the art, using the sequences provided herein, additional sequences of the CA genes can be obtained, using techniques well known in the art for cloning either longer sequences or the full length sequences; see Maniatis et al., and Ausubel, et al., supra, hereby expressly incorporated by reference. In general, this is done using PCR, for example, kinetic PCR.

Once the CA nucleic acid is identified, it can be cloned and, if necessary, its constituent parts recombined to form the entire CA nucleic acid. Once isolated from its natural source, e.g., contained within a plasmid or other vector or excised therefrom as a linear nucleic acid segment, the recombinant CA nucleic acid can be further used as a probe to identify and isolate other CA nucleic acids, for example additional coding regions. It can also be used as a "precursor" nucleic acid to make modified or variant CA nucleic acids and proteins.

The CA nucleic acids of the present invention are used in several ways. In a first embodiment, nucleic acid probes to the CA nucleic acids are made and attached to biochips to be used in screening and diagnostic methods, as outlined below, or for administration, for example for gene therapy and/or antisense applications. Alternatively, the CA nucleic acids that include coding regions of CA proteins can be put into expression vectors for the expression of CA proteins, again either for screening purposes or for administration to a patient.

In a preferred embodiment, nucleic acid probes to CA nucleic acids (both the nucleic acid sequences outlined in the figures and/or the complements thereof are made. The nucleic acid probes attached to the biochip are designed to be substantially complementary to the CA nucleic acids, i.e. the target sequence (either the target sequence of the sample or to other probe sequences, for example in sandwich assays), such that hybridization of the target sequence and the probes of the present invention occurs. As outlined below, this complementarity need not be perfect; there may be any number of base pair mismatches which will interfere with hybridization between the target sequence and the single stranded nucleic acids of the present invention. However, if the number of mutations is so great that no hybridization can occur under even the least stringent of hybridization conditions, the sequence is not a complementary target sequence. Thus, by "substantially complementary" herein is meant that the probes are sufficiently complementary to the target sequences to hybridize under normal reaction conditions, particularly high stringency conditions, as outlined herein.

A nucleic acid probe is generally single stranded but can be partially single and partially double stranded. The strandedness of the probe is dictated by the structure, composition, and properties of the target sequence. In general, the nucleic acid probes range from about 8 to about 100 bases long, with from about 10 to about 80 bases being preferred, and from about 30 to about 50 bases being particularly preferred. That is, generally whole genes are not used. In some embodiments, much longer nucleic acids can be used, up to hundreds of bases.

In a preferred embodiment, more than one probe per sequence is used, with either overlapping probes or probes to different sections of the target being used. That is, two, three, four or more probes, with three being preferred, are used to build in a redundancy for a particular target. The probes can be overlapping (i.e. have some sequence in common), or separate.

As will be appreciated by those in the art, nucleic acids can be attached or immobilized to a solid support in a wide variety of ways. By "immobilized" and grammatical equivalents herein is meant the association or binding between the nucleic acid probe and the solid support is sufficient to be stable under the conditions of binding, washing, analysis, and removal as outlined below. The binding can be covalent or non-covalent. By "non-covalent binding" and grammatical equivalents herein is meant one or more of either electrostatic, hydrophilic, and hydrophobic interactions. Included in non-covalent binding is the covalent attachment of a molecule, such as, streptavidin to the support and the non-covalent binding of the biotinylated probe to the streptavidin. By "covalent binding" and grammatical equivalents herein is meant that the two moieties, the solid support and the probe, are attached by at least one bond, including sigma bonds, pi bonds and coordination bonds. Covalent bonds can be formed directly between the probe and the solid support or can be formed by a cross linker or by inclusion of a specific reactive group on either the solid support or the probe or both molecules. Immobilization may also involve a combination of covalent and non-covalent interactions.

In general, the probes are attached to the biochip in a wide variety of ways, as will be appreciated by those in the art. As described herein, the nucleic acids can either be synthesized first, with subsequent attachment to the biochip, or can be directly synthesized on the biochip.

The biochip comprises a suitable solid substrate. By "substrate" or "solid support" or other grammatical equivalents herein is meant any material that can be modified to contain discrete individual sites appropriate for the attachment or association of the nucleic acid probes and is amenable to at least one detection method. As will be appreciated by those in the art, the number of possible substrates are very large, and include, but are not limited to, glass and modified or functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, resins, silica or silica_based materials including silicon and modified silicon, carbon, metals, inorganic glasses, etc. In general, the substrates allow optical detection and do not appreciably fluoresce.

In a preferred embodiment, the surface of the biochip and the probe may be derivatized with chemical functional groups for subsequent attachment of the two. Thus, for example, the biochip is derivatized with a chemical functional group including, but not limited to, amino groups, carboxy groups, oxo groups and thiol groups, with amino groups being particularly preferred. Using these functional groups, the probes can be attached using functional groups on the probes. For example, nucleic acids containing amino groups can be attached to surfaces comprising amino groups, for example using linkers as are known in the art; for example, homo- or hetero-bifunctional linkers as are well known (see 1994 Pierce Chemical Company catalog, technical section on cross_linkers, pages 155_200, incorporated herein by reference). In addition, in some cases, additional linkers, such as alkyl groups (including substituted and heteroalkyl groups) may be used.

In this embodiment, the oligonucleotides are synthesized as is known in the art, and then attached to the surface of the solid support. As will be appreciated by those skilled in the art, either the 5' or 3' terminus may be attached to the solid support, or attachment may be via an internal nucleoside.

In an additional embodiment, the immobilization to the solid support may be very strong, yet non-covalent. For example, biotinylated oligonucleotides can be made, which bind to surfaces covalently coated with streptavidin, resulting in attachment.

Alternatively, the oligonucleotides may be synthesized on the surface, as is known in the art. For example, photoactivation techniques utilizing photopolymerization compounds and techniques are used. In a preferred embodiment, the nucleic acids can be synthesized in situ, using well known photolithographic techniques, such as those described in WO 95/25116; WO 95/35505; U.S. Pat. Nos. 5,700,637 and 5,445,934; and references cited within, all of which are expressly incorporated by reference; these methods of attachment form the basis of the Affymetrix GeneChip technology.

In addition to the solid-phase technology represented by biochip arrays, gene expression can also be quantified using liquid-phase arrays. One such system is kinetic polymerase chain reaction (PCR). Kinetic PCR allows for the simultaneous amplification and quantification of specific nucleic acid sequences. The specificity is derived from synthetic oligonucleotide primers designed to preferentially adhere to single-stranded nucleic acid sequences bracketing the target site. This pair of oligonucleotide primers form specific, non-covalently bound complexes on each strand of the target sequence. These complexes facilitate in vitro transcription of double-stranded DNA in opposite orientations. Temperature cycling of the reaction mixture creates a continuous cycle of primer binding, transcription, and re-melting of the nucleic acid to individual strands. The result is an exponential increase of the target dsDNA product. This product can be quantified in real time either through the use of an intercalating dye or a sequence specific probe. SYBR® Greene I, is an example of an intercalating dye, that preferentially binds to dsDNA resulting in a concomitant increase in the fluorescent signal. Sequence specific probes, such as used with TaqMan® technology, consist of a fluorochrome and a quenching molecule covalently bound to opposite ends of an oligonucleotide. The probe is designed to selectively bind the target DNA sequence between the two primers. When the DNA strands are synthesized during the PCR reaction, the fluorochrome is cleaved from the probe by the exonuclease activity of the polymerase resulting in signal dequenching. The probe signaling method can be more specific than the intercalating dye method, but in each case, signal strength is proportional to the dsDNA product produced. Each type of quantification method can be used in multi-well liquid phase arrays with each well representing primers and/or probes specific to nucleic acid sequences of interest. When used with messenger RNA preparations of tissues or cell lines, and an array of probe/primer reactions can simultaneously quantify the expression of multiple gene products of interest. See Germer, S., et al., Genome Res. 10:258-266 (2000); Heid, C. A., et al., Genome Res. 6, 986-994 (1996).

In a preferred embodiment, CA nucleic acids encoding CA proteins are used to make a variety of expression vectors to express CA proteins which can then be used in screening assays, as described below. The expression vectors may be either self-replicating extrachromosomal vectors or vectors which integrate into a host genome. Generally, these expression vectors include transcriptional and translational regulatory nucleic acid operably linked to the nucleic acid encoding the CA protein. The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, synthetic oligonucleotide adaptors or linkers are used in accordance with conventional practice. The transcriptional and translational regulatory nucleic acid will generally be appropriate to the host cell used to express the CA protein; for example, transcriptional and translational regulatory nucleic acid sequences from *Bacillus* are preferably used to express the CA protein in *Bacillus*. Numerous types of appropriate expression vectors, and suitable regulatory sequences are known in the art for a variety of host cells.

In general, the transcriptional and translational regulatory sequences may include, but are not limited to, promoter sequences, ribosomal binding sites, transcriptional start and stop sequences, translational start and stop sequences, and enhancer or activator sequences. In a preferred embodiment, the regulatory sequences include a promoter and transcriptional start and stop sequences.

Promoter sequences encode either constitutive or inducible promoters. The promoters may be either naturally occurring promoters or hybrid promoters. Hybrid promoters, which combine elements of more than one promoter, are also known in the art, and are useful in the present invention.

In addition, the expression vector may comprise additional elements. For example, the expression vector may have two replication systems, thus allowing it to be maintained in two organisms, for example in mammalian or insect cells for expression and in a procaryotic host for cloning and amplification. Furthermore, for integrating expression vectors, the expression vector contains at least one sequence homologous to the host cell genome, and preferably two homologous sequences which flank the expression construct. The integrating vector may be directed to a specific locus in the host cell by selecting the appropriate homologous sequence for inclusion in the vector. Constructs for integrating vectors are well known in the art.

In addition, in a preferred embodiment, the expression vector contains a selectable marker gene to allow the selection of transformed host cells. Selection genes are well known in the art and will vary with the host cell used.

The CA proteins of the present invention are produced by culturing a host cell transformed with an expression vector containing nucleic acid encoding an CA protein, under the appropriate conditions to induce or cause expression of the CA protein. The conditions appropriate for CA protein expression will vary with the choice of the expression vector and the host cell, and will be easily ascertained by one skilled in the art through routine experimentation. For example, the use of constitutive promoters in the expression vector will require optimizing the growth and proliferation of the host cell, while the use of an inducible promoter requires the appropriate growth conditions for induction. In addition, in some embodiments, the timing of the harvest is important. For example, the baculoviral systems used in insect cell expression are lytic viruses, and thus harvest time selection can be crucial for product yield.

Appropriate host cells include yeast, bacteria, archaebacteria, fungi, and insect, plant and animal cells, including mammalian cells. Of particular interest are *Drosophila melanogaster* cells, *Saccharomyces cerevisiae* and other yeasts, *E. coli, Bacillus subtilis*, Sf9 cells, C129 cells, 293 cells, *Neurospora*, BHK, CHO, COS, HeLa cells, THP1 cell line (a macrophage cell line) and human cells and cell lines.

In a preferred embodiment, the CA proteins are expressed in mammalian cells. Mammalian expression systems are also known in the art, and include retroviral systems. A preferred expression vector system is a retroviral vector system such as is generally described in PCT/US97/01019 and PCT/US97/01048, both of which are hereby expressly incorporated by reference. Of particular use as mammalian promoters are the promoters from mammalian viral genes, since the viral genes are often highly expressed and have a broad host range. Examples include the SV40 early promoter, mouse mammary tumor virus LTR promoter, adenovirus major late promoter, herpes simplex virus promoter, and the CMV promoter. Typically, transcription termination and polyadenylation sequences recognized by mammalian cells are regulatory regions located 3' to the translation stop codon and thus, together with the promoter elements, flank the coding sequence. Examples of transcription terminator and polyadenlytion signals include those derived form SV40.

The methods of introducing exogenous nucleic acid into mammalian hosts, as well as other hosts, is well known in the art, and will vary with the host cell used. Techniques include dextran-mediated transfection, calcium phosphate precipitation, polybrene mediated transfection, protoplast fusion, electroporation, viral infection, encapsulation of the polynucleotide(s) in liposomes, and direct microinjection of the DNA into nuclei.

In a preferred embodiment, CA proteins are expressed in bacterial systems. Bacterial expression systems are well known in the art. Promoters from bacteriophage may also be used and are known in the art. In addition, synthetic promoters and hybrid promoters are also useful; for example, the tac promoter is a hybrid of the trp and lac promoter sequences. Furthermore, a bacterial promoter can include naturally occurring promoters of non-bacterial origin that have the ability to bind bacterial RNA polymerase and initiate transcription. In addition to a functioning promoter sequence, an efficient ribosome binding site is desirable. The expression vector may also include a signal peptide sequence that provides for secretion of the CA protein in bacteria. The protein is either secreted into the growth media (gram-positive bacteria) or into the periplasmic space, located between the inner and outer membrane of the cell (gram-negative bacteria). The bacterial expression vector may also include a selectable marker gene to allow for the selection of bacterial strains that have been transformed. Suitable selection genes include genes which render the bacteria resistant to drugs such as ampicillin, chloramphenicol, erythromycin, kanamycin, neomycin and tetracycline. Selectable markers also include biosynthetic genes, such as those in the histidine, tryptophan and leucine biosynthetic pathways. These components are assembled into expression vectors. Expression vectors for bacteria are well known in the art, and include vectors for *Bacillus subtilis, E. coli, Streptococcus cremoris*, and *Streptococcus lividans*, among others. The bacterial expression vectors are transformed into bacterial host cells using techniques well known in the art, such as calcium chloride treatment, electroporation, and others.

In one embodiment, CA proteins are produced in insect cells. Expression vectors for the transformation of insect cells, and in particular, baculovirus-based expression vectors, are well known in the art.

In a preferred embodiment, CA protein is produced in yeast cells. Yeast expression systems are well known in the art, and include expression vectors for *Saccharomyces cerevisiae, Candida albicans* and *C. maltosa, Hansenula polymorpha, Kluyveromyces fragilis* and *K. lactis, Pichia guillerimondii* and *P. pastoris, Schizosaccharomyces pombe*, and *Yarrowia lipolytica*.

The CA protein may also be made as a fusion protein, using techniques well known in the art. Thus, for example, for the creation of monoclonal antibodies. If the desired epitope is small, the CA protein may be fused to a carrier protein to form an immunogen. Alternatively, the CA protein may be made as a fusion protein to increase expression, or for other reasons. For example, when the CA protein is an CA peptide, the nucleic acid encoding the peptide may be linked to other nucleic acid for expression purposes.

In one embodiment, the CA nucleic acids, proteins and antibodies of the invention are labeled. By "labeled" herein is meant that a compound has at least one element, isotope or chemical compound attached to enable the detection of the compound. In general, labels fall into three classes: a) isotopic labels, which may be radioactive or heavy isotopes; b) immune labels, which may be antibodies or antigens; and c) colored or fluorescent dyes. The labels may be incorporated into the CA nucleic acids, proteins and antibodies at any position. For example, the label should be capable of producing, either directly or indirectly, a detectable signal. The detectable moiety may be a radioisotope, such as $^3$H, $^{14}$C, $^{32}$P, $^{35}$S, or $^{125}$I, a fluorescent or chemiluminescent compound, such as fluorescein isothiocyanate, rhodamine, or luciferin, or an enzyme, such as alkaline phosphatase, beta-galactosidase or horseradish peroxidase. Any method known in the art for conjugating the antibody to the label may be employed, including those methods described by Hunter et al., Nature, 144:945 (1962); David et al., Biochemistry, 13:1014 (1974); Pain et al., J. Immunol. Meth., 40:219 (1981); and Nygren, J. Histochem. and Cytochem., 30:407 (1982).

Accordingly, the present invention also provides CA protein sequences. An CA protein of the present invention may be identified in several ways. "Protein" in this sense includes proteins, polypeptides, and peptides. As will be appreciated by those in the art, the nucleic acid sequences of the invention can be used to generate protein sequences. There are a variety of ways to do this, including cloning the entire gene and verifying its frame and amino acid sequence, or by comparing it to known sequences to search for homology to provide a frame, assuming the CA protein has homology to some protein in the database being used. Generally, the nucleic acid sequences are input into a program that will search all three frames for homology. This is done in a preferred embodiment using the following NCBI Advanced BLAST parameters. The program is blastx or blastn. The database is nr. The input data is as "Sequence in FASTA format". The organism list is "none". The "expect" is 10; the filter is default. The "descriptions" is 500, the "alignments" is 500, and the "alignment view" is pairwise. The "query Genetic Codes" is standard (1). The matrix is BLOSUM62; gap existence cost is 11, per residue gap cost is 1; and the lambda ratio is 0.85 default. This results in the generation of a putative protein sequence.

Also included within one embodiment of CA proteins are amino acid variants of the naturally occurring sequences, as determined herein. Preferably, the variants are preferably greater than about 75% homologous to the wild-type sequence, more preferably greater than about 80%, even more preferably greater than about 85% and most preferably greater than 90%. In some embodiments the homology will be as high as about 93 to 95 or 98%. As for nucleic acids, homology in this context means sequence similarity or identity, with identity being preferred. This homology will be determined using standard techniques known in the art as are outlined above for the nucleic acid homologies.

CA proteins of the present invention may be shorter or longer than the wild type amino acid sequences. Thus, in a preferred embodiment, included within the definition of CA proteins are portions or fragments of the wild type sequences herein. In addition, as outlined above, the CA nucleic acids of the invention may be used to obtain additional coding regions, and thus additional protein sequence, using techniques known in the art.

In a preferred embodiment, the CA proteins are derivative or variant CA proteins as compared to the wild-type sequence. That is, as outlined more fully below, the derivative CA peptide will contain at least one amino acid substitution, deletion or insertion, with amino acid substitutions being particularly preferred. The amino acid substitution, insertion or deletion may occur at any residue within the CA peptide.

Also included in an embodiment of CA proteins of the present invention are amino acid sequence variants. These variants fall into one or more of three classes: substitutional, insertional or deletional variants. These variants ordinarily are prepared by site specific mutagenesis of nucleotides in the DNA encoding the CA protein, using cassette or PCR mutagenesis or other techniques well known in the art, to produce DNA encoding the variant, and thereafter expressing the DNA in recombinant cell culture as outlined above. However, variant CA protein fragments having up to about 100-150 residues may be prepared by in vitro synthesis using established techniques. Amino acid sequence variants are characterized by the predetermined nature of the variation, a feature that sets them apart from naturally occurring allelic or interspecies variation of the CA protein amino acid sequence. The variants typically exhibit the same qualitative biological activity as the naturally occurring analogue, although variants can also be selected which have modified characteristics as will be more fully outlined below.

While the site or region for introducing an amino acid sequence variation is predetermined, the mutation per se need not be predetermined. For example, in order to optimize the performance of a mutation at a given site, random mutagenesis may be conducted at the target codon or region and the expressed CA variants screened for the optimal combination of desired activity. Techniques for making substitution mutations at predetermined sites in DNA having a known sequence are well known, for example, M13 primer mutagenesis and LAR mutagenesis. Screening of the mutants is done using assays of CA protein activities.

Amino acid substitutions are typically of single residues; insertions usually will be on the order of from about 1 to 20 amino acids, although considerably larger insertions may be tolerated. Deletions range from about 1 to about 20 residues, although in some cases deletions may be much larger.

Substitutions, deletions, insertions or any combination thereof may be used to arrive at a final derivative. Generally these changes are done on a few amino acids to minimize the alteration of the molecule. However, larger changes may be tolerated in certain circumstances. When small alterations in the characteristics of the CA protein are desired, substitutions are generally made in accordance with the following chart:

CHART I

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |

CHART I-continued

| Original Residue | Exemplary Substitutions |
| --- | --- |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

Substantial changes in function or immunological identity are made by selecting substitutions that are less conservative than those shown in Chart I. For example, substitutions may be made which more significantly affect: the structure of the polypeptide backbone in the area of the alteration, for example the alpha-helical or beta-sheet structure; the charge or hydrophobicity of the molecule at the target site; or the bulk of the side chain. The substitutions which in general are expected to produce the greatest changes in the polypeptide's properties are those in which (a) a hydrophilic residue, e.g. seryl or threonyl is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine.

The variants typically exhibit the same qualitative biological activity and will elicit the same immune response as the naturally-occurring analogue, although variants also are selected to modify the characteristics of the CA proteins as needed. Alternatively, the variant may be designed such that the biological activity of the CA protein is altered. For example, glycosylation sites may be altered or removed, dominant negative mutations created, etc.

Covalent modifications of CA polypeptides are included within the scope of this invention, for example for use in screening. One type of covalent modification includes reacting targeted amino acid residues of an CA polypeptide with an organic derivatizing agent that is capable of reacting with selected side chains or the N- or C-terminal residues of an CA polypeptide. Derivatization with bifunctional agents is useful, for instance, for crosslinking CA polypeptides to a water-insoluble support matrix or surface for use in the method for purifying anti-CA antibodies or screening assays, as is more fully described below. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl, threonyl or tyrosyl residues, methylation of the a-amino groups of lysine, arginine, and histidine side chains [T. E. Creighton, Proteins: Structure and Molecular Properties, W.H. Freeman & Co., San Francisco, pp. 79-86 (1983)], acetylation of the N-terminal amine, and amidation of any C-terminal carboxyl group.

Another type of covalent modification of the CA polypeptide included within the scope of this invention comprises altering the native glycosylation pattern of the polypeptide. "Altering the native glycosylation pattern" is intended for purposes herein to mean deleting one or more carbohydrate moieties found in native sequence CA polypeptide, and/or adding one or more glycosylation sites that are not present in the native sequence CA polypeptide.

Addition of glycosylation sites to CA polypeptides may be accomplished by altering the amino acid sequence thereof. The alteration may be made, for example, by the addition of, or substitution by, one or more serine or threonine residues to the native sequence CA polypeptide (for O-linked glycosylation sites). The CA amino acid sequence may optionally be altered through changes at the DNA level, particularly by mutating the DNA encoding the CA polypeptide at preselected bases such that codons are generated that will translate into the desired amino acids.

Another means of increasing the number of carbohydrate moieties on the CA polypeptide is by chemical or enzymatic coupling of glycosides to the polypeptide. Such methods are described in the art, e.g., in WO 87/05330 published 11 Sep. 1987, and in Aplin and Wriston, La. Crit. Rev. Biochem., pp. 259-306 (1981).

Removal of carbohydrate moieties present on the CA polypeptide may be accomplished chemically or enzymatically or by mutational substitution of codons encoding for amino acid residues that serve as targets for glycosylation. Chemical deglycosylation techniques are known in the art and described, for instance, by Hakimuddin, et al., Arch. Biochem. Biophys., 259:52 (1987) and by Edge et al., Anal. Biochem., 118:131 (1981). Enzymatic cleavage of carbohydrate moieties on polypeptides can be achieved by the use of a variety of endo- and exo-glycosidases as described by Thotakura et al., Meth. Enzymol., 138:350 (1987).

Another type of covalent modification of CA comprises linking the CA polypeptide to one of a variety of nonproteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192 or 4,179,337.

CA polypeptides of the present invention may also be modified in a way to form chimeric molecules comprising an CA polypeptide fused to another, heterologous polypeptide or amino acid sequence. In one embodiment, such a chimeric molecule comprises a fusion of an CA polypeptide with a tag polypeptide which provides an epitope to which an anti-tag antibody can selectively bind. The epitope tag is generally placed at the amino- or carboxyl-terminus of the CA polypeptide, although internal fusions may also be tolerated in some instances. The presence of such epitope-tagged forms of an CA polypeptide can be detected using an antibody against the tag polypeptide. Also, provision of the epitope tag enables the CA polypeptide to be readily purified by affinity purification using an anti-tag antibody or another type of affinity matrix that binds to the epitope tag. In an alternative embodiment, the chimeric molecule may comprise a fusion of an CA polypeptide with an immunoglobulin or a particular region of an immunoglobulin. For a bivalent form of the chimeric molecule, such a fusion could be to the Fc region of an IgG molecule.

Various tag polypeptides and their respective antibodies are well known in the art. Examples include poly-histidine (poly-his) or poly-histidine-glycine (poly-his-gly) tags; the flu HA tag polypeptide and its antibody 12CA5 [Field et al., Mol. Cell. Biol., 8:2159-2165 (1988)]; the c-myc tag and the 8F9, 3C7, 6E10, G4, B7 and 9E10 antibodies thereto [Evan et al., Molecular and Cellular Biology, 5:3610-3616 (1985)]; and the Herpes Simplex virus glycoprotein D (gD) tag and its antibody [Paborsky et al., Protein Engineering, 3(6):547-553 (1990)]. Other tag polypeptides include the Flag-peptide [Hopp et al., BioTechnology, 6:1204-1210 (1988)]; the KT3 epitope peptide [Martin et al., Science, 255:192-194 (1992)]; tubulin epitope peptide [Skinner et al., J. Biol. Chem., 266: 15163-15166 (1991)]; and the T7 gene 10 protein peptide tag [Lutz-Freyermuth et al., Proc. Natl. Acad. Sci. USA, 87:6393-6397 (1990)].

Also included with the definition of CA protein in one embodiment are other CA proteins of the CA family, and CA proteins from other organisms, which are cloned and expressed as outlined below. Thus, probe or degenerate polymerase chain reaction (PCR) primer sequences may be used to find other related CA proteins from humans or other organisms. As will be appreciated by those in the art, particularly useful probe and/or PCR primer sequences include the unique areas of the CA nucleic acid sequence. As is generally known in the art, preferred PCR primers are from about 15 to about 35 nucleotides in length, with from about 20 to about 30 being preferred, and may contain inosine as needed. The conditions for the PCR reaction are well known in the art.

In addition, as is outlined herein, CA proteins can be made that are longer than those encoded by the nucleic acids of the figures, for example, by the elucidation of additional sequences, the addition of epitope or purification tags, the addition of other fusion sequences, etc.

CA proteins may also be identified as being encoded by CA nucleic acids. Thus, CA proteins are encoded by nucleic acids that will hybridize to the sequences of the sequence listings, or their complements, as outlined herein.

In a preferred embodiment, the invention provides CA antibodies. In a preferred embodiment, when the CA protein is to be used to generate antibodies, for example for immunotherapy, the CA protein should share at least one epitope or determinant with the full length protein. By "epitope" or "determinant" herein is meant a portion of a protein which will generate and/or bind an antibody or T-cell receptor in the context of MHC. Thus, in most instances, antibodies made to a smaller CA protein will be able to bind to the full length protein. In a preferred embodiment, the epitope is unique; that is, antibodies generated to a unique epitope show little or no cross-reactivity.

In one embodiment, the term "antibody" includes antibody fragments, as are known in the art, including Fab, Fab$_2$, single chain antibodies (Fv for example), chimeric antibodies, etc., either produced by the modification of whole antibodies or those synthesized de novo using recombinant DNA technologies.

Methods of preparing polyclonal antibodies are known to the skilled artisan. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. The immunizing agent may include a protein encoded by a nucleic acid of the figures or fragment thereof or a fusion protein thereof. It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

The antibodies may, alternatively, be monoclonal antibodies. Monoclonal antibodies may be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes may be immunized in vitro. The immunizing agent will typically include a polypeptide encoded by a nucleic acid of Tables 1-112, or fragment thereof or a fusion protein thereof. Generally, either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, Monoclonal Antibodies: Principles and Practice, Academic Press, (1986) pp. 59-103]. Immortalized cell lines are usually transformed mammalian cells, particularly myeloma cells of rodent, bovine and human origin. Usually, rat or mouse myeloma cell lines are employed. The hybridoma cells may be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

In one embodiment, the antibodies are bispecific antibodies. Bispecific antibodies are monoclonal, preferably human or humanized, antibodies that have binding specificities for at least two different antigens. In the present case, one of the binding specificities is for a protein encoded by a nucleic acid of Tables 1-112, or a fragment thereof, the other one is for any other antigen, and preferably for a cell-surface protein or receptor or receptor subunit, preferably one that is tumor specific.

In a preferred embodiment, the antibodies to CA are capable of reducing or eliminating the biological function of CA, as is described below. That is, the addition of anti-CA antibodies (either polyclonal or preferably monoclonal) to CA (or cells containing CA) may reduce or eliminate the CA activity. Generally, at least a 25% decrease in activity is preferred, with at least about 50% being particularly preferred and about a 95-100% decrease being especially preferred.

In a preferred embodiment the antibodies to the CA proteins are humanized antibodies. Humanized forms of non_human (e.g., murine) antibodies are chimeric molecules of immunoglobulins, immunoglobulin chains or fragments thereof (such as Fv, Fab, Fab', F(ab')$_2$ or other antigen binding subsequences of antibodies) which contain minimal sequence derived from non_human immunoglobulin. Humanized antibodies include human immunoglobulins (recipient antibody) in which residues form a complementary determining region (CDR) of the recipient are replaced by residues from a CDR of a non_human species (donor antibody) such as mouse, rat or rabbit having the desired specificity, affinity and capacity. In some instances, Fv framework residues of the human immunoglobulin are replaced by corresponding non_human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non_human immunoglobulin and all or substantially all of the framework residues (FR) regions are those of a human immunoglobulin consensus sequence. The humanized antibody optimally also will comprise at least a portion of an immunoglobulin constant region (Fc), typically that of a human immunoglobulin [Jones et al., Nature, 321: 522_525 (1986); Riechmann et al., Nature, 332:323_329 (1988); and Presta, Curr. Op. Struct. Biol., 2:593 596 (1992)].

Methods for humanizing non_human antibodies are well known in the art. Generally, a humanized antibody has one or more amino acid residues introduced into it from a source which is non_human. These non_human amino acid residues are often referred to as import residues, which are typically taken from an import variable domain. Humanization can be essentially performed following the method of Winter and co_workers [Jones et al., Nature, 321:522_525 (1986); Riechmann et al., Nature, 332:323_327 (1988); Verhoeyen et al., Science, 239:1534_1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non_human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies [Cole et al., Monoclonal Antibodies and Cancer Therapy, Alan R. Liss, p. 77 (1985) and Boerner et al., J. Immunol., 147(1):86_95 (1991)]. Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10, 779_783 (1992); Lonberg et al., Nature 368 856_859 (1994); Morrison, Nature 368, 812_13 (1994); Fishwild et al., Nature Biotechnology 14, 845_51 (1996); Neuberger, Nature Biotechnology 14, 826 (1996); Lonberg and Huszar, Intern. Rev. Immunol. 13 65_93 (1995).

By immunotherapy is meant treatment of a carcinoma with an antibody raised against an CA protein. As used herein, immunotherapy can be passive or active. Passive immunotherapy as defined herein is the passive transfer of antibody to a recipient (patient). Active immunization is the induction of antibody and/or T-cell responses in a recipient (patient). Induction of an immune response is the result of providing the recipient with an antigen to which antibodies are raised. As appreciated by one of ordinary skill in the art, the antigen may be provided by injecting a polypeptide against which antibodies are desired to be raised into a recipient, or contacting the recipient with a nucleic acid capable of expressing the antigen and under conditions for expression of the antigen.

In a preferred embodiment, oncogenes which encode secreted growth factors may be inhibited by raising antibodies against CA proteins that are secreted proteins as described above. Without being bound by theory, antibodies used for treatment, bind and prevent the secreted protein from binding to its receptor, thereby inactivating the secreted CA protein.

In another preferred embodiment, the CA protein to which antibodies are raised is a transmembrane protein. Without being bound by theory, antibodies used for treatment, bind the extracellular domain of the CA protein and prevent it from binding to other proteins, such as circulating ligands or cell-associated molecules. The antibody may cause down-regulation of the transmembrane CA protein. As will be appreciated by one of ordinary skill in the art, the antibody may be a competitive, non-competitive or uncompetitive inhibitor of protein binding to the extracellular domain of the CA protein. The antibody is also an antagonist of the CA protein. Further, the antibody prevents activation of the transmembrane CA protein. In one aspect, when the antibody prevents the binding of other molecules to the CA protein, the antibody prevents growth of the cell. The antibody may also sensitize the cell to cytotoxic agents, including, but not limited to TNF-$\alpha$, TNF-$\beta$, IL-1, INF-$\gamma$ and IL-2, or chemotherapeutic agents including 5FU, vinblastine, actinomycin D, cisplatin, methotrexate, and the like. In some instances the antibody belongs to a sub-type that activates serum complement when complexed with the transmembrane protein thereby mediating cytotoxicity. Thus, carcinomas may be treated by administering to a patient antibodies directed against the transmembrane CA protein.

In another preferred embodiment, the antibody is conjugated to a therapeutic moiety. In one aspect the therapeutic moiety is a small molecule that modulates the activity of the CA protein. In another aspect the therapeutic moiety modulates the activity of molecules associated with or in close proximity to the CA protein. The therapeutic moiety may inhibit enzymatic activity such as protease or protein kinase activity associated with carcinoma.

In a preferred embodiment, the therapeutic moiety may also be a cytotoxic agent. In this method, targeting the cytotoxic agent to tumor tissue or cells, results in a reduction in the number of afflicted cells, thereby reducing symptoms associated with carcinomas, including lymphoma. Cytotoxic agents are numerous and varied and include, but are not limited to, cytotoxic drugs or toxins or active fragments of such toxins. Suitable toxins and their corresponding fragments include diphtheria A chain, exotoxin A chain, ricin A chain, abrin A chain, curcin, crotin, phenomycin, enomycin and the like. Cytotoxic agents also include radiochemicals made by conjugating radioisotopes to antibodies raised against CA proteins, or binding of a radionuclide to a chelating agent that has been covalently attached to the antibody. Targeting the therapeutic moiety to transmembrane CA proteins not only serves to increase the local concentration of therapeutic moiety in the carcinoma of interest, i.e., lymphoma, but also serves to reduce deleterious side effects that may be associated with the therapeutic moiety.

In another preferred embodiment, the CA protein against which the antibodies are raised is an intracellular protein. In this case, the antibody may be conjugated to a protein which facilitates entry into the cell. In one case, the antibody enters the cell by endocytosis. In another embodiment, a nucleic acid encoding the antibody is administered to the individual or cell. Moreover, wherein the CA protein can be targeted within a cell, i.e., the nucleus, an antibody thereto contains a signal for that target localization, i.e., a nuclear localization signal.

The CA antibodies of the invention specifically bind to CA proteins. By "specifically bind" herein is meant that the antibodies bind to the protein with a binding constant in the range of at least $10^{-4}$-$10^{-6}$ M$^{-1}$, with a preferred range being $10^{-7}$-$10^{-9}$ M$^{-1}$.

In a preferred embodiment, the CA protein is purified or isolated after expression. CA proteins may be isolated or purified in a variety of ways known to those skilled in the art depending on what other components are present in the sample. Standard purification methods include electrophoretic, molecular, immunological and chromatographic techniques, including ion exchange, hydrophobic, affinity, and reverse-phase HPLC chromatography, and chromatofocusing. For example, the CA protein may be purified using a standard anti-CA antibody column. Ultrafiltration and diafiltration techniques, in conjunction with protein concentration, are also useful. For general guidance in suitable purification techniques, see Scopes, R., Protein Purification, Springer-Verlag, N.Y. (1982). The degree of purification necessary will vary depending on the use of the CA protein. In some instances no purification will be necessary.

Once expressed and purified if necessary, the CA proteins and nucleic acids are useful in a number of applications.

In one aspect, the expression levels of genes are determined for different cellular states in the carcinoma phenotype; that is, the expression levels of genes in normal tissue and in carcinoma tissue (and in some cases, for varying severities of lymphoma that relate to prognosis, as outlined below) are evaluated to provide expression profiles. An expression profile of a particular cell state or point of development is essentially a "fingerprint" of the state; while two states may have any particular gene similarly expressed, the evaluation of a number of genes simultaneously allows the generation of a gene expression profile that is unique to the state of the cell. By comparing expression profiles of cells in different states, information regarding which genes are important (including both up- and down-regulation of genes) in each of these states is obtained. Then, diagnosis may be done or confirmed: does tissue from a particular patient have the gene expression profile of normal or carcinoma tissue.

"Differential expression," or grammatical equivalents as used herein, refers to both qualitative as well as quantitative differences in the genes temporal and/or cellular expression patterns within and among the cells. Thus, a differentially expressed gene can qualitatively have its expression altered, including an activation or inactivation, in, for example, normal versus carcinoma tissue. That is, genes may be turned on or turned off in a particular state, relative to another state. As is apparent to the skilled artisan, any comparison of two or more states can be made. Such a qualitatively regulated gene will exhibit an expression pattern within a state or cell type which is detectable by standard techniques in one such state or cell type, but is not detectable in both. Alternatively, the determination is quantitative in that expression is increased or decreased; that is, the expression of the gene is either upregulated, resulting in an increased amount of transcript, or down-regulated, resulting in a decreased amount of transcript. The degree to which expression differs need only be large enough to quantify via standard characterization techniques as outlined below, such as by use of Affymetrix GeneChip® expression arrays, Lockhart, Nature Biotechnology, 14:1675-1680 (1996), hereby expressly incorporated by reference. Other techniques include, but are not limited to, quantitative reverse transcriptase PCR, Northern analysis and RNase protection. As outlined above, preferably the change in expression (i.e. upregulation or downregulation) is at least about 50%, more preferably at least about 100%, more preferably at least about 150%, more preferably, at least about 200%, with from 300 to at least 1000% being especially preferred.

As will be appreciated by those in the art, this may be done by evaluation at either the gene transcript, or the protein level; that is, the amount of gene expression may be monitored using nucleic acid probes to the DNA or RNA equivalent of the gene transcript, and the quantification of gene expression levels, or, alternatively, the final gene product itself (protein) can be monitored, for example through the use of antibodies to the CA protein and standard immunoassays (ELISAs, etc.) or other techniques, including mass spectroscopy assays, 2D gel electrophoresis assays, etc. Thus, the proteins corresponding to CA genes, i.e. those identified as being important in a particular carcinoma phenotype, i.e., lymphoma, can be evaluated in a diagnostic test specific for that carcinoma.

In a preferred embodiment, gene expression monitoring is done and a number of genes, i.e. an expression profile, is monitored simultaneously, although multiple protein expression monitoring can be done as well. Similarly, these assays may be done on an individual basis as well.

In this embodiment, the CA nucleic acid probes may be attached to biochips as outlined herein for the detection and quantification of CA sequences in a particular cell. The assays are done as is known in the art. As will be appreciated by those in the art, any number of different CA sequences may be used as probes, with single sequence assays being used in some cases, and a plurality of the sequences described herein being used in other embodiments. In addition, while solid-phase assays are described, any number of solution based assays may be done as well.

In a preferred embodiment, both solid and solution based assays may be used to detect CA sequences that are up-regulated or down-regulated in carcinomas as compared to normal tissue. In instances where the CA sequence has been altered but shows the same expression profile or an altered expression profile, the protein will be detected as outlined herein.

In a preferred embodiment nucleic acids encoding the CA protein are detected. Although DNA or RNA encoding the CA protein may be detected, of particular interest are methods wherein the mRNA encoding a CA protein is detected. The presence of mRNA in a sample is an indication that the CA gene has been transcribed to form the mRNA, and suggests that the protein is expressed. Probes to detect the mRNA can be any nucleotide/deoxynucleotide probe that is complementary to and base pairs with the mRNA and includes but is not limited to oligonucleotides, cDNA or RNA. Probes also should contain a detectable label, as defined herein. In one method the mRNA is detected after immobilizing the nucleic acid to be examined on a solid support such as nylon membranes and hybridizing the probe with the sample. Following washing to remove the non-specifically bound probe, the label is detected. In another method detection of the mRNA is performed in situ. In this method permeabilized cells or tissue samples are contacted with a detectably labeled nucleic acid probe for sufficient time to allow the probe to hybridize with the target mRNA. Following washing to remove the non-specifically bound probe, the label is detected. For example a digoxygenin labeled riboprobe (RNA probe) that is complementary to the mRNA encoding a CA protein is detected by binding the digoxygenin with an anti-digoxygenin secondary antibody and developed with nitro blue tetrazolium and 5_bromo_4_chloro_3_indoyl phosphate.

In a preferred embodiment, any of the three classes of proteins as described herein (secreted, transmembrane or intracellular proteins) are used in diagnostic assays. The CA proteins, antibodies, nucleic acids, modified proteins and cells containing CA sequences are used in diagnostic assays. This can be done on an individual gene or corresponding polypeptide level, or as sets of assays.

As described and defined herein, CA proteins find use as markers of carcinomas, including lymphomas such as, but not limited to, Hodgkin's and non-Hodgkin lymphoma. Detection of these proteins in putative carcinoma tissue or patients allows for a determination or diagnosis of the type of carcinoma. Numerous methods known to those of ordinary skill in the art find use in detecting carcinomas. In one embodiment, antibodies are used to detect CA proteins. A preferred method separates proteins from a sample or patient by electrophoresis on a gel (typically a denaturing and reducing protein gel, but may be any other type of gel including isoelectric focusing gels and the like). Following separation of proteins, the CA protein is detected by immunoblotting with antibodies raised against the CA protein. Methods of immunoblotting are well known to those of ordinary skill in the art.

In another preferred method, antibodies to the CA protein find use in in situ imaging techniques. In this method cells are contacted with from one to many antibodies to the CA protein(s). Following washing to remove non-specific antibody binding, the presence of the antibody or antibodies is detected. In one embodiment the antibody is detected by incubating with a secondary antibody that contains a detectable label. In another method the primary antibody to the CA protein(s) contains a detectable label. In another preferred embodiment each one of multiple primary antibodies contains a distinct and detectable label. This method finds particular use in simultaneous screening for a plurality of CA proteins. As will be appreciated by one of ordinary skill in the art, numerous other histological imaging techniques are useful in the invention.

In a preferred embodiment the label is detected in a fluorometer which has the ability to detect and distinguish emissions of different wavelengths. In addition, a fluorescence activated cell sorter (FACS) can be used in the method.

In another preferred embodiment, antibodies find use in diagnosing carcinomas from blood samples. As previously described, certain CA proteins are secreted/circulating molecules. Blood samples, therefore, are useful as samples to be probed or tested for the presence of secreted CA proteins. Antibodies can be used to detect the CA proteins by any of the previously described immunoassay techniques including ELISA, immunoblotting (Western blotting), immunoprecipitation, BIACORE technology and the like, as will be appreciated by one of ordinary skill in the art.

In a preferred embodiment, in situ hybridization of labeled CA nucleic acid probes to tissue arrays is done. For example, arrays of tissue samples, including CA tissue and/or normal tissue, are made. In situ hybridization as is known in the art can then be done.

It is understood that when comparing the expression fingerprints between an individual and a standard, the skilled artisan can make a diagnosis as well as a prognosis. It is further understood that the genes which indicate the diagnosis may differ from those which indicate the prognosis.

In a preferred embodiment, the CA proteins, antibodies, nucleic acids, modified proteins and cells containing CA sequences are used in prognosis assays. As above, gene expression profiles can be generated that correlate to carcinoma, especially lymphoma, severity, in terms of long term prognosis. Again, this may be done on either a protein or gene level, with the use of genes being preferred. As above, the CA probes are attached to biochips for the detection and quantification of CA sequences in a tissue or patient. The assays proceed as outlined for diagnosis.

In a preferred embodiment, any of the CA sequences as described herein are used in drug screening assays. The CA proteins, antibodies, nucleic acids, modified proteins and cells containing CA sequences are used in drug screening assays or by evaluating the effect of drug candidates on a "gene expression profile" or expression profile of polypeptides. In one embodiment, the expression profiles are used, preferably in conjunction with high throughput screening techniques to allow monitoring for expression profile genes after treatment with a candidate agent, Zlokarnik, et al., Science 279, 84-8 (1998), Heid, et al., Genome Res., 6:986-994 (1996).

In a preferred embodiment, the CA proteins, antibodies, nucleic acids, modified proteins and cells containing the native or modified CA proteins are used in screening assays. That is, the present invention provides novel methods for screening for compositions which modulate the carcinoma phenotype. As above, this can be done by screening for modulators of gene expression or for modulators of protein activity. Similarly, this may be done on an individual gene or protein level or by evaluating the effect of drug candidates on a "gene expression profile". In a preferred embodiment, the expression profiles are used, preferably in conjunction with high throughput screening techniques to allow monitoring for expression profile genes after treatment with a candidate agent, see Zlokarnik, supra.

Having identified the CA genes herein, a variety of assays to evaluate the effects of agents on gene expression may be executed. In a preferred embodiment, assays may be run on an individual gene or protein level. That is, having identified a particular gene as aberrantly regulated in carcinoma, candidate bioactive agents may be screened to modulate the genes response. "Modulation" thus includes both an increase and a decrease in gene expression or activity. The preferred amount of modulation will depend on the original change of the gene expression in normal versus tumor tissue, with changes of at least 10%, preferably 50%, more preferably 100-300%, and in some embodiments 300-1000% or greater. Thus, if a gene exhibits a 4 fold increase in tumor compared to normal tissue, a decrease of about four fold is desired; a 10 fold decrease in tumor compared to normal tissue gives a 10 fold increase in expression for a candidate agent is desired, etc. Alternatively, where the CA sequence has been altered but shows the same expression profile or an altered expression profile, the protein will be detected as outlined herein.

As will be appreciated by those in the art, this may be done by evaluation at either the gene or the protein level; that is, the amount of gene expression may be monitored using nucleic acid probes and the quantification of gene expression levels, or, alternatively, the level of the gene product itself can be monitored, for example through the use of antibodies to the CA protein and standard immunoassays. Alternatively, binding and bioactivity assays with the protein may be done as outlined below.

In a preferred embodiment, gene expression monitoring is done and a number of genes, i.e. an expression profile, is monitored simultaneously, although multiple protein expression monitoring can be done as well.

In this embodiment, the CA nucleic acid probes are attached to biochips as outlined herein for the detection and quantification of CA sequences in a particular cell. The assays are further described below.

Generally, in a preferred embodiment, a candidate bioactive agent is added to the cells prior to analysis. Moreover, screens are provided to identify a candidate bioactive agent which modulates a particular type of carcinoma, modulates CA proteins, binds to a CA protein, or interferes between the binding of a CA protein and an antibody.

The term "candidate bioactive agent" or "drug candidate" or grammatical equivalents as used herein describes any molecule, e.g., protein, oligopeptide, small organic or inorganic molecule, polysaccharide, polynucleotide, etc., to be tested for bioactive agents that are capable of directly or indirectly altering either the carcinoma phenotype, binding to and/or modulating the bioactivity of an CA protein, or the expression of a CA sequence, including both nucleic acid sequences and protein sequences. In a particularly preferred embodiment, the candidate agent suppresses a CA phenotype, for example to a normal tissue fingerprint. Similarly, the candidate agent preferably suppresses a severe CA phenotype. Generally a plurality of assay mixtures are run in parallel with different agent concentrations to obtain a differential response to the various concentrations. Typically, one of these concentrations serves as a negative control, i.e., at zero concentration or below the level of detection.

In one aspect, a candidate agent will neutralize the effect of an CA protein. By "neutralize" is meant that activity of a protein is either inhibited or counter acted against so as to have substantially no effect on a cell.

Candidate agents encompass numerous chemical classes, though typically they are organic or inorganic molecules, preferably small organic compounds having a molecular weight of more than 100 and less than about 2,500 daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof. Particularly preferred are peptides.

Candidate agents are obtained from a wide variety of sources including libraries of synthetic or natural compounds. For example, numerous means are available for random and directed synthesis of a wide variety of organic compounds and biomolecules, including expression of randomized oligonucleotides. Alternatively, libraries of natural compounds in the form of bacterial, fungal, plant and animal extracts are available or readily produced. Additionally, natural or synthetically produced libraries and compounds are readily modified through conventional chemical, physical and biochemical means. Known pharmacological agents may be subjected to directed or random chemical modifications, such as acylation, alkylation, esterification, amidification to produce structural analogs.

In a preferred embodiment, the candidate bioactive agents are proteins. By "protein" herein is meant at least two covalently attached amino acids, which includes proteins, polypeptides, oligopeptides and peptides. The protein may be made up of naturally occurring amino acids and peptide bonds, or synthetic peptidomimetic structures. Thus "amino acid", or "peptide residue", as used herein means both naturally occurring and synthetic amino acids. For example, homo-phenylalanine, citrulline and noreleucine are considered amino acids for the purposes of the invention. "Amino acid" also includes imino acid residues such as proline and hydroxyproline. The side chains may be in either the (R) or the (S) configuration. In the preferred embodiment, the amino acids are in the (S) or L-configuration. If non-naturally occurring side chains are used, non-amino acid substituents may be used, for example to prevent or retard in vivo degradations.

In a preferred embodiment, the candidate bioactive agents are naturally occurring proteins or fragments of naturally occurring proteins. Thus, for example, cellular extracts containing proteins, or random or directed digests of proteinaceous cellular extracts, may be used. In this way libraries of procaryotic and eucaryotic proteins may be made for screening in the methods of the invention. Particularly preferred in this embodiment are libraries of bacterial, fungal, viral, and mammalian proteins, with the latter being preferred, and human proteins being especially preferred.

In a preferred embodiment, the candidate bioactive agents are peptides of from about 5 to about 30 amino acids, with from about 5 to about 20 amino acids being preferred, and from about 7 to about 15 being particularly preferred. The peptides may be digests of naturally occurring proteins as is outlined above, random peptides, or "biased" random peptides. By "randomized" or grammatical equivalents herein is meant that each nucleic acid and peptide consists of essentially random nucleotides and amino acids, respectively. Since generally these random peptides (or nucleic acids, discussed below) are chemically synthesized, they may incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, the library is fully randomized, with no sequence preferences or constants at any position. In a preferred embodiment, the library is biased. That is, some positions within the sequence are either held constant, or are selected from a limited number of possibilities. For example, in a preferred embodiment, the nucleotides or amino acid residues are randomized within a defined class, for example, of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

In a preferred embodiment, the candidate bioactive agents are nucleic acids, as defined above.

As described above generally for proteins, nucleic acid candidate bioactive agents may be naturally occurring nucleic acids, random nucleic acids, or "biased" random nucleic acids. For example, digests of procaryotic or eucaryotic genomes may be used as is outlined above for proteins.

In a preferred embodiment, the candidate bioactive agents are organic chemical moieties, a wide variety of which are available in the literature.

In assays for altering the expression profile of one or more CA genes, after the candidate agent has been added and the cells allowed to incubate for some period of time, the sample containing the target sequences to be analyzed is added to the biochip. If required, the target sequence is prepared using known techniques. For example, the sample may be treated to lyse the cells, using known lysis buffers, electroporation, etc., with purification and/or amplification such as PCR occurring as needed, as will be appreciated by those in the art. For example, an in vitro transcription with labels covalently attached to the nucleosides is done. Generally, the nucleic acids are labeled with a label as defined herein, with biotin-FITC or PE, cy3 and cy5 being particularly preferred.

In a preferred embodiment, the target sequence is labeled with, for example, a fluorescent, chemiluminescent, chemical, or radioactive signal, to provide a means of detecting the target sequence's specific binding to a probe. The label also can be an enzyme, such as, alkaline phosphatase or horseradish peroxidase, which when provided with an appropriate substrate produces a product that can be detected. Alternatively, the label can be a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. As known in the art, unbound labeled streptavidin is removed prior to analysis.

As will be appreciated by those in the art, these assays can be direct hybridization assays or can comprise "sandwich assays", which include the use of multiple probes, as is generally outlined in U.S. Pat. Nos. 5,681,702, 5,597,909, 5,545,730, 5,594,117, 5,591,584, 5,571,670, 5,580,731, 5,571,670, 5,591,584, 5,624,802, 5,635,352, 5,594,118, 5,359,100, 5,124,246 and 5,681,697, all of which are hereby incorporated by reference. In this embodiment, in general, the target nucleic acid is prepared as outlined above, and then added to the biochip comprising a plurality of nucleic acid probes, under conditions that allow the formation of a hybridization complex.

A variety of hybridization conditions may be used in the present invention, including high, moderate and low stringency conditions as outlined above. The assays are generally run under stringency conditions which allows formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc.

These parameters may also be used to control non-specific binding, as is generally outlined in U.S. Pat. No. 5,681,697. Thus it may be desirable to perform certain steps at higher stringency conditions to reduce non-specific binding.

The reactions outlined herein may be accomplished in a variety of ways, as will be appreciated by those in the art. Components of the reaction may be added simultaneously, or sequentially, in any order, with preferred embodiments outlined below. In addition, the reaction may include a variety of other reagents may be included in the assays. These include reagents like salts, buffers, neutral proteins, e.g. albumin, detergents, etc which may be used to facilitate optimal hybridization and detection, and/or reduce non-specific or background interactions. Also reagents that otherwise improve the efficiency of the assay, such as protease inhibitors, nuclease inhibitors, anti-microbial agents, etc., may be used, depending on the sample preparation methods and purity of the target. In addition, either solid phase or solution based (i.e., kinetic PCR) assays may be used.

Once the assay is run, the data is analyzed to determine the expression levels, and changes in expression levels as between states, of individual genes, forming a gene expression profile.

In a preferred embodiment, as for the diagnosis and prognosis applications, having identified the differentially expressed gene(s) or mutated gene(s) important in any one state, screens can be run to alter the expression of the genes individually. That is, screening for modulation of regulation of expression of a single gene can be done. Thus, for example, particularly in the case of target genes whose presence or absence is unique between two states, screening is done for modulators of the target gene expression.

In addition, screens can be done for novel genes that are induced in response to a candidate agent. After identifying a candidate agent based upon its ability to suppress a CA expression pattern leading to a normal expression pattern, or modulate a single CA gene expression profile so as to mimic the expression of the gene from normal tissue, a screen as described above can be performed to identify genes that are specifically modulated in response to the agent. Comparing expression profiles between normal tissue and agent treated CA tissue reveals genes that are not expressed in normal tissue or CA tissue, but are expressed in agent treated tissue. These agent specific sequences can be identified and used by any of the methods described herein for CA genes or proteins. In particular these sequences and the proteins they encode find use in marking or identifying agent treated cells. In addition, antibodies can be raised against the agent induced proteins and used to target novel therapeutics to the treated CA tissue sample.

Thus, in one embodiment, a candidate agent is administered to a population of CA cells, that thus has an associated CA expression profile. By "administration" or "contacting" herein is meant that the candidate agent is added to the cells in such a manner as to allow the agent to act upon the cell, whether by uptake and intracellular action, or by action at the cell surface. In some embodiments, nucleic acid encoding a proteinaceous candidate agent (i.e. a peptide) may be put into a viral construct such as a retroviral construct and added to the cell, such that expression of the peptide agent is accomplished; see PCT US97/01019, hereby expressly incorporated by reference.

Once the candidate agent has been administered to the cells, the cells can be washed if desired and are allowed to incubate under preferably physiological conditions for some period of time. The cells are then harvested and a new gene expression profile is generated, as outlined herein.

Thus, for example, CA tissue may be screened for agents that reduce or suppress the CA phenotype. A change in at least one gene of the expression profile indicates that the agent has an effect on CA activity. By defining such a signature for the CA phenotype, screens for new drugs that alter the phenotype can be devised. With this approach, the drug target need not be known and need not be represented in the original expression screening platform, nor does the level of transcript for the target protein need to change.

In a preferred embodiment, as outlined above, screens may be done on individual genes and gene products (proteins). That is, having identified a particular differentially expressed gene as important in a particular state, screening of modulators of either the expression of the gene or the gene product itself can be done. The gene products of differentially expressed genes are sometimes referred to herein as "CA proteins" or an "CAP". The CAP may be a fragment, or alternatively, be the full length protein to the fragment encoded by the nucleic acids of Tables 1-112. Preferably, the CAP is a fragment. In another embodiment, the sequences are sequence variants as further described herein.

Preferably, the CAP is a fragment of approximately 14 to 24 amino acids long. More preferably the fragment is a soluble fragment. Preferably, the fragment includes a non-transmembrane region. In a preferred embodiment, the fragment has an N-terminal Cys to aid in solubility. In one embodiment, the c-terminus of the fragment is kept as a free acid and the n-terminus is a free amine to aid in coupling, i.e., to cysteine.

In one embodiment the CA proteins are conjugated to an immunogenic agent as discussed herein. In one embodiment the CA protein is conjugated to BSA.

In a preferred embodiment, screening is done to alter the biological function of the expression product of the CA gene. Again, having identified the importance of a gene in a particular state, screening for agents that bind and/or modulate the biological activity of the gene product can be run as is more fully outlined below.

In a preferred embodiment, screens are designed to first find candidate agents that can bind to CA proteins, and then these agents may be used in assays that evaluate the ability of the candidate agent to modulate the CAP activity and the carcinoma phenotype. Thus, as will be appreciated by those in the art, there are a number of different assays which may be run; binding assays and activity assays.

In a preferred embodiment, binding assays are done. In general, purified or isolated gene product is used; that is, the gene products of one or more CA nucleic acids are made. In general, this is done as is known in the art. For example, antibodies are generated to the protein gene products, and standard immunoassays are run to determine the amount of protein present. Alternatively, cells comprising the CA proteins can be used in the assays.

Thus, in a preferred embodiment, the methods comprise combining a CA protein and a candidate bioactive agent, and determining the binding of the candidate agent to the CA protein. Preferred embodiments utilize the human or mouse CA protein, although other mammalian proteins may also be used, for example for the development of animal models of human disease. In some embodiments, as outlined herein, variant or derivative CA proteins may be used.

Generally, in a preferred embodiment of the methods herein, the CA protein or the candidate agent is non-diffusably bound to an insoluble support having isolated sample receiving areas (e.g. a microtiter plate, an array, etc.). The insoluble supports may be made of any composition to which the compositions can be bound, is readily separated from soluble material, and is otherwise compatible with the overall method of screening. The surface of such supports may be solid or porous and of any convenient shape. Examples of suitable insoluble supports include microliter plates, arrays, membranes and beads. These are typically made of glass, plastic (e.g., polystyrene), polysaccharides, nylon or nitrocellulose, Teflon™, etc. Microtiter plates and arrays are especially convenient because a large number of assays can be carried out simultaneously, using small amounts of reagents and samples. The particular manner of binding of the composition is not crucial so long as it is compatible with the reagents and overall methods of the invention, maintains the activity of the composition and is nondiffusable. Preferred methods of binding include the use of antibodies (which do not sterically block either the ligand binding site or activation sequence when the protein is bound to the support), direct binding to "sticky" or ionic supports, chemical crosslinking, the synthesis of the protein or agent on the surface, etc. Following binding of the protein or agent, excess unbound material is removed by washing. The sample receiving areas may then be blocked through incubation with bovine serum albumin (BSA), casein or other innocuous protein or other moiety.

In a preferred embodiment, the CA protein is bound to the support, and a candidate bioactive agent is added to the assay. Alternatively, the candidate agent is bound to the support and the CA protein is added. Novel binding agents include specific antibodies, non_natural binding agents identified in screens of chemical libraries, peptide analogs, etc. Of particular interest are screening assays for agents that have a low toxicity for human cells. A wide variety of assays may be used for this purpose, including labeled in vitro protein binding assays, electrophoretic mobility shift assays, immunoassays for protein binding, functional assays (phosphorylation assays, etc.) and the like.

The determination of the binding of the candidate bioactive agent to the CA protein may be done in a number of ways. In a preferred embodiment, the candidate bioactive agent is labeled, and binding determined directly. For example, this may be done by attaching all or a portion of the CA protein to a solid support, adding a labeled candidate agent (for example a fluorescent label), washing off excess reagent, and determining whether the label is present on the solid support. Various blocking and washing steps may be utilized as is known in the art.

By "labeled" herein is meant that the compound is either directly or indirectly labeled with a label which provides a detectable signal, e.g. radioisotope, fluorescers, enzyme, antibodies, particles such as magnetic particles, chemiluminescers, or specific binding molecules, etc. Specific binding molecules include pairs, such as biotin and streptavidin, digoxin and antidigoxin etc. For the specific binding members, the complementary member would normally be labeled with a molecule which provides for detection, in accordance with known procedures, as outlined above. The label can directly or indirectly provide a detectable signal.

In some embodiments, only one of the components is labeled. For example, the proteins (or proteinaceous candidate agents) may be labeled at tyrosine positions using $^{125}$I, or with fluorophores. Alternatively, more than one component may be labeled with different labels; using $^{125}$I for the proteins, for example, and a fluorophor for the candidate agents.

In a preferred embodiment, the binding of the candidate bioactive agent is determined through the use of competitive binding assays. In this embodiment, the competitor is a binding moiety known to bind to the target molecule (i.e. CA protein), such as an antibody, peptide, binding partner, ligand, etc. Under certain circumstances, there may be competitive binding as between the bioactive agent and the binding moiety, with the binding moiety displacing the bioactive agent.

In one embodiment, the candidate bioactive agent is labeled. Either the candidate bioactive agent, or the competitor, or both, is added first to the protein for a time sufficient to allow binding, if present. Incubations may be performed at any temperature which facilitates optimal activity, typically between 4 and 40° C. Incubation periods are selected for optimum activity, but may also be optimized to facilitate rapid high through put screening. Typically between 0.1 and 1 hour will be sufficient. Excess reagent is generally removed or washed away. The second component is then added, and the presence or absence of the labeled component is followed, to indicate binding.

In a preferred embodiment, the competitor is added first, followed by the candidate bioactive agent. Displacement of the competitor is an indication that the candidate bioactive agent is binding to the CA protein and thus is capable of binding to, and potentially modulating, the activity of the CA protein. In this embodiment, either component can be labeled. Thus, for example, if the competitor is labeled, the presence of label in the wash solution indicates displacement by the agent. Alternatively, if the candidate bioactive agent is labeled, the presence of the label on the support indicates displacement.

In an alternative embodiment, the candidate bioactive agent is added first, with incubation and washing, followed by the competitor. The absence of binding by the competitor may indicate that the bioactive agent is bound to the CA protein with a higher affinity. Thus, if the candidate bioactive agent is labeled, the presence of the label on the support, coupled with a lack of competitor binding, may indicate that the candidate agent is capable of binding to the CA protein.

In a preferred embodiment, the methods comprise differential screening to identity bioactive agents that are capable of modulating the activity of the CA proteins. In this embodiment, the methods comprise combining a CA protein and a competitor in a first sample. A second sample comprises a candidate bioactive agent, a CA protein and a competitor. The binding of the competitor is determined for both samples, and a change, or difference in binding between the two samples indicates the presence of an agent capable of binding to the CA protein and potentially modulating its activity. That is, if the binding of the competitor is different in the second sample relative to the first sample, the agent is capable of binding to the CA protein.

Alternatively, a preferred embodiment utilizes differential screening to identify drug candidates that bind to the native CA protein, but cannot bind to modified CA proteins. The structure of the CA protein may be modeled, and used in rational drug design to synthesize agents that interact with that site. Drug candidates that affect CA bioactivity are also identified by screening drugs for the ability to either enhance or reduce the activity of the protein.

Positive controls and negative controls may be used in the assays. Preferably all control and test samples are performed in at least triplicate to obtain statistically significant results. Incubation of all samples is for a time sufficient for the binding of the agent to the protein. Following incubation, all samples are washed free of non-specifically bound material and the amount of bound, generally labeled agent determined. For example, where a radiolabel is employed, the samples may be counted in a scintillation counter to determine the amount of bound compound.

A variety of other reagents may be included in the screening assays. These include reagents like salts, neutral proteins, e.g. albumin, detergents, etc which may be used to facilitate optimal protein_protein binding and/or reduce non_specific or background interactions. Also reagents that otherwise improve the efficiency of the assay, such as protease inhibitors, nuclease inhibitors, anti_microbial agents, etc., may be used. The mixture of components may be added in any order that provides for the requisite binding.

Screening for agents that modulate the activity of CA proteins may also be done. In a preferred embodiment, methods for screening for a bioactive agent capable of modulating the activity of CA proteins comprise the steps of adding a candidate bioactive agent to a sample of CA proteins, as above, and determining an alteration in the biological activity of CA proteins. "Modulating the activity of an CA protein" includes an increase in activity, a decrease in activity, or a change in the type or kind of activity present. Thus, in this embodiment, the candidate agent should both bind to CA proteins (although this may not be necessary), and alter its biological or biochemical activity as defined herein. The methods include both in vitro screening methods, as are generally outlined above, and in vivo screening of cells for alterations in the presence, distribution, activity or amount of CA proteins.

Thus, in this embodiment, the methods comprise combining a CA sample and a candidate bioactive agent, and evaluating the effect on CA activity. By "CA activity" or grammatical equivalents herein is meant one of the CA protein's biological activities, including, but not limited to, its role in tumorigenesis, including cell division, preferably in lymphatic tissue, cell proliferation, tumor growth and transformation of cells. In one embodiment, CA activity includes activation of or by a protein encoded by a nucleic acid of Tables 1-112. An inhibitor of CA activity is the inhibition of any one or more CA activities.

In a preferred embodiment, the activity of the CA protein is increased; in another preferred embodiment, the activity of the CA protein is decreased. Thus, bioactive agents that are antagonists are preferred in some embodiments, and bioactive agents that are agonists may be preferred in other embodiments.

In a preferred embodiment, the invention provides methods for screening for bioactive agents capable of modulating the activity of a CA protein. The methods comprise adding a candidate bioactive agent, as defined above, to a cell comprising CA proteins. Preferred cell types include almost any cell. The cells contain a recombinant nucleic acid that encodes a CA protein. In a preferred embodiment, a library of candidate agents are tested on a plurality of cells.

In one aspect, the assays are evaluated in the presence or absence or previous or subsequent exposure of physiological signals, for example hormones, antibodies, peptides, antigens, cytokines, growth factors, action potentials, pharmacological agents including chemotherapeutics, radiation, carcinogenics, or other cells (i.e. cell-cell contacts). In another example, the determinations are determined at different stages of the cell cycle process.

In this way, bioactive agents are identified. Compounds with pharmacological activity are able to enhance or interfere with the activity of the CA protein.

In one embodiment, a method of inhibiting carcinoma cancer cell division, is provided. The method comprises administration of a carcinoma cancer inhibitor.

In a preferred embodiment, a method of inhibiting lymphoma carcinoma cell division is provided comprising administration of a lymphoma carcinoma inhibitor.

In another embodiment, a method of inhibiting tumor growth is provided. The method comprises administration of a carcinoma cancer inhibitor. In a particularly preferred embodiment, a method of inhibiting tumor growth in lymphatic tissue is provided comprising administration of a lymphoma inhibitor.

In a further embodiment, methods of treating cells or individuals with cancer are provided. The method comprises administration of a carcinoma cancer inhibitor. Preferably, the carcinoma is a lymphoma carcinoma.

In one embodiment, a carcinoma cancer inhibitor is an antibody as discussed above. In another embodiment, the carcinoma cancer inhibitor is an antisense molecule. Antisense molecules as used herein include antisense or sense oligonucleotides comprising a singe-stranded nucleic acid sequence (either RNA or DNA) capable of binding to target mRNA (sense) or DNA (antisense) sequences for carcinoma cancer molecules. Antisense or sense oligonucleotides, according to the present invention, comprise a fragment generally at least about 14 nucleotides, preferably from about 14 to 30 nucleotides. The ability to derive an antisense or a sense oligonucleotide, based upon a cDNA sequence encoding a given protein is described in, for example, Stein and Cohen, Cancer Res. 48:2659, (1988) and van der Krol et al., BioTechniques 6:958, (1988).

Antisense molecules may be introduced into a cell containing the target nucleotide sequence by formation of a conjugate with a ligand binding molecule, as described in WO 91/04753. Suitable ligand binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a sense or an antisense oligonucleotide may be introduced into a cell containing the target nucleic acid sequence by formation of an oligonucleotide-lipid complex, as described in WO 90/10448. It is understood that the use of antisense molecules or knock out and knock in models may also be used in screening assays as discussed above, in addition to methods of treatment.

The compounds having the desired pharmacological activity may be administered in a physiologically acceptable carrier to a host, as previously described. The agents may be administered in a variety of ways, orally, parenterally e.g., subcutaneously, intraperitoneally, intravascularly, etc. Depending upon the manner of introduction, the compounds may be formulated in a variety of ways. The concentration of therapeutically active compound in the formulation may vary from about 0.1_100% wgt/vol. The agents may be administered alone or in combination with other treatments, i.e., radiation.

The pharmaceutical compositions can be prepared in various forms, such as granules, tablets, pills, suppositories, capsules, suspensions, salves, lotions and the like. Pharmaceutical grade organic or inorganic carriers and/or diluents suitable for oral and topical use can be used to make up compositions containing the therapeutically_active compounds. Diluents known to the art include aqueous media, vegetable and animal oils and fats. Stabilizing agents, wetting and emulsifying agents, salts for varying the osmotic pressure or buffers for securing an adequate pH value, and skin penetration enhancers can be used as auxiliary agents.

Without being bound by theory, it appears that the various CA sequences are important in carcinomas. Accordingly, disorders based on mutant or variant CA genes may be determined. In one embodiment, the invention provides methods for identifying cells containing variant CA genes comprising determining all or part of the sequence of at least one endogenous CA genes in a cell. As will be appreciated by those in the art, this may be done using any number of sequencing techniques. In a preferred embodiment, the invention provides methods of identifying the CA genotype of an individual comprising determining all or part of the sequence of at least one CA gene of the individual. This is generally done in at least one tissue of the individual, and may include the evaluation of a number of tissues or different samples of the same tissue. The method may include comparing the sequence of the sequenced CA gene to a known CA gene, i.e., a wild-type gene. As will be appreciated by those in the art, alterations in the sequence of some oncogenes can be an indication of either the presence of the disease, or propensity to develop the disease, or prognosis evaluations.

The sequence of all or part of the CA gene can then be compared to the sequence of a known CA gene to determine if any differences exist. This can be done using any number of known homology programs, such as Bestfit, etc. In a preferred embodiment, the presence of a difference in the sequence between the CA gene of the patient and the known CA gene is indicative of a disease state or a propensity for a disease state, as outlined herein.

In a preferred embodiment, the CA genes are used as probes to determine the number of copies of the CA gene in the genome. For example, some cancers exhibit chromosomal deletions or insertions, resulting in an alteration in the copy number of a gene.

In another preferred embodiment CA genes are used as probes to determine the chromosomal location of the CA genes. Information such as chromosomal location finds use in providing a diagnosis or prognosis in particular when chromosomal abnormalities such as translocations, and the like are identified in CA gene loci.

Thus, in one embodiment, methods of modulating CA in cells or organisms are provided. In one embodiment, the methods comprise administering to a cell an anti-CA antibody that reduces or eliminates the biological activity of an endogenous CA protein. Alternatively, the methods comprise administering to a cell or organism a recombinant nucleic acid encoding a CA protein. As will be appreciated by those in the art, this may be accomplished in any number of ways. In a preferred embodiment, for example when the CA sequence is down-regulated in carcinoma, the activity of the CA gene is increased by increasing the amount of CA in the cell, for example by overexpressing the endogenous CA or by administering a gene encoding the CA sequence, using known gene-therapy techniques, for example. In a preferred embodiment, the gene therapy techniques include the incorporation of the exogenous gene using enhanced homologous recombination (EHR), for example as described in PCT/US93/03868, hereby incorporated by reference in its entirety. Alternatively, for example when the CA sequence is up-regulated in carcinoma, the activity of the endogenous CA gene is decreased, for example by the administration of a CA antisense nucleic acid.

In one embodiment, the CA proteins of the present invention may be used to generate polyclonal and monoclonal antibodies to CA proteins, which are useful as described herein. Similarly, the CA proteins can be coupled, using standard technology, to affinity chromatography columns. These columns may then be used to purify CA antibodies. In a preferred embodiment, the antibodies are generated to epitopes unique to a CA protein; that is, the antibodies show little or no cross-reactivity to other proteins. These antibodies find use in a number of applications. For example, the CA antibodies may be coupled to standard affinity chromatography columns and used to purify CA proteins. The antibodies may also be used as blocking polypeptides, as outlined above, since they will specifically bind to the CA protein.

In one embodiment, a therapeutically effective dose of a CA or modulator thereof is administered to a patient. By "therapeutically effective dose" herein is meant a dose that produces the effects for which it is administered. The exact dose will depend on the purpose of the treatment, and will be ascertainable by one skilled in the art using known techniques. As is known in the art, adjustments for CA degradation, systemic versus localized delivery, and rate of new protease synthesis, as well as the age, body weight, general health, sex, diet, time of administration, drug interaction and the severity of the condition may be necessary, and will be ascertainable with routine experimentation by those skilled in the art.

A "patient" for the purposes of the present invention includes both humans and other animals, particularly mammals, and organisms. Thus the methods are applicable to both human therapy and veterinary applications. In the preferred embodiment the patient is a mammal, and in the most preferred embodiment the patient is human.

The administration of the CA proteins and modulators of the present invention can be done in a variety of ways as discussed above, including, but not limited to, orally, subcutaneously, intravenously, intranasally, transdermally, intraperitoneally, intramuscularly, intrapulmonary, vaginally, rectally, or intraocularly. In some instances, for example, in the treatment of wounds and inflammation, the CA proteins and modulators may be directly applied as a solution or spray.

The pharmaceutical compositions of the present invention comprise a CA protein in a form suitable for administration to a patient. In the preferred embodiment, the pharmaceutical compositions are in a water soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids such as hydrochloric acid, hydrobromic acid, sulfuric acid, nitric acid, phosphoric acid and the like, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p_toluenesulfonic acid, salicylic acid and the like. "Pharmaceutically acceptable base addition salts" include those derived from inorganic bases such as sodium, potassium, lithium, ammonium, calcium, magnesium, iron, zinc, copper, manganese, aluminum salts and the like. Particularly preferred are the ammonium, potassium, sodium, calcium, and magnesium salts. Salts derived from pharmaceutically acceptable organic non_toxic bases include salts of primary, secondary, and tertiary amines, substituted amines including naturally occurring substituted amines, cyclic amines and basic ion exchange resins, such as isopropylamine, trimethylamine, diethylamine, triethylamine, tripropylamine, and ethanolamine.

The pharmaceutical compositions may also include one or more of the following: carrier proteins such as serum albumin; buffers; fillers such as microcrystalline cellulose, lactose, corn and other starches; binding agents; sweeteners and other flavoring agents; coloring agents; and polyethylene glycol. Additives are well known in the art, and are used in a variety of formulations.

In a preferred embodiment, CA proteins and modulators are administered as therapeutic agents, and can be formulated as outlined above. Similarly, CA genes (including both the full-length sequence, partial sequences, or regulatory sequences of the CA coding regions) can be administered in gene therapy applications, as is known in the art. These CA genes can include antisense applications, either as gene therapy (i.e. for incorporation into the genome) or as antisense compositions, as will be appreciated by those in the art.

In a preferred embodiment, CA genes are administered as DNA vaccines, either single genes or combinations of CA genes. Naked DNA vaccines are generally known in the art. Brower, Nature Biotechnology, 16:1304-1305 (1998).

In one embodiment, CA genes of the present invention are used as DNA vaccines. Methods for the use of genes as DNA vaccines are well known to one of ordinary skill in the art, and include placing a CA gene or portion of a CA gene under the control of a promoter for expression in a patient with carcinoma. The CA gene used for DNA vaccines can encode full-length CA proteins, but more preferably encodes portions of the CA proteins including peptides derived from the CA protein. In a preferred embodiment a patient is immunized with a DNA vaccine comprising a plurality of nucleotide sequences derived from a CA gene. Similarly, it is possible to immunize a patient with a plurality of CA genes or portions thereof as defined herein. Without being bound by theory, expression of the polypeptide encoded by the DNA vaccine, cytotoxic T-cells, helper T-cells and antibodies are induced which recognize and destroy or eliminate cells expressing CA proteins.

In a preferred embodiment, the DNA vaccines include a gene encoding an adjuvant molecule with the DNA vaccine. Such adjuvant molecules include cytokines that increase the immunogenic response to the CA polypeptide encoded by the DNA vaccine. Additional or alternative adjuvants are known to those of ordinary skill in the art and find use in the invention.

In another preferred embodiment CA genes find use in generating animal models of carcinomas, particularly lymphoma carcinomas. As is appreciated by one of ordinary skill in the art, when the CA gene identified is repressed or diminished in CA tissue, gene therapy technology wherein antisense RNA directed to the CA gene will also diminish or repress expression of the gene. An animal generated as such serves as an animal model of CA that finds use in screening bioactive drug candidates. Similarly, gene knockout technology, for example as a result of homologous recombination with an appropriate gene targeting vector, will result in the absence of the CA protein. When desired, tissue-specific expression or knockout of the CA protein may be necessary.

It is also possible that the CA protein is overexpressed in carcinoma. As such, transgenic animals can be generated that overexpress the CA protein. Depending on the desired expression level, promoters of various strengths can be employed to express the transgene. Also, the number of copies of the integrated transgene can be determined and compared for a determination of the expression level of the transgene. Animals generated by such methods find use as animal models of CA and are additionally useful in screening for bioactive molecules to treat carcinoma.

The CA nucleic acid sequences of the invention are depicted in Tables 1-112. The sequences in Tables 1 (SEQ ID NOS:1-460) and 2 (SEQ ID NOS:461-952) depict mouse tags, i.e. the genomic insertion sites. The sequences in Tables 3-112 (SEQ ID NOS:953-1612) include genomic sequence, mRNA and coding sequences for both mouse and human. N/A indicates a gene that has been identified, but for which there has not been a name ascribed. The different sequences of Tables 3-112 are assigned the following SEQ ID Nos:

TABLE 3

(mouse gene: Fscn1; human gene SNL)

Mouse genomic sequence (SEQ ID NO: 953)
Mouse mRNA sequence (SEQ ID NO: 954)
Mouse coding sequence (SEQ ID NO: 955)
Human genomic sequence (SEQ ID NO: 956)
Human mRNA sequence (SEQ ID NO: 957)
Human coding sequence (SEQ ID NO: 958)

TABLE 4

(mouse gene Map3k6; human gene MAP3K6)

Mouse genomic sequence (SEQ ID NO: 959)
Mouse mRNA sequence (SEQ ID NO: 960)
Mouse coding sequence (SEQ ID NO: 961)
Human genomic sequece (SEQ ID NO: 962)
Human mRNA sequence (SEQ ID NO: 963)
Human coding sequence (SEQ ID NO: 964)

TABLE 5

(mouse gene Fosb; human gene FOSB)

Mouse genomic sequence (SEQ ID NO: 965)
Mouse mRNA sequence (SEQ ID NO: 966)

TABLE 5-continued (mouse gene Fosb; human gene FOSB)

Mouse coding sequence (SEQ ID NO: 967)
Human genomic sequence (SEQ ID NO: 968)
Human mRNA sequence (SEQ ID NO: 969)
Human coding sequence (SEQ ID NO: 970)

TABLE 6

(mouse gene cmkbr7; human gene: CCR7)

Mouse genomic sequence (SEQ ID NO: 971)
Mouse mRNA sequence (SEQ ID NO: 972)
Mouse coding sequence (SEQ ID NO: 973)
Human genomic sequence (SEQ ID NO: 974)
Human mRNA sequence (SEQ ID NO: 975)
Human coding sequence (SEQ ID NO: 976)

TABLE 7

(mouse gene: Ccnd1; human gene: CCND1)

Mouse genomic sequence (SEQ ID NO: 977)
Mouse mRNA sequence (SEQ ID NO: 978)
Mouse coding sequence (SEQ ID NO: 979)
Human genomic sequence (SEQ ID NO: 980)
Human mRNA sequence (SEQ ID NO: 981)
Human coding sequence (SEQ ID NO: 982)

TABLE 8

(mouse gene: Ccnd3; human gene: CCND3)
Mouse genomic sequence (SEQ ID NO: 983)
Mouse mRNA sequence (SEQ ID NO: 984)
Mouse coding sequence (SEQ ID NO: 985)
Human genomic sequence (SEQ ID NO: 986)
Human mRNA sequence (SEQ ID NO: 987)
Human coding sequence (SEQ ID NO: 988)

TABLE 9

(mouse gene: Wnt3; human gene: WNT3)
Mouse genomic sequence (SEQ ID NO: 989)
Mouse mRNA sequence (SEQ ID NO: 990)
Mouse coding sequence (SEQ ID NO: 991)
Human genomic sequence (SEQ ID NO: 992)
Human mRNA sequence (SEQ ID NO: 993)
Human coding sequence (SEQ ID NO: 994)

TABLE 10

(mouse gene: Baff; human gene: BATF)
Mouse genomic sequence (SEQ ID NO: 995)
Mouse mRNA sequence (SEQ ID NO: 996)
Mouse coding sequence (SEQ ID NO: 997)
Human genomic sequence (SEQ ID NO: 998)
Human mRNA sequence (SEQ ID NO: 999)
Human coding sequence (SEQ ID NO: 1000)

TABLE 11

(mouse gene: Irf4; human gene: IRF4)
Mouse genomic sequence (SEQ ID NO: 1001)
Mouse mRNA sequence (SEQ ID NO: 1002)
Mouse coding sequence (SEQ ID NO: 1003)

TABLE 11-continued

Human genomic sequence (SEQ ID NO: 1004)
Human mRNA sequence (SEQ ID NO: 1005)
Human coding sequence (SEQ ID NO: 1006)

TABLE 12

(mouse gene: Notch1; human gene: NOTCH1)
Mouse qenomic sequence (SEQ ID NO: 1007)
Mouse mRNA sequence (SEQ ID NO: 1008)
Mouse coding sequence (SEQ ID NO: 1009)
Human genomic sequence (SEQ ID NO: 1010)
Human mRNA sequence (SEQ ID NO: 1011)
Human coding sequence (SEQ ID NO: 1012)

TABLE 13

(mouse gene: Myc; human gene MYC)
Mouse genomic sequence (SEQ ID NO: 1013)
Mouse mRNA sequence (SEQ ID NO: 1014)
Mouse coding sequence (SEQ ID NO: 1015)
Human genomic sequence (SEQ ID NO: 1016)
Human mRNA sequence (SEQ ID NO: 1017)
Human codinq sequence (SEQ ID NO: 1018)

TABLE 14

(mouse gene Bach2; human gene BACH2)
Mouse genomic sequence (SEQ ID NO: 1019)
Mouse mRNA sequence (SEQ ID NO: 1020)
Mouse coding sequence (SEQ ID NO: 1021)
Human genomic sequence (SEQ ID NO: 1022)
Human mRNA sequence (SEQ ID NO: 1023)
Human coding sequence (SEQ ID NO: 1024)

TABLE 15

(mouse gene Wnt1; human gene WNT1)
Mouse genomic sequence (SEQ ID NO: 1025)
Mouse mRNA sequence (SEQ ID NO: 1026)
Mouse coding sequence (SEQ ID NO: 1027)
Human genomic sequence (SEQ ID NO: 1028)
Human mRNA sequence (SEQ ID NO: 1029)
Human coding sequence (SEQ ID NO: 1030)

TABLE 16

(mouse gene Rasgrp1: human gene: RASGRP1)
Mouse genomic sequence (SEQ ID NO: 1031)
Mouse mRNA sequence (SEQ ID NO: 1032)
Mouse coding sequence (SEQ ID NO: 1033)
Human genomic sequence (SEQ ID NO: 1034)
Human mRNA sequence (SEQ ID NO: 1035)
Human coding sequence (SEQ ID NO: 1036)

TABLE 17

(mouse gene: Nmyc1; human gene: MYCN)
Mouse genomic sequence (SEQ ID NO: 1037)
Mouse mRNA sequence (SEQ ID NO: 1038)
Mouse coding sequence (SEQ ID NO: 1039)
Human genomic sequence (SEQ ID NO: 1040)
Human mRNA sequence (SEQ ID NO: 1041)
Human coding sequence (SEQ ID NO: 1042)

TABLE 18

(mouse gene: Myb; human gene: MYB)
Mouse genomic sequence (SEQ ID NO: 1043)
Mouse mRNA sequence (SEQ ID NO: 1044)
Mouse coding sequence (SEQ ID NO: 1045)
Human genomic sequence (SEQ ID NO: 1046)
Human mRNA sequence (SEQ ID NO: 1047)
Human coding sequence (SEQ ID NO: 1048)

TABLE 19

(mouse gene: Sox4; human gene: SOX4)
Mouse genomic sequence (SEQ ID NO: 1049)
Mouse mRNA sequence (SEQ ID NO: 1050)
Mouse coding sequence (SEQ ID NO: 1051)
Human genomic sequence (SEQ ID NO: 1052)
Human mRNA sequence (SEQ ID NO: 1053)
Human coding seaunce (SEQ ID NO: 1054)

TABLE 20

(mouse gene: Tcof1; human gene: TCOF1)
Mouse genomic sequence (SEQ ID NO: 1055)
Mouse mRNA sequence (SEQ ID NO: 1056)
Mouse coding sequence (SEQ ID NO: 1057)
Human genomic sequence (SEQ ID NO: 1058)
Human mRNA sequence (SEQ ID NO: 1059)
Human coding sequence (SEQ ID NO: 1060)

TABLE 21

(mouse gene: Pim1; human gene: PIM1)
Mouse genomic sequence (SEQ ID NO: 1061)
Mouse mRNA sequence (SEQ ID NO: 1062)
Mouse coding sequence (SEQ ID NO: 1063)
Human genomic sequence (SEQ ID NO: 1064)
Human mRNA sequence (SEQ ID NO: 1065)
Human coding sequence (SEQ ID NO: 1066)

TABLE 22

(mouse gene: Wnt3a; human gene: WNT3A)
Mouse genomic sequence (SEQ ID NO: 1067)
Mouse mRNA sequence (SEQ ID NO: 1068)
Mouse coding sequence (SEQ ID NO: 1069)
Human genomic sequence (SEQ ID NO: 1070)
Human mRNA sequence (SEQ ID NO: 1071)
Human coding sequence (SEQ ID NO: 1072)

TABLE 23

(mouse gene: Ly6e; human gene LY6E)

Mouse genomic sequence (SEQ ID NO: 1073)
Mouse mRNA sequence (SEQ ID NO: 1074)
Mouse coding sequence (SEQ ID NO: 1075)
Human genomic sequence (SEQ ID NO: 1076)
Human mRNA sequence (SEQ ID NO: 1077)
Human coding sequence (SEQ ID NO: 1078)

TABLE 24

(mouse gene: Rasa2; human gene RASA2)

Mouse genomic sequence (SEQ ID NO: 1079)
Mouse mRNA sequence (SEQ ID NO: 1080)

TABLE 24-continued (mouse gene: Rasa2; human gene RASA2)

Mouse coding sequence (SEQ ID NO: 1081)
Human genomic sequence (SEQ ID NO: 1082)
Human mRNA sequence (SEQ ID NO: 1083)
Human coding sequence (SEQ ID NO: 1084)

TABLE 25

(mouse gene: Gata1: human gene GATA1)

Mouse genomic sequence (SEQ ID NO: 1085)
Mouse mRNA sequence (SEQ ID NO: 1086)
Mouse coding sequence (SEQ ID NO: 1087)
Human genomic sequence (SEQ ID NO: 1088)
Human mRNA sequence (SEQ ID NO: 1089)
Human coding sequence (SEQ ID NO: 1090)

TABLE 26

(mouse gene: Fkbp5; human gene FKBP5)

Mouse genomic sequence (SEQ ID NO: 1091)
Mouse mRNA sequence (SEQ ID NO: 1092)
Mouse coding sequence (SEQ ID NO: 1093)
Human genomic sequence (SEQ ID NO: 1094)
Human mRNA sequence (SEQ ID NO: 1095)
Human coding sequence (SEQ ID NO: 1096)

TABLE 27

(mouse gene: Rel; human gene REL)

Mouse genomic sequence (SEQ ID NO: 1097)
Mouse mRNA sequence (SEQ ID NO: 1098)
Mouse coding sequence (SEQ ID NO: 1099)
Human genomic sequence (SEQ ID NO: 1100)
Human mRNA sequence (SEQ ID NO: 1101)
Human coding sequence (SEQ ID NO: 1102)

TABLE 28

(mouse gene: Icsbp; human gene ICSBP1)

Mouse genomic sequence (SEQ ID NO: 1103)
Mouse mRNA sequence (SEQ ID NO: 1104)
Mouse coding sequence (SEQ ID NO: 1105)
Human genomic sequence (SEQ ID NO: 1106)
Human mRNA sequence (SEQ ID NO: 1107)
Human coding sequence (SEQ ID NO: 1108)

TABLE 29

(mouse gene: Bmi1; human gene BMI1)

Mouse genomic sequence (SEQ ID NO: 1109)
Mouse mRNA sequence (SEQ ID NO: 1110)
Mouse coding sequence (SEQ ID NO: 1111)
Human genomic sequence (SEQ ID NO: 1112)
Human mRNA sequence (SEQ ID NO: 1113)
Human coding sequence (SEQ ID NO: 1114)

TABLE 30

(mouse gene: Runx1; human gene RUNX1)

Mouse genomic sequence (SEQ ID NO: 1115)
Mouse mRNA sequence (SEQ ID NO: 1116)
Mouse coding sequence (SEQ ID NO: 1117)
Human genomic sequence (SEQ ID NO: 1118)
Human mRNA sequence (SEQ ID NO: 1119)
Human coding sequence (SEQ ID NO: 1120)

TABLE 31

(mouse gene: Il2ra; human gene IL2RA)

Mouse genomic sequence (SEQ ID NO: 1121)
Mouse mRNA sequence (SEQ ID NO: 1122)
Mouse coding sequence (SEQ ID NO: 1123)
Human genomic sequence (SEQ ID NO: 1124)
Human mRNA sequence (SEQ ID NO: 1125)
Human coding sequence (SEQ ID NO: 1126)

TABLE 32

(mouse gene: Nfkb1; human gene NFKB1)

Mouse genomic sequence (SEQ ID NO: 1127)
Mouse mRNA sequence (SEQ ID NO: 1128)
Mouse coding sequence (SEQ ID NO: 1129)
Human genomic sequence (SEQ ID NO: 1130)
Human mRNA sequence (SEQ ID NO: 1131)
Human coding sequence (SEQ ID NO: 1132)

TABLE 33

(mouse gene: Fyn; human gene FYN)

Mouse genomic sequence (SEQ ID NO: 1133)
Mouse mRNA sequence (SEQ ID NO: 1134)
Mouse coding sequence (SEQ ID NO: 1135)
Human genomic sequence (SEQ ID NO: 1136)
Human mRNA sequence (SEQ ID NO: 1137)
Human coding sequence (SEQ ID NO: 1138)

TABLE 34

(mouse gene: Nfkbil1; human gene NFKBIL1)

Mouse genomic sequence (SEQ ID NO: 1139)
Mouse mRNA sequence (SEQ ID NO: 1140)
Mouse coding sequence (SEQ ID NO: 1141)
Human genomic sequence (SEQ ID NO: 1142)
Human mRNA sequence (SEQ ID NO: 1143)
Human coding sequence (SEQ ID NO: 1144)

TABLE 35

(mouse gene: Flt3; human gene FLT3)

Mouse genomic sequence (SEQ ID NO: 1145)
Mouse mRNA sequence (SEQ ID NO: 1146)
Mouse coding sequence (SEQ ID NO: 1147)
Human genomic sequence (SEQ ID NO: 1148)
Human mRNA sequence (SEQ ID NO: 1149)
Human coding sequence (SEQ ID NO: 1150)

TABLE 36

(mouse gene: Dntt; human gene DNTT)

Mouse genomic sequence (SEQ ID NO: 1151)
Mouse mRNA sequence (SEQ ID NO: 1152)
Mouse coding sequence (SEQ ID NO: 1153)
Human genomic sequence (SEQ ID NO: 1154)
Human mRNA sequence (SEQ ID NO: 1155)
Human coding sequence (SEQ ID NO: 1156)

TABLE 37

(mouse gene: Znfn1a1; human gene ZNFN1A1)

Mouse genomic sequence (SEQ ID NO: 1157)
Mouse mRNA sequence (SEQ ID NO: 1158)
Mouse coding sequence (SEQ ID NO: 1159)
Human genomic sequence (SEQ ID NO: 1160)
Human mRNA sequence (SEQ ID NO: 1161)
Human coding sequence (SEQ ID NO: 1162)

TABLE 38

(mouse gene: Tbx21; human gene TBX21)

| | |
|---|---|
| Mouse genomic sequence | (SEQ ID NO: 1163) |
| Mouse mRNA sequence | (SEQ ID NO: 1164) |
| Mouse coding sequence | (SEQ ID NO: 1165) |
| Human genomic sequence | (SEQ ID NO: 1166) |
| Human mRNA sequence | (SEQ ID NO: 1167) |
| Human coding sequence | (SEQ ID NO: 1168) |

TABLE 39

(mouse gene: Stat5b; human gene STAT5B)

| | |
|---|---|
| Mouse genomic sequence | (SEQ ID NO: 1169) |
| Mouse mRNA sequence | (SEQ ID NO: 1170) |
| Mouse coding sequence | (SEQ ID NO: 1171) |
| Human genomic sequence | (SEQ ID NO: 1172) |
| Human mRNA sequence | (SEQ ID NO: 1173) |
| Human coding sequence | (SEQ ID NO: 1174) |

TABLE 40

(mouse gene: Sema4d; human gene SEMA4D)

| | |
|---|---|
| Mouse genomic sequence | (SEQ ID NO: 1175) |
| Mouse mRNA sequence | (SEQ ID NO: 1176) |
| Mouse coding sequence | (SEQ ID NO 1177) |
| Human genomic sequence | (SEQ ID NO 1178) |
| Human mRNA sequence | (SEQ ID NO: 1179) |
| Human coding sequence | (SEQ ID NO: 1180) |

TABLE 41

(mouse gene: Mdm2; human gene MDM2)

| | |
|---|---|
| Mouse genomic sequence | (SEQ ID NO: 1181) |
| Mouse mRNA sequence | (SEQ ID NO: 1182) |
| Mouse coding sequence | (SEQ ID NO: 1183) |
| Human genomic sequence | (SEQ ID NO: 1184) |
| Human mRNA sequence | (SEQ ID NO: 1185) |
| Human coding sequence | (SEQ ID NO: 1186) |

TABLE 42

(mouse gene: Prlr; human gene PRLR)

| | |
|---|---|
| Mouse genomic sequence | (SEQ ID NO: 1187) |
| Mouse mRNA sequence | (SEQ ID NO: 1188) |
| Mouse coding sequence | (SEQ ID NO: 1189) |
| Human genomic sequence | (SEQ ID NO: 1190) |
| Human mRNA sequence | (SEQ ID NO: 1191) |
| Human coding sequence | (SEQ ID NO: 1192) |

TABLE 43

(mouse gene: Top1; human gene TOP1)

| | |
|---|---|
| Mouse genomic sequence | (SEQ ID NO: 1193) |
| Mouse mRNA sequence | (SEQ ID NO: 1194) |
| Mouse coding sequence | (SEQ ID NO: 1195) |
| Human genomic sequence | (SEQ ID NO: 1196) |
| Human mRNA sequence | (SEQ ID NO: 1197) |
| Human coding sequence | (SEQ ID NO: 1198) |

TABLE 44

(mouse gene: Dusp10; human gene DUSP10)

| | |
|---|---|
| Mouse genomic sequence | (SEQ ID NO: 1199) |
| Mouse mRNA sequence | (SEQ ID NO: 1200) |
| Mouse coding sequence | (SEQ ID NO: 1201) |
| Human genomic sequence | (SEQ ID NO: 1202) |
| Human mRNA sequence | (SEQ ID NO: 1203) |
| Human coding sequence | (SEQ ID NO: 1204) |

TABLE 45

(mouse gene: Fli1; human gene FLI1)

| | |
|---|---|
| Mouse genomic sequence | (SEQ ID NO: 1205) |
| Mouse mRNA sequence | (SEQ ID NO: 1206) |
| Mouse coding sequence | (SEQ ID NO: 1207) |
| Human genomic sequence | (SEQ ID NO: 1208) |
| Human mRNA sequence | (SEQ ID NO: 1209) |
| Human coding sequence | (SEQ ID NO: 1210) |

TABLE 46

(mouse gene: Tk2; human gene TK2)

| | |
|---|---|
| Mouse genomic sequence | (SEQ ID NO: 1211) |
| Mouse mRNA sequence | (SEQ ID NO: 1212) |
| Mouse coding sequence | (SEQ ID NO: 1213) |
| Human genomic sequence | (SEQ ID NO: 1214) |
| Human mRNA sequence | (SEQ ID NO: 1215) |
| Human coding sequence | (SEQ ID NO: 1216) |

TABLE 47

(mouse gene: Nupr1)

| | |
|---|---|
| Mouse genomic sequence | (SEQ ID NO: 1217) |
| Mouse mRNA sequence | (SEQ ID NO: 1218) |
| Mouse coding sequence | (SEQ ID NO: 1219) |
| Human genomic sequence | (SEQ ID NO: 1220) |
| Human mRNA sequence | (SEQ ID NO: 1221) |
| Human coding sequence | (SEQ ID NO: 1222) |

TABLE 48

(mouse gene: Zfhx1b; human gene ZFHX1B)

| | |
|---|---|
| Mouse genomic sequence | (SEQ ID NO: 1223) |
| Mouse mRNA sequence | (SEQ ID NO: 1224) |
| Mouse coding sequence | (SEQ ID NO: 1225) |
| Human genomic sequence | (SEQ ID NO: 1226) |
| Human mRNA sequence | (SEQ ID NO: 1227) |
| Human coding sequence | (SEQ ID NO: 1228) |

TABLE 49

(mouse gene: Vdac1; human gene VDAC1)

| | |
|---|---|
| Mouse genomic sequence | (SEQ ID NO: 1229) |
| Mouse mRNA sequence | (SEQ ID NO: 1230) |
| Mouse coding sequence | (SEQ ID NO: 1231) |
| Human genomic sequence | (SEQ ID NO: 1232) |
| Human mRNA sequence | (SEQ ID NO: 1233) |
| Human coding sequence | (SEQ ID NO: 1234) |

TABLE 50

(mouse gene: Nfatc1; human gene NFATC1)

| | |
|---|---|
| Mouse genomic sequence | (SEQ ID NO: 1235) |
| Mouse mRNA sequence | (SEQ ID NO: 1236) |
| Mouse coding sequence | (SEQ ID NO: 1237) |
| Human genomic sequence | (SEQ ID NO: 1238) |
| Human mRNA sequence | (SEQ ID NO: 1239) |
| Human coding sequence | (SEQ ID NO: 1240) |

TABLE 51

(mouse gene: Syk; human gene SYK)

| | |
|---|---|
| Mouse genomic sequence | (SEQ ID NO: 1241) |
| Mouse mRNA sequence | (SEQ ID NO: 1242) |
| Mouse coding sequence | (SEQ ID NO: 1243) |
| Human genomic sequence | (SEQ ID NO: 1244) |
| Human mRNA sequence | (SEQ ID NO: 1245) |
| Human coding sequence | (SEQ ID NO: 1246) |

TABLE 52

(mouse gene: Gnb1; human gene GNB1)

| | |
|---|---|
| Mouse genomic sequence | (SEQ ID NO: 1247) |
| Mouse mRNA sequence | (SEQ ID NO: 1248) |
| Mouse coding sequence | (SEQ ID NO: 1249) |
| Human genomic sequence | (SEQ ID NO: 1250) |
| Human mRNA sequence | (SEQ ID NO: 1251) |
| Human coding sequence | (SEQ ID NO: 1252). |

TABLE 53

(mouse gene: Ccnd2; human gene CCND2)

| | |
|---|---|
| Mouse genomic sequence | (SEQ ID NO: 1253) |
| Mouse mRNA sequence | (SEQ ID NO: 1254) |
| Mouse coding sequence | (SEQ ID NO: 1255) |
| Human genomic sequence | (SEQ ID NO: 1256) |
| Human mRNA sequence | (SEQ ID NO: 1257) |
| Human coding sequence | (SEQ ID NO: 1258) |

TABLE 54

(mouse gene Tnfrsf6; human gene TNFRSF6)

Mouse genomic sequence (SEQ ID NO: 1259)
Mouse mRNA sequence (SEQ ID NO: 1260)
Mouse coding sequence (SEQ ID NO: 1261)
Human genomic sequence (SEQ ID NO: 1262)
Human mRNA sequence (SEQ ID NO: 1263)
Human coding sequence (SEQ ID NO: 1264)

TABLE 55

(mouse gene Irf2; human gene IRF2)

Mouse genomic sequence (SEQ ID NO: 1265)
Mouse mRNA sequence (SEQ ID NO: 1266)
Mouse coding sequence (SEQ ID NO: 1267)
Human genomic sequence (SEQ ID NO: 1268)
Human mRNA sequence (SEQ ID NO: 1269)
Human coding sequence (SEQ ID NO: 1270)

TABLE 56

(mouse gene Morf; human gene: MORF)

Mouse genomic sequence (SEQ ID NO: 1271)
Mouse mRNA sequence (SEQ ID NO: 1272)
Mouse coding sequence (SEQ ID NO: 1273)
Human genomic sequence (SEQ ID NO: 1274)
Human mRNA sequence (SEQ ID NO: 1275)
Human coding sequence (SEQ ID NO: 1276)

TABLE 57

(mouse gene: Runx3; human gene: RUNX3)

Mouse genomic sequence (SEQ ID NO: 1277)
Mouse mRNA sequence (SEQ ID NO: 1278)
Mouse coding sequence (SEQ ID NO: 1279)
Human genomic sequence (SEQ ID NO: 1280)
Human mRNA sequence (SEQ ID NO: 1281)
Human coding sequence (SEQ ID NO: 1282)

TABLE 58

(mouse gene: Bcl11b; human gene: BCL11B)

Mouse genomic sequence (SEQ ID NO: 1283)
Mouse mRNA sequence (SEQ ID NO: 1284)
Mouse coding sequence (SEQ ID NO: 1285)
Human genomic sequence (SEQ ID NO: 1286)
Human mRNA sequence (SEQ ID NO: 1287)
Human coding sequence (SEQ ID NO: 1288)

TABLE 59

(mouse gene: Arhgef1; human gene: ARHGEF1)

Mouse genomic sequence (SEQ ID NO: 1289)
Mouse mRNA sequence (SEQ ID NO: 1290)
Mouse coding sequence (SEQ ID NO: 1291)
Human genomic sequence (SEQ ID NO: 1292)
Human mRNA sequence (SEQ ID NO: 1293)
Human coding sequence (SEQ ID NO: 1294)

TABLE 60

(mouse gene: Ptprk; human gene: PTPRK)

Mouse genomic sequence (SEQ ID NO: 1295)
Mouse mRNA sequence (SEQ ID NO: 1296)
Mouse coding sequence (SEQ ID NO: 1297)
Human genomic sequence (SEQ ID NO: 1298)
Human mRNA sequence (SEQ ID NO: 1299)
Human coding sequence (SEQ ID NO: 1300)

TABLE 61

(mouse gene: Mcmd5; human gene: MCM5)

Mouse genomic sequence (SEQ ID NO: 1301)
Mouse mRNA sequence (SEQ ID NO: 1302)
Mouse coding sequence (SEQ ID NO: 1303)
Human genomic sequence (SEQ ID NO: 1304)
Human mRNA sequence (SEQ ID NO: 1305)
Human coding sequence (SEQ ID NO: 1306)

TABLE 62

(mouse gene: Matn4; human gene: MATN4)

Mouse genomic sequence (SEQ ID NO: 1307)
Mouse mRNA sequence (SEQ ID NO: 1308)
Mouse coding sequence (SEQ ID NO: 1309)
Human genomic sequence (SEQ ID NO: 1310)
Human mRNA sequence (SEQ ID NO: 1311)
Human coding sequence (SEQ ID NO: 1312)

TABLE 63

(mouse gene: Tnfsf11; human gene TNFSF11)

Mouse genomic sequence (SEQ ID NO: 1313)
Mouse mRNA sequence (SEQ ID NO: 1314)
Mouse coding sequence (SEQ ID NO: 1315)
Human genomic sequence (SEQ ID NO: 1316)
Human mRNA sequence (SEQ ID NO: 1317)
Human coding sequence (SEQ ID NO: 1318)

TABLE 64

(mouse gene: Itk; human gene ITK)

Mouse genomic sequence (SEQ ID NO: 1319)
Mouse mRNA sequence (SEQ ID NO: 1320)
Mouse coding sequence (SEQ ID NO: 1321)
Human genomic sequence (SEQ ID NO: 1322)
Human mRNA sequence (SEQ ID NO: 1323)
Human coding sequence (SEQ ID NO: 1324)

TABLE 65

(mouse gene: Fish; human gene: N/A)

Mouse genomic sequence (SEQ ID NO: 1325)
Mouse mRNA sequence (SEQ ID NO: 1326)
Mouse coding sequence (SEQ ID NO: 1327)
Human genomic sequence (SEQ ID NO: 1328)
Human mRNA sequence (SEQ ID NO: 1329)
Human coding sequence (SEQ ID NO: 1330)

TABLE 66

(mouse gene: Egr2; human gene EGR2)

Mouse genomic sequence (SEQ ID NO: 1331)
Mouse mRNA sequence (SEQ ID NO: 1332)
Mouse coding sequence (SEQ ID NO: 1333)
Human genomic sequence (SEQ ID NO: 1334)
Human mRNA sequence (SEQ ID NO: 1335)
Human coding sequence (SEQ ID NO: 1336)

TABLE 67

(mouse gene: Sos1; human gene SOS1)

Mouse genomic sequence (SEQ ID NO: 1337)
Mouse mRNA sequence (SEQ ID NO: 1338)
Mouse coding sequence (SEQ ID NO: 1339)
Human genomic sequence (SEQ ID NO: 1340)
Human mRNA sequence (SEQ ID NO: 1341)
Human coding sequence (SEQ ID NO: 1342)

TABLE 68

(mouse gene: Pou2af1; human gene POU2AF1)

| | |
|---|---|
| Mouse genomic sequence | (SEQ ID NO: 1343) |
| Mouse mRNA sequence | (SEQ ID NO: 1344) |
| Mouse coding sequence | (SEQ ID NO: 1345) |
| Human genomic sequence | (SEQ ID NO: 1346) |
| Human mRNA sequence | (SEQ ID NO: 1347) |
| Human coding sequence | (SEQ ID NO: 1348) |

TABLE 69

(mouse gene: Mef2c; human gene MEF2C)

| | |
|---|---|
| Mouse genomic sequence | (SEQ ID NO: 1349) |
| Mouse mRNA sequence | (SEQ ID NO: 1350) |
| Mouse coding sequence | (SEQ ID NO: 1351) |
| Human genomic sequence | (SEQ ID NO: 1352) |
| Human mRNA sequence | (SEQ ID NO: 1353) |
| Human coding sequence | (SEQ ID NO: 1354) |

TABLE 70

(mouse gene: Map3k8; human gene MAP3K8)

| | |
|---|---|
| Mouse genomic sequence | (SEQ ID NO: 1355) |
| Mouse mRNA sequence | (SEQ ID NO: 1356) |
| Mouse coding sequence | (SEQ ID NO: 1357) |
| Human genomic sequence | (SEQ ID NO: 1358) |
| Human mRNA sequence | (SEQ ID NO: 1359) |
| Human coding sequence | (SEQ ID NO: 1360) |

TABLE 71

(mouse gene: Fgfr3; human gene FGFR3)

| | |
|---|---|
| Mouse genomic sequence | (SEQ ID NO: 1361) |
| Mouse mRNA sequence | (SEQ ID NO: 1362) |
| Mouse coding sequence | (SEQ ID NO: 1363) |
| Human genomic sequence | (SEQ ID NO: 1364) |
| Human mRNA sequence | (SEQ ID NO: 1365) |
| Human coding sequence | (SEQ ID NO: 1366) |

TABLE 72

(mouse gene: Cbx8; human gene CBX8)

| | |
|---|---|
| Mouse genomic sequence | (SEQ ID NO: 1367) |
| Mouse mRNA sequence | (SEQ ID NO: 1368) |
| Mouse coding sequence | (SEQ ID NO: 1369) |
| Human genomic sequence | (SEQ ID NO: 1370) |
| Human mRNA sequence | (SEQ ID NO: 1371) |
| Human coding sequence | (SEQ ID NO: 1372) |

TABLE 73

(mouse gene: Lmo2; human gene LMO2)

| | |
|---|---|
| Mouse genomic sequence | (SEQ ID NO: 1373) |
| Mouse mRNA sequence | (SEQ ID NO: 1374) |
| Mouse coding sequence | (SEQ ID NO: 1375) |
| Human genomic sequence | (SEQ ID NO: 1376) |
| Human mRNA sequence | (SEQ ID NO: 1377) |
| Human coding sequence | (SEQ ID NO: 1378) |

TABLE 74

(mouse gene: Itpr1; human gene ITPR1)

| | |
|---|---|
| Mouse genomic sequence | (SEQ ID NO: 1379) |
| Mouse mRNA sequence | (SEQ ID NO: 1380) |
| Mouse coding sequence | (SEQ ID NO: 1381) |
| Human genomic sequence | (SEQ ID NO: 1382) |
| Human mRNA sequence | (SEQ ID NO: 1383) |
| Human coding sequence | (SEQ ID NO: 1384) |

TABLE 75

(mouse gene: Sell; human gene SELL)

| | |
|---|---|
| Mouse genomic sequence | (SEQ ID NO: 1385) |
| Mouse mRNA sequence | (SEQ ID NO: 1386) |
| Mouse coding sequence | (SEQ ID NO: 1387) |
| Human genomic sequence | (SEQ ID NO: 1388) |
| Human mRNA sequence | (SEQ ID NO: 1389) |
| Human coding sequence | (SEQ ID NO: 1390) |

TABLE 76

(mouse gene: Dpt; human gene DPT)

| | |
|---|---|
| Mouse genomic sequence | (SEQ ID NO: 1391) |
| Mouse mRNA sequence | (SEQ ID NO: 1392) |
| Mouse coding sequence | (SEQ ID NO: 1393) |
| Human genomic sequence | (SEQ ID NO: 1394) |
| Human mRNA sequence | (SEQ ID NO: 1395) |
| Human coding sequence | (SEQ ID NO: 1396) |

TABLE 77

(mouse gene: Pap; human gene PAP)

| | |
|---|---|
| Mouse genomic sequence | (SEQ ID NO: 1397) |
| Mouse mRNA sequence | (SEQ ID NO: 1398) |
| Mouse coding sequence | (SEQ ID NO: 1399) |
| Human genomic sequence | (SEQ ID NO: 1400) |
| Human mRNA sequence | (SEQ ID NO: 1401) |
| Human coding sequence | (SEQ ID NO: 1402) |

TABLE 78

(mouse gene: Blm; human gene BLM)

| | |
|---|---|
| Mouse genomic sequence | (SEQ ID NO: 1403) |
| Mouse mRNA sequence | (SEQ ID NO: 1404) |
| Mouse coding sequence | (SEQ ID NO: 1405) |
| Human genomic sequence | (SEQ ID NO: 1406) |
| Human mRNA sequence | (SEQ ID NO: 1407) |
| Human coding sequence | (SEQ ID NO: 1408) |

TABLE 79

(mouse gene: Blr1; human gene BLR1)

| | |
|---|---|
| Mouse genomic sequence | (SEQ ID NO: 1409) |
| Mouse mRNA sequence | (SEQ ID NO: 1410) |
| Mouse coding sequence | (SEQ ID NO: 1411) |
| Human genomic sequence | (SEQ ID NO: 1412) |
| Human mRNA sequence | (SEQ ID NO: 1413) |
| Human coding sequence | (SEQ ID NO: 1414) |

TABLE 80

(mouse gene: Ptp4a2; human gene PTP4A2)

| | |
|---|---|
| Mouse genomic sequence | (SEQ ID NO: 1415) |
| Mouse mRNA sequence | (SEQ ID NO: 1416) |
| Mouse coding sequence | (SEQ ID NO: 1417) |
| Human genomic sequence | (SEQ ID NO: 1418) |
| Human mRNA sequence | (SEQ ID NO: 1419) |
| Human coding sequence | (SEQ ID NO: 1420) |

TABLE 81

(mouse gene: Mcm3ap; human gene MCM3AP)

| | |
|---|---|
| Mouse genomic sequence | (SEQ ID NO: 1421) |
| Mouse mRNA sequence | (SEQ ID NO: 1422) |
| Mouse coding sequence | (SEQ ID NO: 1423) |
| Human genomic sequence | (SEQ ID NO: 1424) |
| Human mRNA sequence | (SEQ ID NO: 1425) |
| Human coding sequence | (SEQ ID NO: 1426) |

TABLE 82

(mouse gene: Jak2; human gene JAK2)

| | |
|---|---|
| Mouse genomic sequence | (SEQ ID NO: 1427) |
| Mouse mRNA sequence | (SEQ ID NO: 1428) |
| Mouse coding sequence | (SEQ ID NO: 1429) |
| Human genomic sequence | (SEQ ID NO: 1430) |
| Human mRNA sequence | (SEQ ID NO: 1431) |
| Human coding sequence | (SEQ ID NO: 1432) |

TABLE 83

(mouse gene: Fus1; human gene FUS1)

| |
|---|
| Mouse genomic sequence (SEQ ID NO: 1433) |
| Mouse mRNA sequence (SEQ ID NO: 1434) |
| Mouse coding sequence (SEQ ID NO: 1435) |
| Human genomic sequence (SEQ ID NO: 1436) |
| Human mRNA sequence (SEQ ID NO: 1437) |
| Human coding sequence (SEQ ID NO: 1438) |

TABLE 84

(mouse gene: Rassf1; human gene RASSF1)

| |
|---|
| Mouse genomic sequence (SEQ ID NO: 1439) |
| Mouse mRNA sequence (SEQ ID NO: 1440) |
| Mouse coding sequence (SEQ ID NO: 1441) |
| Human genomic sequence (SEQ ID NO: 1442) |
| Human mRNA sequence (SEQ ID NO: 1443) |
| Human coding sequence (SEQ ID NO: 1444) |

TABLE 85

(mouse gene: Pik3r1; human gene PIK3R1)

| |
|---|
| Mouse genomic sequence (SEQ ID NO: 1445) |
| Mouse mRNA sequence (SEQ ID NO: 1446) |
| Mouse coding sequence (SEQ ID NO: 1447) |
| Human genomic sequence (SEQ ID NO: 1448) |
| Human mRNA sequence (SEQ ID NO: 1449) |
| Human coding sequence (SEQ ID NO: 1450) |

TABLE 86

(mouse gene: Braf; human gene BRAF)

| |
|---|
| Mouse genomic sequence (SEQ ID NO: 1451) |
| Mouse mRNA sequence (SEQ ID NO: 1452) |
| Mouse coding sequence (SEQ ID NO: 1453) |
| Human genomic sequence (SEQ ID NO: 1454) |
| Human mRNA sequence (SEQ ID NO: 1455) |
| Human coding sequence (SEQ ID NO: 1456) |

TABLE 87

(mouse gene: Tle3; human gene: TLE3)

| |
|---|
| Mouse genomic sequence (SEQ ID NO: 1457) |
| Mouse mRNA sequence (SEQ ID NO: 1458) |
| Mouse coding sequence (SEQ ID NO: 1459) |
| Human genomic sequence (SEQ ID NO: 1460) |
| Human mRNA sequence (SEQ ID NO: 1461) |
| Human coding sequence (SEQ ID NO: 1462) |

TABLE 88

(mouse gene: Nek; human gene NEK2)

| |
|---|
| Mouse genomic sequence (SEQ ID NO: 1463) |
| Mouse mRNA sequence (SEQ ID NO: 1464) |
| Mouse coding sequence (SEQ ID NO: 1465) |
| Human genomic sequence (SEQ ID NO: 1466) |
| Human mRNA sequence (SEQ ID NO: 1467) |
| Human coding sequence (SEQ ID NO: 1468) |

TABLE 89

(mouse gene: Nr3c1; human gene NR3C1)

| |
|---|
| Mouse genomic sequence (SEQ ID NO: 1469) |
| Mouse mRNA sequence (SEQ ID NO: 1470) |
| Mouse coding sequence (SEQ ID NO: 1471) |
| Human genomic sequence (SEQ ID NO: 1472) |
| Human mRNA sequence (SEQ ID NO: 1473) |
| Human coding sequence (SEQ ID NO: 1474) |

TABLE 90

(mouse gene: Dad1; human gene DAD1)

Mouse genomic sequence (SEQ ID NO: 1475)
Mouse mRNA sequence (SEQ ID NO: 1476)
Mouse coding sequence (SEQ ID NO: 1477)
Human genomic sequence (SEQ ID NO: 1478)
Human mRNA sequence (SEQ ID NO: 1479)
Human coding sequence (SEQ ID NO: 1480)

TABLE 91

(mouse gene: Lck; human gene LCK)

Mouse genomic sequence (SEQ ID NO: 1481)
Mouse mRNA sequence (SEQ ID NO: 1482)
Mouse coding sequence (SEQ ID NO: 1483)
Human genomic sequence (SEQ ID NO: 1484)
Human mRNA sequence (SEQ ID NO: 1485)
Human coding sequence (SEQ ID NO: 1486)

TABLE 92

(mouse gene: Git2; human gene GIT2)

Mouse genomic sequence (SEQ ID NO: 1487)
Mouse mRNA sequence (SEQ ID NO: 1488)
Mouse coding sequence (SEQ ID NO: 1489)
Human genomic sequence (SEQ ID NO: 1490)
Human mRNA sequence (SEQ ID NO: 1491)
Human coding sequence (SEQ ID NO: 1492).

TABLE 93

(mouse gene: Anp32; human gene N/A)

Mouse genomic sequence (SEQ ID NO: 1493)
Mouse mRNA sequence (SEQ ID NO: 1494)
Mouse coding sequence (SEQ ID NO: 1495)
Human genomic sequence (SEQ ID NO: 1496)
Human mRNA sequence (SEQ ID NO: 1497)
Human coding sequence (SEQ ID NO: 1498).

TABLE 94

(mouse gene: Map2k5; human gene MAP2K5)

Mouse genomic sequence (SEQ ID NO: 1499)
Mouse mRNA sequence (SEQ ID NO: 1500)
Mouse coding sequence (SEQ ID NO: 1501)
Human genomic sequence (SEQ ID NO: 1502)
Human mRNA sequence (SEQ ID NO: 1503)
Human coding sequence (SEQ ID NO: 1504).

TABLE 95

(mouse gene: Cd28; human gene CD28)

Mouse genomic sequence (SEQ ID NO: 1505)
Mouse mRNA sequence (SEQ ID NO: 1506)
Mouse coding sequence (SEQ ID NO: 1507)
Human genomic sequence (SEQ ID NO: 1508)
Human mRNA sequence (SEQ ID NO: 1509)
Human coding sequence (SEQ ID NO: 1510).

TABLE 96

(mouse gene: Sept9; human gene Msf)

Mouse genomic sequence (SEQ ID NO: 1511)
Mouse mRNA sequence (SEQ ID NO: 1512)
Mouse coding sequence (SEQ ID NO: 1513)
Human genomic sequence (SEQ ID NO: 1514)
Human mRNA sequence (SEQ ID NO: 1515)
Human coding sequence (SEQ ID NO: 1516).

TABLE 97

(mouse gene: Fzd10; human gene FZD10)

Mouse genomic sequence (SEQ ID NO: 1517)
Mouse mRNA sequence (SEQ ID NO: 1518)
Mouse coding sequence (SEQ ID NO: 1519)
Human genomic sequence (SEQ ID NO: 1520)
Human mRNA sequence (SEQ ID NO: 1521)
Human coding sequence (SEQ ID NO: 1522).

TABLE 98

(mouse gene: Calm2; human gene CALM2)

Mouse genomic sequence (SEQ ID NO:1523)
Mouse mRNA sequence (SEQ ID NO:1524)
Mouse coding sequence (SEQ ID NO:1525)
Human genomic sequence (SEQ ID NO:1526)
Human mRNA sequence (SEQ ID NO:1527)
Human coding sequence (SEQ ID NO:1528).

TABLE 99

(mouse gene: Ncf4; human gene NCF4)

Mouse genomic sequence (SEQ ID NO:1529)
Mouse mRNA sequence (SEQ ID NO:1530)
Mouse coding sequence (SEQ ID NO:1531)
Human genomic sequence (SEQ ID NO:1532)
Human mRNA sequence (SEQ ID NO:1533)
Human coding sequence (SEQ ID NO:1534).

TABLE 100

(mouse gene: Rac2; human gene RAC2)

Mouse genomic sequence (SEQ ID NO:1535)
Mouse mRNA sequence (SEQ ID NO:1536)
Mouse coding sequence (SEQ ID NO:1537)
Human genomic sequence (SEQ ID NO:1538)
Human mRNA sequence (SEQ ID NO:1539)
Human coding sequence (SEQ ID NO:1540).

TABLE 101

(mouse gene: Mbnl; human gene MBNL)

Mouse genomic sequence (SEQ ID NO:1541)
Mouse mRNA sequence (SEQ ID NO:1542)
Mouse coding sequence (SEQ ID NO:1543)
Human genomic sequence (SEQ ID NO:1544)
Human mRNA sequence (SEQ ID NO:1545)
Human coding sequence (SEQ ID NQ:1546).

TABLE 102

(mouse gene: mCG10516; human gene N/A)

Mouse genomic sequence (SEQ ID NO:1547)
Mouse mRNA sequence (SEQ NQ:1548)
Mouse coding sequence (SEQ ID NO:1549)
Human genomic sequence (SEQ ID NO:1550)
Human mRNA sequence (SEQ ID NO:1551)
Human coding sequence (SEQ ID NO:1552)

TABLE 103

(mouse gene: Rorc; human gene RORC)

Mouse genomic sequence (SEQ ID NO:1553)
Mouse mRNA sequence (SEQ ID NO:1554)
Mouse coding sequence (SEQ ID NO:1555)
Human genomic sequence (SEQ ID NO:1556)
Human mRNA sequence (SEQ ID NO:1557)
Human coding sequence (SEQ ID NO:1558)

TABLE 104

(mouse gene mCG15938; human gene BAT1)

Mouse genomic sequence (SEQ ID NO:1559)
Mouse mRNA sequence (SEQ ID NO:1560)
Mouse coding sequence (SEQ ID NO:1561)
Human genomic sequence (SEQ ID NO:1562)
Human mRNA sequence (SEQ ID NO:1563)
Human codina secuence (SEQ ID NO:1564)

TABLE 105

(mouse gene: Iqgap1; human gene IQGAP1)

Mouse genomic sequence (SEQ ID NO:1565)
Mouse mRNA sequence (SEQ ID NO:1566)
Mouse coding sequence (SEQ ID NO:1567)
Human genomic sequence (SEQ ID NO:1568)
Human mRNA sequence (SEQ ID NO:1569)
Human coding sequence (SEQ ID NO:1570)

TABLE 106

(mouse gene Zpf29; human gene: hCG27579)

Mouse genomic sequence (SEQ ID NO:1571)
Mouse mRNA sequence (SEQ ID NO:1572)
Mouse coding sequence (SEQ ID NO:1573)
Human genomic sequence (SEQ ID NO:1574)
Human mRNA sequence (SEQ ID NO:1575)
Human coding sequence (SEQ ID NO:1576)

TABLE 107

(mouse gene: Kcnj9; human gene: KCNJ9)

Mouse genomic sequence (SEQ ID NO:1577)
Mouse mRNA sequence (SEQ ID NO:1578)
Mouse coding sequence (SEQ ID NO:1579)
Human genomic sequence (SEQ ID NO:1580)
Human mRNA sequence (SEQ ID NO:1581)
Human coding sequence (SEQ ID NO:1582)

TABLE 108

(mouse gene: Ppp3cc; human gene: PPP3CC)

Mouse genomic sequence (SEQ ID NO:1583)
Mouse mRNA sequence (SEQ ID NO:1584)
Mouse coding sequence (SEQ ID NO:1585)
Human genomic sequence (SEQ ID NO:1586)
Human mRNA sequence (SEQ ID NO:1587)
Human coding sequence (SEQ ID NO:1588)

TABLE 109

(mouse gene: mCG910; human gene: hCG27579)

Mouse genomic sequence (SEQ ID NO:1589)
Mouse mRNA sequence (SEQ ID NO:1590)
Mouse coding sequence (SEQ ID NO:1591)
Human genomic sequence (SEQ ID NO:1592)
Human mRNA sequence (SEQ ID NO:1593)
Human coding sequence (SEQ ID NO:1594)

TABLE 110

(mouse gene: mCG2257; human gene: PRDM11)

Mouse genomic sequence (SEQ ID NO:1595)
Mouse mRNA sequence (SEQ ID NO:1596)
Mouse coding sequence (SEQ ID NO:1597)
Human genomic sequence (SEQ ID NO:1598)
Human mRNA sequence (SEQ ID NO:1599)
Human coding sequence (SEQ ID NO:1600)

TABLE 111

(mouse gene: mCG17918; human gene: hCG23764)

Mouse genomic sequence (SEQ ID NO:1601)
Mouse mRNA sequence (SEQ ID NO:1602)
Mouse coding sequence (SEQ ID NO:1603)
Human genomic sequence (SEQ ID NO:1604)
Human mRNA sequence (SEQ ID NO:1605)
Human coding sequence (SEQ ID NO:1606)

TABLE 112

(mouse gene: Lfng; human gene: LFNG)

Mouse genomic sequence (SEQ ID NO:1607)
Mouse mRNA sequence (SEQ ID NO:1608)
Mouse coding sequence (SEQ ID NO:1609)
Human genomic sequence (SEQ ID NO:1610)
Human mRNA sequence (SEQ ID NO:1611)
Human coding sequence (SEQ ID NO:1612).

TABLE 1

| SEQ ID NO: | MUTATION | SEQUENCE | CLONE | CLASS. | GENE |
|---|---|---|---|---|---|
| 1 | IM000619 | GATCAAAGCAATCTCTATGTCTTTCTCTG CTGTCCTCCTCAGACATCTCCAGAGAGC TGGGATATTTTCTTTCCCATTTGAGATT ATGAAGTTGTTTCTAGAGTGCATGACGC AGGTTGAAGGATAAGTACACAGGTCCCA AGGAACCAAGCGTTTTCACTGACGGTGA TGAGTCTTGTTCGTGAGATTGTTGTGATT CTCAGCCTTTCTCTTCCCCTGTGTGTGCT CTTCATTTTCTGGTTCTGTCTGCCTAGCA CCTCCTGGGGAAGCTGCTGTGCTTT | p000632 | A | Spr |
| 2 | IM000620 | GATCTTTGGAGCCCAGTTGTTAATCATAA GAGCTGATATTTTGAAAGAGTGTGTCAA CCTAGATGCACAGGGAAGCCAAAGCATT CAGCC | p000633 | D | — |
| 3 | IM000621 | ATATGACCACAAGGAAATAAGATAAAGT GTTCATACTGAATTTATAATGAAAAGTGA TC | p000634 | C | — |
| 4 | IM000622 | GAACAGGCATGGCTTTACTTGTACAATG AGGAAACCAAGGCAGAGATTGCAAAGCG GGTCCTACACGTTTGCTCCATGCCCTGC TTCTCTGACCACAGTGTACTGAGAATATG CTGAGCCCTAGTTCCTGGGGAGGAGGC AGAAGAGAGCAGCATCCTGCCCACTTGA AGGCGTGCACACATAGTTCCTGTCTGAT C | p000638 | D | — |
| 5 | IM000623 | GATCAGGAGACCACACCCAGCTAGCCTT CTCTGACTGGGTATCCTTGGTCAGCCAG CCTTTCTTCACCTCATGTTCTCATTTGCA AACTCACATGAACACTATTTGACCTACAC ACTTCATAAAGCTGTTTTTAGAAAGACGA GATAATACAGGAGGAACGCTACAATATT AAATGATATGTATTTATAT | p000639 | D | — |
| 6 | IM000624 | AGTGTTTAGGTCAGCTGGTGCAGGAGAA GCTTCTTGAGGAAGACGACCATCTGGCA AGGCCTGATGGTAGAAAATAATGGACTT CTCTCCAACTGAGTAGGAACTTGATGAT C | p000640 | D | — |
| 7 | IM000625 | ATCAGTAAGTTAATCCTAAGAATTACTAT GCATTTTCCCCTCTTTTTTAACAACATTC CTCCTTAGCTTATATGAGGCTCTAGTGC CCGGAGACTTTAATACTGCCCTAACATG ATGGTGGCTCTTTGTCCCTCTTTCTCAGC CACTGAAATCTGACAGTTTGGGGAAGAA TAATAAGAATTTAAGAAACTAGATGGTTT TAAATATAGATATAAAAACAGTTCTTCGA CTATTCTCAATAAAGAAATTCAGTCAAAA GAATTTCAGTCCTAACACAATGATC | p000641 | D | — |
| 8 | IM000626 | GATCATCAGAGTCCTGCATCTTATGTGT GCAGTGTTTTCAGCAATACAGGCTTACC TTCTTACCTCTAACAGGCAACCAGATGCT ACAATAGCTTATATTGTTTTAGAAATCAC TTGGACTACTCTAAACAACTTGAGTG AAGGCTCTTTGTATCTGATACTGGAGTTT GTTAGTCTATGACACTTGTGGGGAGACA TGTCTGCACAAGTAGCATATGTGTGTAC ATGTATATTGTATACATATATAGTTTTGCT CTATGTATGTATGTGTATATGTATGTATG TATATGTATATGTATGTATATATATAG | p000642 | D | — |
| 9 | IM000627 | AAGGGACCTGATAATCGTGTTGGCAACT GGGCTACAATTAGTTATCAATTGCTTGCT TGCCACCTGCCCTGCTCCATAGAGAATC ATAGTCTGGGGAGTGTGGAGGAATAGC GGAGTCATCTAAACACATCACTGCTGCC CCCACCATTTGCCTGCCACCAGGCCCT GCCTTTCATTTGCATCTCCCTCTTAC AAGCAAATGGCGCTCACTGATC | p000643 | D | — |
| 10 | IM000628 | GTTTGGGGATTGTACAGAATGCACAGCG TAGTATTCAGGAAAAAGGAAACTGGGAA ATTAATGTATAAATTAAAATCAGCTTTTAA TTAGCTTAACACACACATACGAAGGCAA AAATGTAACGTTACTTTGATC | p000644 | K | Myc |
| 11 | IM000629 | GATCTCATTACAGATGGTTGTGAGCTAC CATGTGG | p000647 | R | — |
| 12 | IM000630 | GATCTCAGGAGGCACCGAGAGACTCAG CATGGACTCAAATGAGTACCCTGGCAGC CCGCTACACCAGCTGTGTAACACTACCG TGAGGGATGTCTTCCCTGCCTCCCTCCA | p000649 | K | Gfi1 |

TABLE 1-continued

| SEQ ID NO: | MUTATION | SEQUENCE | CLONE | CLASS. | GENE |
|---|---|---|---|---|---|
| | | GCCCCTTCTCAGGCCCTGAGTCCAGTGT GCAAAGCTCATCATGGTTAGTCCCCTTC ACCT | | | |
| 13 | IM000631 | AGAGCACCCGACTGCTCTTCCGAAGGTC CAGAGTTCAAATCCCAGCAACCACATGG TGGCTCACAACCATCCGTAACAAGATC | p000650 | R | — |
| 14 | IM000632 | GATCAAATCCTGTCAGGGAGAGGGGCTC CTCCCAGTAGTGCCATCCCATAATAATAA GAAGGACTCCTGGGCCTCAGTGAAGTCA GGCTGACCACTACTGCAGGTTAGTCATG ACCAGTAGCCAGAATGGAACGAAGGGT GACCCAGTGTGAGGACACAGCCCCAGG CAACTGCTTCTGCTTTGAGCCAAGTTGTT ACCCCAAAGCTCGTCATTCCGCTTGGTT TCTCATGTGTGTGAGCTGCACATATGGA GGTCCCCCTTTGTTCCCTT | p000651 | D | — |
| 15 | IM000633 | GTGAGGAAGGTCCCTCTGCATTCTAACC TTCCTCAACTCCACCAGCCTCGGCGTTT AAGGGAGAAATATTACCGTTCCCTTTGG GCCAAGTTGGAGCCAGTGAAGTAGTCG GAAATGTACAGTCACAGGAAATTGCTGC TACCAAGGCTGGAGGAACAAAGAGAAGA CTTGTCACAAGAGGCCAGAGAGGAAGTC ACCCAGTACAAACTGAAGCGCGCGCGC ACACACACACACACACACACACACGC ACACACACACACACACGATC | p000652 | D | — |
| 16 | IM000634 | TGGCCGCCTAGACAAGCTGACCATCACC TCCCAGAACCTGCAACTGGAGAGCCTTC GCATGAAGCTTCCGAAATGTGCGTGCTC CACCTGTCCCTCACCTCACAGACATCAT TTCTCCATTTAGCCCCTCCCGATC | p000654 | A | — |
| 17 | IM000635 | GATCCCCTGGAATTTACAGTCGGTTCCA ACAATCATGTAGATG | p000656 | C | — |
| 18 | IM000636 | GATCGGCTATAGCATTTGTCAATGTTTAC CCAGAAGAATAGCACAGATATATTTGCA CATCAATGCTTATTGCAGTATTATTCACA GTGGCTATGTAATGGAACCAACCTACAT GGCCAGCAACTGAATAGATTAAGAAAAT ATATATACACAATGGTGCTTTTTTCGGCT ATAAAGAAGAATGAAGTTATGTTGTTTGT TAGAAGATGGATGAAAGTGGAGATGATA ATATCAAGTGCACAGTCAACCTCTCTCTC TCACCTCCCCCGCCCCGCTCTTTCTCTC TCATATACATTTGAGAGTAGCAGTAAACT GTCTGAGAACAAAGGGGATTAATGGGAG GGGAGAAGATTAAGGAGCGGAAGGGTA GTAGGTAGTAT | p000659 | A | Cr2 |
| 19 | IM000637 | GATCGGCTTCTATGGACTGAGTGTGTAA GAAAACATT | p000661 | D | — |
| 20 | IM000638 | TTAGGAGGGTAGAGAACATTCAGGAATC AAGAACAAGCATTTTAACACCCACTGAG CTATCCTGTGGATGGTGGTGGTTTTGT GTTTGTTGGTTTTGTTTTAGGAAGTCAGG GATGGGGTGGGAATCTCACTCTGTGGCT TAGACTTGCAACAATCCCAAATTCTGGAA TGATAAGCAAGAGAGCTGTCTAGTCCCA GTCTCAGATACATGCTGTTAATTTTCTAC TACTGCTATAACACATAGGCTCAAATGC GGTGGCTTACCTAACACACCCTGTGCAG TTCTGAAAGTCGTAACTCTGGCACGATC | p000662 | D | — |
| 21 | IM000639 | ATGCTAAGCTGTGACTCCTGTCGATACG AGACCCTGGCTGCCCTCCTTTCCCGATC | p000663 | D | — |
| 22 | IM000640 | GATCGTCTGGAAGAGCAGTCAGTATTCT TAACTGCTGAGCCATCTTTGCAGCCCCC AGTTCTTTGGGGTTTTTTGTTTGTTTGTTT GGTTGGTTGGTTGGTTTGGTTTAGTTTG GTTTGGTTCAAGACAGGGTTTCTCTGTG TTGCCCTGGATGTCCTGGAACTCTCTTT GTAGACCAGGGTGGCCTTTAACTCACAG AAATGCGCCTGCTAGGATTAAAGCTGTG TCCCACCACTATATATATATGTGTG | p000665 | R | — |
| 23 | IM000641 | GTCACAGTGTTAGAGCCACAGACGGGG GAACCTACTGGCTGTCCTGGGTTCCTGT AAACTAGGGACAAAGCTGCCACAGCCA GACTTAGCTGCGATC | p000666 | D | — |
| 24 | IM000642 | GATCGCTGCTTCTGTAAATCCGCAACGA CAATTGTTATCTTCTCCTTTTCTTTCTTTT | p000668 | R | — |

TABLE 1-continued

| SEQ ID NO: | MUTATION | SEQUENCE | CLONE | CLASS. | GENE |
|---|---|---|---|---|---|
| | | ATGTTTTATTCTATTTTATTTTTCAGAT GAACTCTCATGTAGCCCAGGCTGGTCTC AAACTCCCTCTGTAGCTGACGGCAACCT TGAAC | | | |
| 25 | IM000643 | TTCCTACACCATAGCATTTAGTTGTAGGC AGAAGCGATC | p000669 | D | — |
| 26 | IM000644 | GATCGGCTCAAGGGCTCTAATTTAGTCT AGGAAGTCCTTAGGAAACATGAAAATCT CCGAGATAAGACCCGGGGTAAAAAGCTT GAGCCACGGAGTTAGACATGCCCAGGG TGGAGTCATGTTCAGAGGTTCAAGACCC GAATCAGCTACGTAAATAAAGCATTTGAG GCCTACCTGGGCTACAAGAGAGTATCTT TAAATAAATAAGATGATTTAAAAAAAACT GTTTTCCCCTTAGATGGATTAAAAAAACA AGACAAAACAAAACAAAACAAAAACCCG TCTTTCCTTCTTAA | p000672 | D | — |
| 27 | IM000645 | CTGTCCGTGTGGGAAACGTTTAGCAAGT CCGAGCGTGTTCGATC | p000673 | K | Nmyc |
| 28 | IM000646 | ATGCGTTCGTATGACAGTTCTCCTAATGA CTGTCCCAAAGTCCCAGATTCCTGGAAA CAGTAAAGACTGCCTCAAACTGTAGTCA CTAGTCTATTATCTTAATCATAGTAACCA TTTGGGTTTGACTTGAAAACCTGTGACA GGGAGATAAATTTCTGCCACTGTAGGTG AAGCTTGGAAGGGCTAACCCAATGAATA TGCTCAGTCGATC | p000676 | C | — |
| 29 | IM000647 | AGATGAAGCTATCCCCAGTCCCTAAGCT GAGTTCTGCCTGAGACTATTTGAAACAG GGTACCCCTGGGTCCCAGTTCAGTTGAC AGGTAGTGGACGCATGAGAACGCCATAC CTGGTGGCCGTGCCCGAGAGTGCTGTC CCTGACCTGCCACTGTGTTCTCCAGAGC AGCTCCAATCTGCCTGCTCCTGTCTC CCCTGCCTGTTGGCACCAGGCAGCCAG AATTCCATTTGTGTTTGCTTCGCGATA GGCTCTTGCCATGTAGTCCTTCCTGGCC TAGAACTTGATATGTAGACTTCCCCCCTT GGATC | p000678 | C | — |
| 30 | IM000648 | CCGTGTCCGTGGGCATGTGCGTGTACA GACAGACATACATGCCCCCGCATGAGTG TGAACACCAGAGGTCAACCTCAGGTGTC CTTTTGATGTTATCTACCTTGTTTTTTGAA GCAAGGTCTAGGATTGACCAATGAGCCC CAAGTAGGGATC | p000679 | D | — |
| 31 | IM000649 | GATCCATAGGCAGAGAAGGCAGTAATAG GACATTGGTCATTGTACCTCATTTGTGAG GGGTCACCTTGGAAATGTGCTGAGACTA GGTTCTAGGAGAAGCTCGCCA | p000682 | D | — |
| 32 | IM000650 | CTGGCACTGTGTGGCAGAAACAGTGAAC AGTGTAGCGGTGCAGAATGTGTGTGCTG TGGGTTTTAGCACCAGGGCTGCATGAGA CTGCAGACATGCTTATGACGCAGGAAGG CTCAGGACACAGCACACATGTGTGCTAA CATACATGTTTCACCTCAGACTCAGCTCC CATTTGACTTTTAATTAATTTTTGGCCATT CCACAACAGAACCTTTTCTTGCTCCCTTT TTTCAATCTTATGTATATATCTCCTACATT TAGTTACAGGACTGTGACCTACAGTTTAA AACTCGGGGATC | p000684 | D | — |
| 33 | IM000651 | GATCCCTCCCCTCCCTTCTTTETCCCGC CAAGCGTCGGCGAAGCCCTGCCCTTCA GGAGGCAGGAGGGGAGCTGAGTGAGGC GAGTCGGACCCAGCAGCTGAGAGCAGC GCAGCCCAGGGGTCCTCGGCCGCGCAG ACCCCCGGAATAA | p000685 | K | Myc |
| 34 | IM000652 | CTACCACAGCCCCAGTGCTCTGGAGGG ACTCTAGTAGCCAGGGCTGGCAGCTTGG TTTGGGCCAGCATCTCACTATGTAGCCT AGTTGTCCTGGAATTTGCTATGTAAATGT GGCTACCCTCAAACTCATAGAGAGCCTC CCACCTCTCCTGAGATTATAGGCACATG CTACCATGCCCTAAGTGGATC | p000686 | D | — |
| 35 | IM000653 | GGAGCAGGCCCTTCTGAATCAACTTGGC AGAGTGAAGGAGGCACTCTCCACACAAA CAGGAAAAGGGCAGTGGTGACTTTCTAG GCAGGGAACTGGTTACATTTTGTTTATTT | p000687 | D | — |

TABLE 1-continued

| SEQ ID NO: | MUTATION | SEQUENCE | CLONE | CLASS. | GENE |
|---|---|---|---|---|---|
| | | GAAGGTGAAGAGTCGTGACATTCTGGGA AATAGGCAAGATGGCCGTTTCCCCTCAG CTACAACCAGCCATGCAGACCTCCTTGC AGGGACCTGGCTATCTACACTGGAACCA GAAAGGCACGCCCTGCTTTAGCCTCAGG CAGAACGATAATAACAGCGTGCTAGCTC GTAGTCTGTGTGCTGGAAGGGTTTATG AGGAGGAAGTCCGCTATTACATATTTCT GGGCAAACATTAACCAAGATTGAAACCT AGATTTGAAGAGAAGTAGCAGGCTGGGA TC | | | |
| 36 | IM000654 | AGATGAACTTATAAATGCATCTGCAGTCC TCTAATAAAGATGAATAGTAACCCAGAG GCGTGGTAGTGCGCTCTTCAAACCCAGT GCTCAGAAGGTGCAAACAAAAGGACCG GGAGTCCAAGGCTAGCCTTGACTAGAAG GGGCCATGTCTCAAAGAACAACAACCAA GAGCTGCTTATGGAGGTCAGTCTGTGTT CCCAGGGGACAGCATCAGTCTAAGTTG GCGGTTGTTGTTGGCTGAGCATGCACAA ATCCCTAACAGCACATAAAGCAAGTTGT GTCACACACTCACAGTGCCCAGATTCAC TGGATC | p000688 | B | Mm.1313 36 |
| 37 | IM000655 | GTCCATTGTGTACTGAGAGAGGAGTTAG GTTTAGAAAGCCTTCCTCAGATGTCCCT CAAAGAAGCTGCTACAACTGCCCTCATC CCACGTTGCCAAGGATC | p000689 | D | — |
| 38 | IM000656 | AGCTGTAGGGAAGCCCAAAGCACAGAC GACTGCTGCTGCTGCTGCGGTTCCCACT CTGGGTTGACCTTAGAAACGGGGGTTCA TCTCCTCCAGCAGCTCCGGGAAGGAAG GTGAAGGGGACTAACCATGATGAGCTTT GCACACTGGACTCAGGGCCTGAGAAGG GGCTGGAGGGAGGCAGGGAAGACATCC CTCACGGTAGTGTTACACAGCTGGCGTT GCGGGCTGCCAGGGTACTCATTTGAGTC CATGCTGAGTCTCTCGGTGCCTCCTGAG ATC | p000694 | K | Gfi1 |
| 39 | IM000657 | GATCGCCCCAGTTACCTCAAATTGTGTG AGTGTGTGTGTGTGTGTATGCATATAT GCATACAAGCATATACATGCATGCATATA TATAATACACATAGACATATATACACACA TATAGACGCATACATGCATTTGTATGCAT GCATCTATGTATGTACATATCCACAACCA AATATACCAAACACGCAGACACAGCACA CATAGGACAATAGTAATTGTGAATCTAAC TGGTGGGGTTTATGGGTCAAGAGCCAG GGTAGAGGAAACTGGCTAAGGCTCTAAC CATCCTAGAGCAGGCACATCTACCAGGA AAAGAAACAAGGAAAAGAGCAGAGTTGA GGGTTACTTAACATG | p000695 | D | — |
| 40 | IM000658 | ACAGAATCTGTGGGTCATTATTACGTTTA TAGGAACAGGATTTTCTTTCCTTTCTGAC TCTACCTTCTAGAAAGGCCGACTTTTAAA TCCTCATGCTCTTGTCTATTGACAGGAAA AGATGGGCTTCCACACTGATC | p000700 | D | — |
| 41 | IM000659 | GATCAGGCTGGCCTTGAACTCACAGAGA CCCACCTGCCTCTGCCTCCTGCATGGTG GGATTAAAGGTGTGTGCCACCACTGCCC AGCTCACAAAGTAGTAGTAGGACTAGTA CTAGTACTAATTATAACAAACATTACAAC AATCTTAATTATTTTTGTTTCTACCTAA AATCTCCCAACTGTCTTTTTATATTGCCT CAAGTCTTCCCTCAGTCCTGGCCTTCA TAGCTTGACTTTTTGCTAGAGGTTATCA GTGGCTCATCTCTCCTGAGATTGAGC TGGCTAAGACCACTATTCAGAGGGAGAA TGTAATGTCTCAGACATCATAGCCAGTC CTCAGTTCTCCTTTTGCTGACTGACCACT TTGCCAAACTAGTTTTCCTAAGCCATACC TTTTCTTTTTAAAAAATAGTCTTTCTTATA GTGGGTGCTGGCTTTGAACTTCTGTCCT CTTGCCTCACCTTGCACTGGTAGTAGAG GCTTGCAATTTCACCG | p000702 | C | — |
| 42 | IM000660 | GATCAAGAACGAAACCCCTGAAAACATA AAACAGTAAGATAACAATAGCGTGCCTG ATTTTGTCCAAACCTTCTTGTCACCTGTC | p000703 | D | — |

TABLE 1-continued

| SEQ ID NO: | MUTATION | SEQUENCE | CLONE | CLASS. | GENE |
|---|---|---|---|---|---|
| | | ACTGAGATTGTCAACTCCTTTTCACCACC CTACATACGTTAGTTAGCTCAGTTTACGA GAGTTTGCAAAGGCCCCCACCAGTACCC TGCAACTTTACCCACCCCTGCATGGGAC TGTGAGAAAATGGGACTGGAGAGTAACC CTCTTCAGGCTCACAATCTGAGCTAGTC AGAGCATCTCACGGGTCCCGGGACTTTC AGTGTGCTCCTCTTGGGTATTGGACTT TAAACAATGTGTACCGATATGGGTGAATA ATACAACATCCATGGAGAAATAAGCCAA ATCAAGACACTTCTTCAGAGG | | | |
| 43 | IM000661 | GATCAAAAACATCAACGTAAGGAGCCCT TAATGACGCTTTGTGACGGTTTAGAATG GTCTACCCAAACCTAGCCAAGTCTAACT ATGTTATGGAGGTGGTAAAAGCAGTTAA CCTAAACATCTGGGACACTCACAGAATG TAGGTAGGTAGGTAGATAGATAGATAG ATAGATAGATAGATAGATAGACAGACAG ACAGACAGATGTTAATAAAAAGTGACG TTTACAGTGATGTTAGCTCAAGGCAGGG CTTTTCAGGCCATTTCCCCTGGTCTCAC CC | p000704 | D | — |
| 44 | IM000662 | CTACTAAGTCCAGAGCAGAGAAGGAGGC GCCGCCTGTGTGCACAGCGGAGTCTGG GAGAGACCACCGGCCCAAACCAGTAAAC ACAGGGCACCCACCGTGCTCCGATC | p000706 | D | — |
| 45 | IM000663 | ACAGTAATCTGATTATCTTGGAGTAGATA ATTTGTCTACCTGTTAATGACTCTGCTTC TTGAACTACGTCCCAGTAGATGCCATGC TCAGCCTGGTAAGTGACACTAATACTA CCTCCAAACTGTCACTTGGATTGTCAGG GTTTTGGTGTGGTGATGATACAGGAGAA ATGTAAAACACGGAGTTGATGATAGAAA GGAGTCACTAATACATTTTCTTAGGAAAA GTCAAGTGACACACAGCAGAATCTAGCT GAAGGAGCTCCGCCAATAGGGCTGGAA GATAACTCTCGCACTAACCTGCTTTATTA GGAACTGTAGGAAAGGCAGGTCTGCAG CACAGTTGAAGTTTAGGTTGCTGAGAAA GTTTCTGCTCATATTTATTCACCAGTGAT GATC | p000708 | D | — |
| 46 | IM000664 | GTTTAGCAAGTCCGAGCGTGTTCGATC | p000709 | K | Nmyc |
| 47 | IM000665 | AGGCAAACCCATGTGAGGCCTTCTCACA TCTTTCCTTGGATGCCTGCACACACCTG ACTTGACAGACTTCAAATCAGACTTATCA ACTCACCTCTTCAGTCCTGGGCCTCTTC CTGTATTTCAATCTTAGATAGAAAATTGG TTCCACTGTCTACCAGCCTTGAACCAGG AATGCAGAGCCAACCACCCCTGGGGTGT CCCAGGCAGCTGGGCTGGATGCTACCT GTCATGCTCTTGATC | p000710 | C | — |
| 48 | IM000666 | ATGTATGAGTGTGGGGCTGGGTTTGAAC CTGTGTCACCTTAGGACTCTCTGAACCT CGGTTTCCTATTAGACGGAGGGGCTATT CGGAGTCCTCATCTAATGGAGACACTTT GTGGGTATCAGAGGGCAACACTGTGGTA TTGGGGGTGGGGGGTTGCTGCTTAGAG CTCAGAGAAGAGGAGTTTGGCTTGCTCT ACAGAACATGCAGGCTGAGGTGTGGGT GCAGGGTTTCCCTGAGGCCCCGGCTCT GACCCTCTCCCCACTCCATTTCCTGCGC AGGTGAGCGACAAACGTTCCAACAGCTT CCGCCAGGCCATCCTTCAGGGAAACCG CAGGCTGAGCAGCAAGGCCCTGCTGGA GGAGAAGGGGCTGAGCCTCTCTCAGCG GCTCATCCGCCACGTGGCCTACGAGACT CTGCCCCGGGAGATTGACCGCAAGTGG TACTATGACAGCTACACCTGCTGCCTCC GCCCGGTTCATGATC | p000711 | C | — |
| 49 | IM000667 | GATCATTTTTCTCTCGAGATGGATTAAAG CTATGCTGCAGAAGGACCCGTGTGTGTC CTGTGTGTGTGTGTCCTCGCCGGCGAGA CTCCTTATCACACATGACAGCTTCAAAGC CCCCAGATTCAATAGGTTCCAGGAGTTC ACATTTAACACTCATGGGGTCAAAGTGC AGGCAGATGGTGGAGCCTGTGGAAGGT | p000712 | R | — |

TABLE 1-continued

| SEQ ID NO: | MUTATION | SEQUENCE | CLONE | CLASS. | GENE |
|---|---|---|---|---|---|
| | | CATCAGACAAACAACCTGGTGGTTGCAG CAGAAATCACCAGGCAAGTAG | | | |
| 50 | IM000668 | GATCTGGCTAGCAGGGAGCCATTTACAG CTCAGACATCTATCATCCTTA | p000713 | D | — |
| 51 | IM000669 | GATCATTGTACCTCACCTGTCAGTTTGAC AGGTGGGAGGTGATATCTCTTTTCATTCA TGTATTCTTTGAAAGTTTGTTCATGCATA TAATACATTCTGGTTCAATTCACCACTCC ACCCTTTTGTATCCCCTGCGTACCGAGC CCCCATTTTCTCACCAAGTCTTACTGTTA TCTCAGTTTTGGGGCTTAGTTTTTTGTTT GTCTTGTTTTGTTGTTTTTGAAACAGGGT CCCGTTATGCAGCCCTGGCCCTGAACTT GCTAAATAAACCAGGTTGGCTTTGAATTC AGAGTTCTGCACACCTCTGTTACCCAAG TGCTCAGATTAAAGGCGTATACTACCAC | p000714 | C | — |
| 52 | IM000670 | GATCAATTCAATCTATTGCAATAACCTGG TTTTTTTTTTCCGCAACTCCTAGATGGGG GGGGGGGGGCCCAGTCAGGAGAGGTTT CAACACAAACGCACTAGTATTTACACACA GAATCTCCTCCACTGTTCTTCTTCTTTGC TTTAAAAGTCTTTGTTCCGGAATCTATAG ATAGGGAGACAGATGGCTAGCTCCCCAA GGCTGAGAGCAGAGGAGAGTATAAACA GGGAAGTCTAGGGGTCTGGGAGGGCTA GGTAAGGAAGCCACAG | p000715 | D | — |
| 53 | IM000671 | CAATGCCTTCCCCGCGAGATGGAGTGG CTGTTTATCCCTAAGTGGCTCTCCAAGTA TACGTGGCAGTGAGTTGCCGAGCAATTT TAATAAAATTCCAGACATCGTTTTCCTG CATAGACCTCATCTGCGGTTGATC | p000716 | K | Myc |
| 54 | IM000672 | TAGTATTCAGGAAAAAGGAAACTGGGAA ATTAATGTATAAATTAAAATCAGCTTTTAA TTAGCTTAACACACACATACGAAGGCAA AAATGTAACGTTACTTTGATC | p000718 | K | Myc |
| 55 | IM000673 | GATCAGAAAAACAGCCCATTATTCAAGAT TCAGGT | p000719 | D | — |
| 56 | IM000674 | TAACTTCAATTTAATAATTATCACATGCTA GGAACTAAAGAGGTGCACAAAACAAACC AACAGTGGTTCCTATCCTGTCTAACAGAA GAAACTACAATTGTGGTTTGGGATGCCA CATAAATGACAGCAACGGGACCTACAGA AAATTAAGTCACAGAGAGTATGGACCAT TTCTGCAGAGACCTGGAAAACAGACAAG GGAAGAAACATGGTGTGTCTAAGTGATG GGGCAGGTGGTGCAAACGCTAGAGGCA AGCAGAGGGGATATGAAACTGTGCTGCA CAGCTGGACAGAAGGGAGGCTGGAAGG GAAGAGAGGACCCTCTGTTTTGACTCAA TGGCTAGATGCCATGTGCCAAATAAGAA AGCACTTGGGGGGTTCTGTGGGAAATCG GAACAGAGGGACTGGAATCAAACCTCAA CGTTCCTTGCATACTCCAGATAAGAACC AGGCTTTGAGCCAGGGCCTGGGAAGAG GGCTGGCCTACATATCTCATTTTAGAGAT GAGCAAACAGGACTGGGAGCTCTAGGT CTTCAGTGACACGCTTGCTTGGCCCGCA GGGAGACCCTGGGTTTGATC | p000720 | D | — |
| 57 | IM000675 | GATCATGTCATGGGTCAACAGAAATAATT CTGAAAGGCTAAGTCATTTCTTCTACCCC CAAGAAAAATCAAGAACACCCCACATTA CAAACCTTCCGTAGTAAACTGAGAATGG AGCCATGGCCAGAGCCCCTCTGCTCTCC CATCCCCCAACCAAGAACCAAAC | p000721 | D | — |
| 58 | IM000676 | ATATAACTTCTTTTTTTTTAAAAAAGAATT ATTTATTTTATGTATATAAGTTCCTTATAG CTGTATTCAGAGACGCCAGAAGAGAGCA TCTGATC | p000722 | R | — |
| 59 | IM000677 | GATCATAGCACACTGGGGTGCCATCTGT CACCCCTAGACAAACATCTTTAACCNGC ATCTCTTCCTGAAGCCCACTTGGACCAC CCTTTGGAAAACCATCACCAAGGCAGT AAGGTACCCGTGGTGACTCACCTCAGCC AGCCCACCATAGACGCTTAGCAGAGCA GGTGTGTGTTAGTCAGAGCCAGACAATC AGAACACTCTCCCTGCTCCAAAGTAGCA ATGTAAAAAATTGAACCCAAAGTTG | p000724 | D | — |

TABLE 1-continued

| SEQ ID NO: | MUTATION | SEQUENCE | CLONE | CLASS. | GENE |
|---|---|---|---|---|---|
| 60 | IM000678 | GATCAAAGTAACGTTACATTTTTGCCTTCGTATGTGTGTGCTAAGCTAATTAAAAGCTGATTTTAATTTATACATTAATTTCCCAGTTTCCTTTTTCCTGAATACTACGCTGTGCATTCTGTACAATCCCCAAACGTATACATACACACTTTATATATACACGATAATCTAGCTTATTAACCAACCAGAAACATGAGTCTTTTGCTCTGTGCATTGGTTCTAGATTTATTATATAATGCATATTCCCTCGGGATGCTTATCC | p000727 | K | Myc |
| 61 | IM000679 | GATCATTTGATGCTTCAGATAAATATGTAAATGGTGAC | p000728 | B | Mm.127881 |
| 62 | IM000680 | GATCAAGATAATCCCCCACAGGCATGCCCAGAGGCCCATTTCCTAGGTGAGACTATAGTCTGTCAAGTTGACAATGCTAACCATTGCAGTGAGGGAGAGAAAGAAGGCCAGGATGGTGCCTCTCTGTTACTCTGCTTACCCCGGGGTGCAAGGACAGTGGGGGATGGGCCTGAGCTTCCTCATGAACACACACATGAGAGCAGTCAGCACATGGCCTCTTCCTCTAAGCTTCACAGTGGCAGCCGCACCTCTGCTGTTAAGACCTAACATGTGGCCGGGCAGTGGTGGCACACGCCTTTAATCCCAGCACTCGGGAGGCAGAGGCAGGTGGATTTCTGAGTTCGAGGCCAGCCTGGTCTCCAGAGTGAGTTCCAGGACAGCCAGGGCTACACAGAGAAACCCTGTCTTGAAAAACCAAAACCAAACCAACCAACCAACCAAACAAACCATCTAACATGTACATCCTATCCATGTGCACGAATCATAC | p000729 | R | — |
| 63 | IM000681 | AGACCAGTGCCGGAGCCGTTCCTGGCTGAGGCAGCCCAAGTCCTTGAAGAGCTTGAAGAGGTCGCTGCGGAACTTGACGCCGATGAAGGCATACTAGAAAGGGTTGACGCAGCAGCGGACGGAGGCCAGGCTGTAGGTGACGTCATAGGCAATGTTGAGCTGCTTGCTGGTTTCGCAGCTGCTATTGGTGATGTTGAAGTTGGCCACCGTCTGAGCCAGGACCACCCCATTGTAGGGCAGCTGGAAGACTATGAAGACTACCACCACGGCAATGATC | p000730 | A | Cmkbr7 |
| 64 | IM000682 | CCCTCTCAAGCCTTCCTTGTTACTTAGCCTCTATAGGTCTGTGCATTATACCATCATTCTTTTAATACAGCTAATATCCATATATATGATTATGTACCATATTTGCCTTTTGGGGTCTGGATTGCCCTACTCAGGATGACCTTTTCTAGTTTGATC | p000731 | D | — |
| 65 | IM000683 | GATCATGATGTTTGTTGAAGCAACAGAAACTATAAGACAGTGCCCAAGAGCCTCTCTGGAGATAGCC | p000732 | D | — |
| 66 | IM000684 | GATCGTGTTAGACACAAGTAAGAAATGAATGAGTCTTCCTGATTTTTAAATTAACTTCTCCCCATATTGGCTGTCACTACTTTTATCAGAAAGGAGAATCTGGACGGTTCCAGGCCTGCAGCGCCATGCTTGCAAAAGGTTTACAGAATCGCTCTGGACAACT | p000734 | D | — |
| 67 | IM000685 | CTACCACAGCATCTTTTGAGTGTATATAGTCAGTGTGCTACATGTTATCTATGAACATATGCAAATGAGGTTTGAGAATTAAAGTTGCTGATAGACTCATGGGTTAGGGGTTTGATTGCCTGCTAATGATC | p000735 | D | — |
| 68 | IM000686 | GATCACGAAACGGTTGACTAAAGCAAGACTGAACCACAGGCAGATACCAAACCCAAAGCTCTATGTCTAGTGTCTAGAATACATAGGTTTGGGTAGCCATGCCCCTGTGACCCTGCCACCTGCAGCACACATAAGACAATACTATAGACAACCACTTCTGAGTCAGAATTGCAATGATGTCTTTGGCAAACTACTCTAGTCTCCTTTGGCCAGGAGCTGCTAAGTGGTTCAGGCTGAGGTACAATCAACCTAGGTAGGTGGGACTGTGTGCCCCTGTGCTCCTGGGTGGCCTCATGTCTGCTATGCTTGCCCTTT | p000736 | D | — |
| 69 | IM000687 | GATCATGTCAACTATACCTGGACACGGACCTTCATCCTTGCTGGTTTCACTACCTCTGGCACCCTGCAAGATCTTGCAGTTTTTGGAACCCTGTGCATCTATCTCCTCACACTGGCAGGGAACTTGTTCATCATTGTCTTG | p000737 | C | — |

TABLE 1-continued

| SEQ ID NO: | MUTATION | SEQUENCE | CLONE | CLASS. | GENE |
|---|---|---|---|---|---|
| | | GTCCAGGCAGATTCAGGGCTGTCCACTC CCATGTACTTCTTTATCAGTGTCCTCTCC TTCCTGGAACTCTGGTATGTCAGCACCA CAGTGCCCACCTTGCTGCATACCTTGCT CCATGGGCCTTCACCCATCCCCTCGTCT GCATGCTTTGTCCAGCTGTATGTCTTCCA CTCCTTGGGCATGACCGAGTGCTACCTG CTAGGTGTCATGGCTCTGGACCGCTACC TTGCTATCTGTCGTCCACTGCACTACCAT GCACTCATGAGCAGACAGGTACAGAAAC AGTTAGTTGGGGTTACATGGTTGGCTGG TTTTTCAGCTGCCTGGTGCCTGCAGGTC TCACTGCCTCTTTAGCTTATTGTTTGAAA GAAGTGGCCCATTACTT | | | |
| 70 | IM000688 | CTGTCAATTCATCCAGCTCTAGGCCGCT GTCTGGCTCGATGCTTATTGGTTTAACA GTGCCGATGCATAGGATTCTACAGTCAG AGTGGCCTAAGCAACAGCTAAATATTGTT TTCTTGCTGTTCTGGGAACTAGATGTTCA AGGTCAAGGCGTCAGTAGCTCTGTTATG AGACCTCTCTGCTGTCGGGCTGTGTCTT CAAGTTTTTTCCCCCCTCTGTGCATGTGT GTTCCTATTTCCTCTGCATGAAAGACCAG TAGAGCCAAGTGGTGGCACACACCTTTG ATC | p000738 | D | — |
| 71 | IM000689 | GATCATGAGAGGCGAGAAACCCAGACAT CTCTAACTCTTCTTGCCAACTCAGGAGC CACCTGTGGCCCCAGCTGGCCACCAGC CGTTCCTCCCTCAGAGGCCTCCATTTCC ACAAAAGGCCTTCCTGGTTGTTCAGGAC AGAGCCTGGTTTCCCTGATACCCCTTCT CTCAGTGGCCACTGAAGTTACAGGGATG CAGCCAGCCGTGGTTGCCATGTCTGTAT ATGCTAATCTCCGAATTCCACTTCCTGTT TAGATTCTCAG | p000739 | D | — |
| 72 | IM000690 | GTTTGTCCGCATGAGTCCCAGGGACCAC TCAGAGTGGCTGGCAGGCATTGTGGAGT GGAATGTGGGAAGACACATTCCCAGCCT TGTTTGCAGCTTGGGACTGTCTGTGTTTT GGGATGATC | p000740 | D | — |
| 73 | IM000691 | GATCACCTGGGAAGGGGGAAAAGGACA AGTCTGAGCTCCCAGCCCACATTCTCCT AGGGTAGCAGCTCCCTCACTTAGTGT | p000741 | D | — |
| 74 | IM000692 | GATCAGTTCTTATTAAACAATACAGACTT AGGCAAAATGAGTCAGAAATAAGGATAT CGCATATCCCGAGACCATGAACTCTA AGAAGTATTTTCTATTATTAAAGTAGTTCA CCAGGCAGTGGTGGCACACACCTTTAAT CCCAGCACTCGGGAGGCAGAGGCAGGT GGATTTCTCAGTTTGAGGCCAGCCTGGT CTACAGAGTGAGTTCCAGGACAGCCAGG GCTACACAGAGAAACCCTGTCTGGACAA ACCAAAAAAAAAAAAAAAAAAAAG | p000744 | R | — |
| 75 | IM000693 | GATCATCACAGATGACATAGAACCAAAC TGTAACTTTCTAGACTACATGTAGCAGAC | p000745 | D | — |
| 76 | IM000694 | GATCATACATGAATACAAGCAGGCTTCT GGTATACTCTTAAGTTGAATTCTGTTTTC TGTAGTCGTAGTCTTGTCTTTTCCAGTTT TAAATTCTAGAACAGGTATACTGTAGAGC ACCCGCCTCCCCTTGCTCTGGAGGTAGG GTAGAGTGGGAGTTAAGGTCAGTTCC | p000746 | B | AA65702 8 |
| 77 | IM000695 | ATTTCTCTTGTAAAACTCACTTTCTGTTCA CCCATTTTGTCTGTGTCCTTACTAAATTA TTTCTATATAGGAATCTTTGTATCTTCTGA TATAAGCTAGCGCATGGGTACCACCAGC ACCCTAGTCATCTGCTGAGGTGCTTCTA ACCTTGCTTGATTCAGTGTCTTCAACAGA AGGTGGAGTAAACAGGTCATTTTTTACC CTAGAGAGTTCAGATC | p000748 | D | — |
| 78 | IM000696 | GATCTCCGGGTGCCAGACTTGCCCAGCA AGCACTCTTACCTGCTGAGCCATCCTGA GGGCCTGGATTTAAAAAAAAAAAATATTG ACATATTGTTC | p000749 | D | — |
| 79 | IM000697 | GATCTCCTAAAACTCCCTGTGTCAGGAA ACTTTCTGTGCTTTTGTATTGCGTTCCTG TGTTCGTGGAAGGCCCCCACGCCTTCAT CCTTGCTAATTCTTTTTGGATAGCTTGTT | p000752 | D | — |

TABLE 1-continued

| SEQ ID NO: | MUTATION | SEQUENCE | CLONE | CLASS. | GENE |
|---|---|---|---|---|---|
| | | GCTTTAACTAGATTGGCCCTTTCTTGGCT GTATTTTCTGCTGTACCTATGAGTGGTG TGGGAGAACTGTGCAGACTTCCAGGAAG CGCAGCCATGAAGCTACATGTGCCTATG TGTAGACACATCATGGATTTTCTTACTAG TTTACTAGTGGGTGATAATCTGTCCTTTT GAGCTCTCCAGAACGTTCTAGAAGCTTA AGGAGAGAAATCACTTAAGAGAG | | | |
| 80 | IM000698 | ATCTGATAGTAAGTAAAAGGACAGCTAAA GATGAAGGGAAAGCAGGAGAGTCCTGG AAGAAGAAACTAGTGTTTCTAAGAGTTCA TCATTGATAAAATGCAAAAGAAGTCAATT ACATACATGTTTAGGAAACTGAATCCTCT TGTTTTGGGGGATGTTTGTTTTGAGGCA AAGGCTCTCTTACAGAGCCCTGGCTGTT CTGGAGTTCTGTATATCAGGCTCTGGCC TCAAACTCAAGAGATC | p000753 | D | — |
| 81 | IM000699 | ACATCAAGAGGAAGTTGGAAATGTCATC TTTAGCTATCTTATATCCTGGTAGCTTTA AGATTTCCTTTGTGTGACTTTATAGTTCT CAAAATATTTTTAAGGGTCAGGGGAGGA AGCACTTTCAAGAAATGAGATGGGAGAG GGAATGTCTTTGTGTTGGCCTGGAGATC | p000755 | D | — |
| 82 | IM000700 | AGCTATACCTGAAATTTGGCCAAGAACA GAAGCTCAGSAAATAGTGTGATTTAAAAA CCAAAACCAATTTACAAAAGGAAGACTGT GGTGTAGATC | p000756 | D | — |
| 83 | IM000701 | CCACAACTGAAAGCAACACACACAGTAT TTTTCTGTGGGTTTTAGGATGTATCCACA CTCCCGAACTTCCTTTCCCTGAAGCACC CCTCAGTTTACTCTGAAGCATGGTTTGA GTCCCAAGGCCAGTGTCAACTTTCTGCC AAGTCTCAATGGCAAAGTCTGTTTTAAT CTGCTCAGGCTAATGTAGATC | p000757 | D | — |
| 84 | IM000702 | CTTCCAGTCTTTTTAGCTATTTATTGATAT GAATTCCCTGCCTTATGTATCATCCAAGA TTCTACCTAAAATACTTCCAATAAGTATC AAGGACCACTCAAATATTCACTATTGGAC TTAGAAGCTCCACTCTTAAAAATAGATTC TATAGAAAGAGCCTGAAATGGGGCATG AAATGGGTCCATCTCCACCATCACGCAC ACATGAACAAAGAAAAGGAGGAAATGGT GTTAAGAAAACTTACATCATACTATTTAA AAATAAGGAGGAAGGAGGGAGGGAGAG AAAGAGAGAAAGCTCAATGCTTAGGCAA GAGTGCTTAAGAAAATTACAGTTAACAGA TC | p000758 | D | — |
| 85 | IM000703 | GATCTCCTAAAACTCCCTGTGTCAGGAA ACTTTCTGTGCTTTTGTATTGCGTTCCTG TGTTCGTGGAAGGCCCCCACGCCTTCAT CCTTGCTAATTCTTTTTGGATAGCTTGTT GCTTTAACTAGATTGGCCCTTTCTTGGCT AGTATTTTCTGCTGTACCTATGAGTGGTG TGGGAGAACTGTGCAGACTTCCAGGAAG CGCAGCCATGAAGCTACATGTGCCTATG T | p000759 | D | — |
| 86 | IM000704 | GATCTGAGTGCTGGGAACCAAACCTGGG TCCTCTGCAACAGTTTGTGCTCTTAGCTG CCGAGCTTT | p000760 | R | — |
| 87 | IM000705 | GTACGGCGATGGGCACAGGCTTCGGGA CAGTCCGCGCGACGCTCAGGCGGACAA CGGGAGGCGGGCGGGAAGGCAGGGG CTGCAGTGTCAAGTCCCTGACCCGGGA GGCTCGGAAACTTCACTGCCTCTGCGCA TCCGGCATGGCCCCTCCCACTCGGACTT CGTCAAAAAACCGCCACCGTGGAGTGTC CCAGTATGTGCGGTGTGGGACAAACTAT CGCACTGTTGCCCTGGCTCTTCTCCTAG ACCCCCTTTGTGAGCCAAAAGAGAAACG CTGGGCAGATC | p000761 | B | Mm.2739 3 |
| 88 | IM000706 | GATCTCGTTACGGATGGTTGTGAGCCAC CATGTGGTTGCTGGGATAA | p000762 | R | — |
| 89 | IM000707 | CTGGGTTGACCTTAGAAACGGGAGTTCA TCCTCCTCCAGCAGCTCCGGGAAGGAAG GTGAAGGGGACTAACCATGATGAGCTTT GCACACTGGACTCAGGGCCTGAGAAGG GGCTGGAGGGAGGCAGGGAAGACATCC | p000763 | K | Gfi1 |

TABLE 1-continued

| SEQ ID NO: | MUTATION | SEQUENCE | CLONE | CLASS. | GENE |
|---|---|---|---|---|---|
| | | CTCACGGTAGTGTTACACAGCTGGTGTT<br>GCGGGCTGCCAGGGTACTCATTGAGTC<br>CATGCTGAGTCTCTCGGTGCCTCCTGAG<br>ATC | | | |
| 90 | IM000708 | GATCTCAGGAGGCACCGAGAGACTCAG<br>CATGGACTCAAATGAGTACCCTGGCAGC<br>CCGCTACACCAGCTGCGTAACACTACCG<br>TGAGGGATGTCTTCCCTGCCTCCCTCCA<br>GCCCCTTCTCAGGCCCTGAGTCCAGTGT<br>GCAAAGCTCATCATGGTTAGTCCCCTTC<br>ACCTTCCTTCCCGGAGCTGCTGGAGGAG<br>ATGAACTGCCGTTTCTAAGGTCAACCCA<br>GAGTGGGAACCGCAGCAGCAGCAGCAG<br>TCGTCTGTGCTTTGGGCTTCCCTA | p000764 | K | Gfi1 |
| 91 | IM000709 | GGAAGAAGTGTGTGCAGGCCATGGTCAA<br>GTCCTGCATGGCTCCCATCTGGGTCCAG<br>CAGCACCCAGCCTCCAGTGCTTGCTCCT<br>GATGTCCCAGTGAACTCAGGTCCTGAGC<br>AGCAAATCCCAGGGGCCAGTCCTAGGG<br>AGAAAAAGAACACACTGCCATCTCAGTG<br>CCTCAACAGAAGCAAACCTAGGCGTCAG<br>GTCATGTCCTTGTTACCCACATCACACCT<br>AGACTTCCCTGGGTATCATGCTCTGTGT<br>GAGATC | p000765 | B | Mm.1535<br>12 |
| 92 | IM000710 | GATCTAAGGATATATCATTCCTAGGAGAA<br>AATGAATATATGACCTTGGATGTCA<br>ATGTTTTTTTAAATATGGCATTAAGCCAC<br>AGAGATAAAAATAAGAAAATAGATACATC<br>GAATTTCAGTAAAATGAGGAAGTTCTTGT<br>GATTCAACAGAAAC | p000766 | A | Mtm1 |
| 93 | IM000711 | GAGGTAAGTCTGTTCAGTGTAGCTATCC<br>TTAGCAGCTAACAGTCCTCAAAACTTTTT<br>AGAGATC | p000767 | D | — |
| 94 | IM000712 | CTACAGATGCATTATTAATATTACTTTTTA<br>AAAAAACCCAGTATACTGCTTGAAAACAG<br>TGAATGCAATGGGTTCTCATTCACCTTCC<br>TGCTCTCAATCAATCTCCATCTCTAAAGC<br>AAGAAGTGGGGGCCCTTCTGGCTGAGC<br>GAGGGGTGAAGGGAGGGGAAGAGATG | p000768 | D | — |
| 95 | IM000713 | GATCTGGAGAAGATGTCAAGTTTTAAAAT<br>GAGGCAG | p000769 | D | — |
| 96 | IM000714 | GAGTGAAGCAAGAATTTGGAGCCCAGCT<br>GCCGCAGCCTTTTTCCTTTCAGCAAAGC<br>TCGGAGTGATAGATATGCATGAACCAA<br>AGCAAAGGCTTGAGAGTGCCACTTGGCC<br>CTGCCTCCTGAGGGTCTCAGGGCATCAG<br>CTGGAGACCACCCTGTGACCCACACATC<br>ACCGACTATGAAAACAGCTCATCAGAGT<br>AATAAAGATC | p000770 | D | — |
| 97 | IM000715 | CAATGAACAGGACACATGCTTCACACGA<br>CAGTCCAAAAATGCAAAGTGTGGAAGAA<br>TTCCACAGCCATAGCCTTCATTACTAGAT<br>C | p000771 | D | — |
| 98 | IM000716 | ATGCCTTCCTGGTAGAAGAGGGCCATGC<br>TGTGGCGGGAGGGGCCACTCAATTTTT<br>CCTGCTCCCTTTCCCTGTCCCATATTCTC<br>AGGAGCTTCTAGAAGCGTAGCCTGCATC<br>TCATGCCCTGACTTGGCACCAAATGCTT<br>GCTTTGTATCAACACCGCTTTCTCTTCTG<br>CTCTTTCCAGCTCGCAGCCATTCAAATAA<br>TACCACCCGGTACCCGTGGAATCAGGAG<br>CAGAGATTCCAAATTGAGTCCTAAAATCA<br>AATCCAAATGGGCCCGTCAGCTAGATC | p000773 | D | — |
| 99 | IM000717 | AGGCGAGCGGATTACTAAGGACTGAAAG<br>ACTCCTAAGACTTGTCTCCTGCTCCCTG<br>GCCAGCGGTGGAGCTCAAGCAGAATTG<br>CAAGCTCAGCTCAGGTCTCAGTGATGCA<br>AAGCACCCTCGTTACTCCAATGTGTGTTA<br>CTCCTACAGGTGGGCTGCCTTCCACTTT<br>CAAACACCCGCACAAACAGACCTCCCAC<br>CGTATGCCAGAGCATCTGTTCGATGCTT<br>TCTGGAAACTATGCAAGCCCAAATTTAAT<br>ATCCAATCAGATC | p000774 | D | — |
| 100 | IM000718 | GTGTGTGTGTGTGTGTGTGTGTGTGTGT<br>GTGTGTTACAAGGTCTCATACAGAATCC<br>AGGCTGGTCTCAAACTACTGGAGTCAAG<br>CCATCTTCTCACCTGGCTTAGCTGGGGT | p000776 | R | — |

TABLE 1-continued

| SEQ ID NO: | MUTATION | SEQUENCE | CLONE | CLASS. | GENE |
|---|---|---|---|---|---|
| | | CACAGACTTGTGCCATCATGCCCAATGG AATGCTGTTCCTTTTGGAAAGCCTGCTAC TGTCATATACTGTCATAGGAGTTAGCGA CTGCTGGCTTATTCCTTCGCTTTGCTTGG AGATC | | | |
| 101 | IM0007T9 | CCCCCTTCCTGTCACCTCCTGACCCCTT GCGCAAAGGAGGCTCGTGGCCCGCTGT CCCACTGGGGGATGGGGCTGGGGTTGA GAAGGCTAGTGAGCGCCTCTAACGCTCA GGAAGTGAAGTTTGTGGTTTTGGGGGCT GAGCTCCGAAGGAGATTAAAAAAAAAAA AAAAAAGTCAGAGAGACAGATC | p000777 | D | — |
| 102 | IM000720 | CTTTGTATAAGCAGCAAACAAAAAGCCA GAGGCAGTCCACAGATC | p000778 | D | — |
| 103 | IM000721 | ATACAACAGGAGCAAAGCTGGAGGGGA ACAGATATAGAGGACAGTTCAGGGCATC TGCAGAGGTGCTGTGGAATGGGGAGGG GACAGTGGATAAGGGGACTTACCCTGAG CATCTCGGTAATAAGCATGGGTCACACT GCGGAAGCGCTCCTGTCCTGCAGTGTC CCAGATC | p000780 | A | Rab37 |
| 104 | IM000722 | GATCTATGTCATCTTCCAGGACTCAGAG TTAAGAGAGTTACCAAGTGAGAGCTCTC ATCACCTTCTGAAGCAGTTGAGAATTGG AACCCAGAAAGATGCACATGCACGGGCA CACACACACCCACGGGCACACACCCAC CCACCCATGCAGAGAGAGAGAGAGAGA GAGAGAGAGAGAGAACTCACACTGGTAC TGCAGTAAACGGGAGCTTGTTT | p000781 | D | — |
| 105 | IM000723 | GATCTTCTTTCTCTGCTCAATTAGTTCAC TTCTGCTTTCATCTCCTTTTCTTTTGATAA ACCATGAGTTTCATTAGGGCTATTACAAT CACATGCAGTTTTTCCTTATAGTA | p000782 | D | — |
| 106 | IM000724 | GAATTAGGCCTAGAAACATTAGAATCCA GACCACGGAGCTCCCCAGATC | p000783 | D | — |
| 107 | IM000725 | GATCTTGTTCTAGAACGACCCTGAAGGC AGCAGAACAGAGCAGGACTGAAGGCCA CCAAGGGGATTTCAACTCTTCAGAAAAA ATAAGTGACTCACCTTCTCACAAAGAGC AAGAATCACAGAGGTCAGATTGTCTCCT CCTGCCCATCAGGGACAGAGTCCCCCAT CTTTTGCCTTGCTCCATCTGGCAGGTAAG AGATGGGAAGTCTCCTCCCTCGGTCT GCAGCATCCCTGGCATCCCTGGGGAGT GTTGGCACAGAACCCCCCTCCCTTA | p000784 | C | — |
| 108 | IM000726 | GATCTGTGTGGGCAAAGCCCATGTGCTG GAGTGTGTCTGGGTAGAAATGAGTTGTG TGGTGCTGAAATGTAAATGAAGTCCCTG TGTT | p000785 | D | — |
| 109 | IM000727 | GATCTCATTACAGATGGATGTGAGCCAC CATGTGGTTGCTGGGAATTGAACTCAGG ACCTTTGGAAGAGCAGTCAGTGCCCTTA ACTGCTGAGCCATCTCTCCAGCCCCCCA CCTTTTTTTTTAAAAGATTTATTTTATAGT TTTTGCTTTTTTAACAGTACTGGAACATC TCAGTAATTGCTAAGTTGTCCTTGCTCCA GGTGAGCAGTCATATTTTCTCCAATTCTG GTTTCCTTACTTGTGTCAGAGACCAAAAT AGCTTGTTTAATCAGTTAGAGCTCTTTAG TTACCCATATCTGTGTAGTAA | p000787 | R | — |
| 110 | IM000728 | TAAGAACATAAAAGCAAAATTTGGAGGCT CAAGATTCAGTTTAGTTGCTAGAGGGCT CACATAGCATGCCCTCCCCACCCGGGAT TCCATTCTCATTTATCGAGGCATAAGGCC AGGTGTGGTGGGATATGTGCTGGGATG CATAAGATC | p000788 | D | — |
| 111 | IM000729 | GAAAGGCACACTGGTGAAGGCTGAGGA CCACCAAAGCTGCATTTCTGCTAGGCTA GGTAGAACAAGAATGGTGCTCCACTAAG AACTCAAAAAGCCACAGCCCACCCCTGA GGCCCTCCATCTGACACATGCCGGTCAC CTGTCCTCCCACAGCCCAGCACAGAGAA GCCACCATCCCTCCCCTTCCCACCTCCT GCAGCTGACAGTGTGCATCTTTCCGCAC ATTCCTCTCCTCAATCAGGTCAGAATG TATTCCAAAGATC | p000789 | D | — |

TABLE 1-continued

| SEQ ID NO: | MUTATION | SEQUENCE | CLONE | CLASS. | GENE |
|---|---|---|---|---|---|
| 112 | IM000730 | CACTGAAAATGGCTAGAATTCTGGTGAT GGGTGAGCCGATC | p000793 | D | — |
| 113 | IM000731 | GATCGGAGTCCCTCGTTTCAGAGGCCCC ACTTCTATGGCTCCTGCCTTCCTTGGCTA CATCCATTCCTGCTGAGCTCCTGGAAAC CTGTGTATCAAGTCTTTTCCAGTTAGTGC GTTCTGAGTGGCTAGAAACCGCTTGC CATTACAGCGAAAGACCCGTATAAACCA TGTTCTCTTCCTCTGTGACAAGAGACAAC GACACCGCACAAAGGACTGTCTGGCCT GGGGGGGGGTCCCTGGTTCACAGCTTC AGTCCTGA | p000794 | D | — |
| 114 | IM000732 | GATCGCTCAATATAACAGCAACATGCCA AGTGCCACTTGTAAAATTTGnGTTGAGC AGTCTCATTATCAACTGAAGCACAATGTC AGGCTAGCAAGAGGCAGGTTCAGTTGTT GATTAGCGATAGCACACACAAGCCAGCA CATGCTTTTTCTGTGAGTTCTAT | p000795 | D | — |
| 115 | IM000733 | GATCGCTGAGTTTGTTTACAGAGCAGGG ACGCCTCAGCTCGGATGCCAAAGCTACC AAGAGCTGCAAACGCAAACTTAGCAGTA GCACACGTACTCCC | p000796 | A | Cited2 |
| 116 | IM000734 | GATCGCACAGGTAAAATGGGGACTCACT TTAGCTAAAACAACAACAACAAACAGCCT GATGAGTCGAAAGTCTCTTTAGGTTGCC CTCTGTTCTCCAGCCCCACATCCTGAAG GCTGTGCATTCCTCCCACAGCAGTCTCA AAATAACCATAGTGCTCAAGTCCCTGTA TCAAATGGTGGTATCTGCATCCACCCTA CAGGTGTTCTTTGATTCTTTCTTTTCTG TAAGTGTGTCTGGGTGTTTTGCCTGAGC GTATGTATGCGCCTAGTACCTGCAGAGG CCAGAATAAGGTGTCAG | p000797 | D | — |
| 117 | IM000735 | GATCGTGAGAGGCGAGAAACCCAGACAT CTCTAACCCTTCTTGCCAACTCAGGAGC CACCTGTGGCCCCAGCTGGCCACCAGC CGTTCCTCCCTCAGAGGCCTCCATTTCC ACAAAAGGCCTTCCTGGTTGTTCAGGAC AGAGCCTGGTTTCCCTGATACCCCTTCT CTCAGTGGCCACTGAAGTTACAGGGATG CAGCCAGCCGTGGTTGCCATGTCTGTAT ATGCTAATCTCCGAATTCCACTTCCTGTT TAGATTCTCGG | p000798 | D | — |
| 118 | IM000736 | ACTGTCCGTGTGGGAAACGTTTAGCAAG TCCGAGCGTGTTCGATC | p000799 | K | Nmyc |
| 119 | IM000737 | ATTTCTTTTTGAGTACTTCATATAAGAGC TTCGCATGTACACCACTCTTGCTCGCCA CTCCTCTTTTCTTCTTTCATTAACTACTGT CCACTCTCCAAACTTCATAATCTCTCTAA TTACTATTGTTATTTACACACACACACAC ACACACACACACACACACACACACACGT ATATGTAACCTACTGAATCTTACTAAATA GCTTTACTATCTTCCAAGTAACAGGCACT TGATAAATCTTCTGTCAATCTCCCAGAAC AGAAGCCTTAAGAGTCATTTAAGTTCT TATCTCAGGCTGTTCTGTTCTATGCCTTT TGCTTTTAATCCATCACCGATC | p000801 | D | — |
| 120 | IM000738 | GAATGTCTAGATGGAGACTGGACAGAGT TGGATTCCTAGACACCTAACAGAAGCGA AAGCAGGGGATGGATAAGGTGGGTGCC TCGTCCTACAGCAGGTTCTGAGTGTCCG CAGAGACTCCCATGGCTTGGCACCATGG TTGAAGCTTTCCATCGATC | p000803 | C | — |
| 121 | IM000739 | CTATTTTCGTTCTCTCCGATC | p000804 | D | — |
| 122 | IM000740 | GATCCTCATGTCAAGGCAGGGCAGAC CAGGGTCAAGGGAAAAACACCTGCTTTC CTGGGTTGTAAATGCCAGAAAGGGAAGG CACGGGGTGGGTAGGGTGGAGAACATG GCCCAGACCCCTGTCTCTTCTCT | p000806 | D | — |
| 123 | IM000741 | GCACCTGACTTCCTCATATAAGACACAAA CATCTTGAGTGCTGCGCAGGTGTACCAG GATACAGGTGAATCCAATCTGGTGGAGA TTTGCCCCTGCTCCCTGATTAGCTGAA GCTGCGTGCCTGGTGAGGTGGCATGGC CTGCTGTGCGTGGATGGGAACTGAGAGT ATAAAAGAGCGAGAGGCCCGGGTTAGA GGAGGATTATTATTCGAGAGAGGATTGT | p000808 | R | — |

TABLE 1-continued

| SEQ ID NO: | MUTATION | SEQUENCE | CLONE | CLASS. | GENE |
|---|---|---|---|---|---|
| | | TATTATTGGGAGATATGAACAAGGGAGA TATTTAACAGGGGAGATATAAACAAGGGA GATATATGGAGAAAGAAGAAACAGGACT GAATAAATGTGTGCAGAAGGATC | | | |
| 124 | IM000742 | GATCCTTCTCCTGTCTTCTCTTCTGGAAG GCTGGGCTACATGCCTAACATGTCAGAGT TTTACCTGGGTTCCTTCCAGAGGTTTGAA CTCAGGTCCTTGTACTTACACAGCAGCT ACTTTGCCTATTGAGTCAATATTTTGTGT GTGTTTGTGTAGGTGTGTTCATGTCTGTA TACTTG | p000809 | D | — |
| 125 | IM000743 | GATCGTGCATGCATGGGTGTGTTTTGGG GAGAGGTTCTGTCCTTGCTAAG | p000811 | D | — |
| 126 | IM000744 | AGCTCAGCTTGTCAGGCCTGATTGTGAA CACTTCACCAACCGAGCCATCTCGTCAG CACAGCCCTGTTTTTTATTCCCATTTTCT TTTCTGTATTTCTGTTGAATTTCTCACATA CTCTCCTTTCTCTTCTGCCTTCTTCTGGT TTCTGCATCATTTCTATATTGACATTTAAA CAACCCCCAAAATTCAAGATACATAACA AAAATTTATTCAACTAGTCTTTCTTACTTC CATATCAATAATGAAAGAAAATTAAAACC TTTCAAATTCAACAAATCCCTACACTACA TATAATCACTTTCCTCTATGCTAAATCCA ACTTGAAATTATATCCTCAATACCCTGCT GGTATTTTTACTGTCTACATCACTGCCTA GTCTTCGATC | p000812 | D | — |
| 127 | IM000745 | CTGGTATATGAACGAAGTTGGTCTCTAAA GGCCGTCTAGAACAACGGTTCTCAACCC GAGGGTCGCACCGGGGTCACCTAAGAC TACTGGGAAAGCACAAATATTTACATTAC GACTCATAACAGTAGCAAAATTACAGTTA TGAACTAGCAACAAAAAATAGTTTTATGG TTGGGGATTACCACAACATGAGGAACTG TATTCAAGGGTCGCAGCATTAGGAAGGT TGAGAACCACCGATC | p000815 | R | — |
| 128 | IM000746 | TTCTAACCTGCTAGGGTTTTCTCACGTG GGTTCTTCTTTGAGGGCTCTCTGGCTTC CCTACTGAGCTGTAGCTGCCAAAGTTGA AGGGCTGCGTCTCCCTTGCGTCTCCCCA GTCTTTACAGCTCCTGAAACACACTAAG GTATTTATTCAAATCCCTGTTTTGTGTGC GATC | p000819 | D | — |
| 129 | IM000747 | AGGGCCCTTCCACCTCTTCTAGAATTCG GTAAGCTAAAAGTACATGTATCCGATTAA TCTGAAATAATTTTGTAGACAGTTTGGTG ACGGGTGGAGGGTGTGTGGTTGCGCGA TC | p000820 | C | — |
| 130 | IM000748 | GATCGGCGAGACCACGATTCGGATGCAA CAGCAAAAGGCTTTATTGGATACACGGG TACCCGGGCGACTCAGTCTATCGGAGGA CTGGCGCGCCGAGTGTGGGGTTCGGAC CAA | p000823 | R | — |
| 131 | IM000749 | TTGGCTGTGGAGATGAACGTGGGAACC GTGGAAATGACCCTAGAATGGGGCTCAA ATGTGAAAGGCATGCCAGAGGTTGCTCT GTTGTTTTAAGTCCCTGGCGAACATTAGA ATTTAGCCTCAGTTTTAAAAGCTGTTACT GCCTAGTTGGGTGCTTCTTTCTTAAAAAG CAACCAAAAAAAAAAAAGCCGTTTTCACT CTGAAATGTATTAGAAATTTGCATTAGCC CAATGGCTAATAAGCGATC | p000824 | D | — |
| 132 | IM000750 | GTTATAAGGATTGCATACAAATGGCATCA GGACTGGATGTGGTGGCACATGTCTTGT ATCACAGCACTTGGTGAACAGAGGCAGG GGAATCTCTTTGAGTTACAGGCTAGCCA GCATGACACGGTGAGACTCTGTCTTAAA CAAACAAACAAACAAAAAAACAAACTAAG GTAGCATAAGAGCGATC | p000825 | D | — |
| 133 | IM000751 | ACCTGAATCTTGAATAATGGGCTGTTTTT CCGATC | p000827 | D | — |
| 134 | IM000752 | ACTAATACCTTTCCTTCCGCTGCGATGT TTCATGAGACTCTGGGTTAGTGCATGGT CAGGGGCCCAGGCAAACAGTGGCAGTT CTGCCCAGGATC | p000831 | D | — |
| 135 | IM000753 | GTTTAAAGAGCCGGTTCGACCCGCTTTC CGTTTCGCTCCGGGTCAGCTAGTACTGT | p000832 | D | — |

TABLE 1-continued

| SEQ ID NO: | MUTATION | SEQUENCE | CLONE | CLASS. | GENE |
|---|---|---|---|---|---|
| | | GAACCGCTCGGTCGGGTCCGGCGCTGC TGCGCACCTACTCGCCGGGACCCTGAA GCCCCCCAACTACATATAGGGGTCTTCC CGGAAAGTACGCAGGAAGTCGCGTTCG GCCCCCTCCCCCCAGCACCACACCCAG TCCCTTCCACCCCCCGGGATC | | | |
| 136 | IM000754 | GATCCCAGTAGAGACAGAAACAGTGCCT TTGGTTAAGAATTCCAGGCAGGATGGTA CAGGATTGCAATCTCAGCATGGGAGACA GAGGCAGGATTTCCAGGCCAGCCTGGG CTACAGTATAAATGGGACCCTGTCTCAA GTTATTGAAAAAAAAACAGAGAAAGAATT TGGAGACTGTGACTATAGCTTGGTGATG GAGTCCGTTTGCCTAGCAGAGTGAAGCA GCTGTGCTCCTGTGTTCACACCACTAAA TAA | p000833 | D | — |
| 137 | IM000755 | GATCCAGTGAATCTGGGCATTGTGAGTG TGTGACACAACTTGCTCTATGTGCTGTTA GGGATTTGTGCATGCTCAGCCAACAACA ACCGCCAACTTAGACTGATGCTGTGCGG CTGAGAACACAGACTGACAA | p000834 | B | Mm.1313 36 |
| 138 | IM000756 | GATCCTCCCTACCGGTCCTCGGGCAGAC CTCCAGCCCTTCCCCAGACACTGTTGGA AAGCAGGCACGCCTTCCACAGTATGGTC TGAGGTTAACCCATGACAGCACTCTGGG TGCCTGGTGGTGTTCCTGGTGGGGACG TCAGTAGCTGTAGCTCTGTCATTGGTCC TTGCAGCGTCTCATTCAACTATTCTTCC CATCACTCCTCT | p000835 | D | — |
| 139 | IM000757 | ATATGTGTTTGTGCGTGTGTGTACATGTG CATGCATGGCATGTATGTACCCATATAAA TATGTGTATGTGTGTGAAGTGCTGATGTA TTTCACACAGCATTTTGGATTTAATGGAG AAGGTAGCTCAGATGTCAAGTGTGCCCT CCTGTCAGGAGAGGAAGCCTGATGTGC CTGCTGTCATAACTCTGGTTTTGATAAAT ACAGCACGAGTGATTTTTGGCTGTTGGG TTTGCCGTGTATGGATC | p000837 | D | — |
| 140 | IM000758 | GTGCTTGCAACATTGTCATAGCTTAGT GAACAGTATAGCATTGTTCTGGCTCAAG AAGCCCTGGTTCTTCAAAGCTCCTACTTA GATGAAATTATTTGCATACTAACAAAAA TTGTTTTGCATTTTTTAGATAATGAAGGA TC | p000838 | C | — |
| 141 | IM000759 | GATCCTAGGCCAGTCAGGGCTACCAATA AGAACCTGCCACACACACAAAAGGAAAG CAAATTTTTGCAAAAACTCTAGTCTCATG GTGTCACGGTCTAAACATCTTGAGGG GCTCGAACTGGTGAGGTGGCTCGGAGG TAAAAGGGCTTTGATGCACAACCTGAGT TCAACCCCGTGTTTAAAGACTTTCTGCA TGATTCTGGTCTGCAGTCCTAGCCCAA GCACAGTCAAGGAGAGATTGAGGCTGAA ACGGAAGAATGGAAGTTTGCATAACAGC TCAGTGGCAGAAATAACAGGAGAGACCT GACCTTAAAAACAGGGTGTAAGGTGAGA AATGATGACAAATGACATCCACTTCAACT GTGCTACAACAGCTACCTGTTTGCACA CCCCAAACACACACACACACACA | p000839 | D | — |
| 142 | IM000760 | GTAAGAGGGAATGTACTCTCTGCCATCG GGACACCCAGTGGAACTGCTCACCTGGA GTCTTGCCTCCACGAAGACTAGGATC | p000840 | D | — |
| 143 | IM000761 | GGGACTTCAGGGCATAGAGCTTAGTTCC AGACAAAACCAAAGTTAGCAGTCGCCTC TCTCTTAAAGACGTTCTCTCTAGCCGCA GATGACCTCAGAAGGGGCTCTGGGAGC CGACTCCCACCCTTCCTTCTCTGTTTACA GAATCTGGTTGGGCTGTGAGGAGCGAC CCACGAGACGGGCTCCCTGTAGTGAGTT AGGCCAGTGGGAACCAACGAGGATC | p000842 | D | — |
| 144 | IM000762 | ACACACACTAACACACACTCACTCACAC ATACTCACACACACTCACACACACTGTCA CACACACACACACACACACACACACACA CACACTTTTCCACCAGGATC | p000843 | R | — |
| 145 | IM000763 | GATCCCTGGATATGGCAGTCTCTACATG GTCCATCCTTTAGTCTCAGCTCCAAACTT TGTCTCTGTAACTCCTTCCATGGGTGTTT | p000844 | R | — |

TABLE 1-continued

| SEQ ID NO: | MUTATION | SEQUENCE | CLONE | CLASS. | GENE |
|---|---|---|---|---|---|
| | | TGTTCCCACTTCTAAGGAGGGGCATAGT GTCCACACTTCAGTCTTCATTTTTCTTGA GTCATGTGTTTAGCAAATTGTATCTTA TATCTTGGGTATCCTAGGTTTTGGGCTAA TATCCACTTATCAGTGAGTACATATTGTG TGAGTTCCTTTGTTCAAATTTCATTTCTAT CACCCATTGTGTGTATATGTGTGTGTTGTG TGTGTATGTATATGACGTGTGTATGTTGT GTGTGTATATATAACGTGTGTATGTTGGG GGTCTAAGGCATGCTCATGCCACAGTGA ATGAGTAGACATCAGAGGACAACTTTCA GGACTCAGTTCTCTTGTTCTACCCTGTG GTTCCAGGACACTAACCCAGGTCATCAG GCATGGTGACAAAGGTTTTGACTCAAGG AGCCATTTTACATGCCTCATAAGAAGGG CC | | | |
| 146 | IM000764 | GCACTAGGAAGGAAATTGACCCGTGTTG TTGGTTTGTGTTCTGGTTTTGTTGGTGGT GCTTTTTGTTTTTTTGTTTGTTTGTTTTT TTGTATCAGGATC | p000845 | R | — |
| 147 | IM000765 | GATCCTGCTTTCTCTTTTGACACAGAACA CTTCTCCTGATTGACTCTGGTCCAGACAT TTCTTTCAAAGGCAGAGGACTCTGGCTT AGCTGTGGATGACTTCTCAGATGAAGTT CATTGGTTGCGATTGGAAACGTAATCAG AGCAGG | p000847 | D | — |
| 148 | IM000766 | GATCGCATTAGGGTTTTTTTTATGGTTTC TCATCTTCTCTTCAAATTAGCATAGAAGC CTCTTCCTAAAGAATGGATACTTAATTCT TAACTTGAAATATCTTTTCTCTGTGTGTT TTCCTCTCCATTGACTGTTCGCTCTATCT ATCTATCTATCTATCCATCTATCTACTGA AATTAAAAATAAGGGAACGCCTTCTTCTC TTCATTCTTGTTTGTTGTTTGTTTGTTTGT TTGTTTTTGAGACAGGGTTTCTCTGTGTA GCCCTGGCTGTCCTGGAACTCACTTTGT AGACCAGGCTGGTCTTGAACTCAGAAAT CTGCCTGCCTCTGCCTCCCAAGTGCTGG GATTAAAGGCGTGCACCACCACCACCTG GCTCTCTTCATTCTTTTTAAAACGATTTTT GAAACCTTTTTAGTGAGGTCAACATTGTG TACTCCAGTCCCACTCATCTTCCTGTCCC TTCCCTCTTAGGCCTGCCTGTCTGGTAC CTCACTCATGTTTGTGTATTCTCTGTGCT GAGCCTCTTCTGTGCTTTCCCAGCACAT GGCTGCTGGCTCCAGTCATTCCAGTC CCTTGTGATGTGAGCCTAGTTCAG | p000852 | R | — |
| 149 | IM000767 | CTCTCATGGCATGGGTCTCAAGGTCCTG CCATTTCTGCTCCATCTTTACCCCAGCAC ATCCTGTAGACAGGACAAATTGTAGGCC GGAGGTTTTGTGGCTGGGTTAGAGACCC AGTTTCTCCACTGGAAGCCCTGCCCGGT TACAGGAGGTGACCAGTTTCTGGCTCCA TGTCCCCCATTGCTAGGAGTCTTAGCTG GGGTCATTCTCACAGATTCCTGGGAGAT TACTCTATTTTATCTCCTTGTTCAAAGTGT TCCATCAGATATTAATTATTCTCAAGATT CAATATTCTCAAATATTATTCTCAAGCTAT GGACCCTTCAAATTACAGATAGATTTTAT GAATGAAAAGTTGTGTGGTTTGAATATGT AGTTGAGGGTGACTTTGAACTTCTGGTTT TCCTGTGTCTACCTTCCAAGTGCTGGGG TTACAGGTATGAGCCATCACGCCAGTTT CTGTAGCACTGAGGCTCAAACACAGGGC TTCTGTCTGCTAGGCAAGCACTCCACCT ACCAAGCCAAATCCCCGGGCTTTACTGC ATCTTTGTGTATATGTATGGTATGTGC GTGTGTATGTTAGGATATATGTACCTGTG T | p000854 | R | — |
| 150 | IM000768 | GATCAACACCTGAAAAGTCGCGCCGCCT ATACACATCCCTAATTGAGAAGTATGTGG AAGATTCCATCCGTGAAATTCAATTATCA TGCAAGCCAAGTGGAAGCGCTTCCCTGG GGAAGGAACCCAGCAGCCGCATCAAAA CGACCCCACCTGTCTATTTTCATGTCAAA AGAGTGAGAAGTCTGGGTGATGTAATAG AGAGCATACATCAGCTTAATGAAAATTTC | p000858 | D | — |

TABLE 1-continued

| SEQ ID NO: | MUTATION | SEQUENCE | CLONE | CLASS. | GENE |
|---|---|---|---|---|---|
| | | CAGGGGTCCCTGCCTGTAATGGGAGTC CCAT | | | |
| 151 | IM000769 | GATCACCACCAGGGTGTTGAGAAAAAAA AAAAGCAAGTTAGTAGATGTTAG | p000860 | D | — |
| 152 | IM000770 | GATCTGACAAAACCTACCTGTTTTTGAAC ACATGTGGGACAGCAGTCTGAGAGAATC TATGAATAAAATTCCTTTCTGAGTCTGGC ACATTGGTACAC | p000861 | D | — |
| 153 | IM000771 | GATCATTATACCCCAAATGGTACTGTATC TATATATACCTCAAACATGTCATGTTAAA GAAAATACTCTGTTGAACTAATTCACTTG TTT | p000863 | D | — |
| 154 | IM000772 | GATCACAGGACTGAATCACATTTATGCC AT | p000864 | D | — |
| 155 | IM000773 | GATCATTTATTTACTTGTTTTGGTGTTTCA TGTTTGTGGCTCCTTATGTAGTCTAGATA TTAACTTGAAGTCTGAAGTGGAACTACCA AAGATTTTCTTCCATCCTCATCT | p000865 | D | — |
| 156 | IM000774 | GATCAACCGCAGATGAGGTCTATGCAGG AAAAACGATGTCTGGAATTTTATTAAAAT TGCTCAGC | p000866 | K | Myc |
| 157 | IM000775 | GATCATCATGTCAAACCTGACACGTGAC GAGACAAATCTGTGTGCACAGAGGTGTG ACATCCTAAAAGTACTAACAATACCGCTG GGCAGGGACACACGCGGCAATTCCAGT CCTGGTATCCATGGCTCAAGCTCTGCAC GGAGAGCCCGGCACACGCGGAGGGGA GAGCCACAGGCTAAGGAGAGCTATGCTA ACTAACATGGCACCCGTGTTAG | p000867 | D | — |
| 158 | IM000776 | GATCTGGCTTCCAAGGGCCTGTACTCAT GTCTACAATGCTCCTACACAGATATAT | p000868 | D | — |
| 159 | IM000777 | GATCAGCCTTCCTCCAAAGCTACGTGCA TAGAAGAGACCTCTGCTCTCACCTACTC TCCTCTACAGTTCAGCCCATATGGCTTCA CCTGCATCCCTACACACAGACACACAG ACACACACACACACACACACAAACACGC ACACAGCACACAACACACACAACACG CACACTCACAACACAAACACACACAACA CACACTCACAACACACTCACACACACAC ACAACACACACACAACACACACTCAC AAACACACTAGTACACAAAGACTCCAAC ACACACATTCCCATGCACTACTCCCTCA GTATCCGCCGCATTTGTGTTCACACTCAT CCACACTCTCACACATGTAGCACACACA CATCATTCCTACACAGGCATGGACACAC ACATGCTCCTATACAGGCATGCCCAGTA CTCTCACATGCATGTTTGCACGTTCCCAA ACAGGTTCCCACAAGGGTTTGGCAAAGT ACATGCATCCTCACACGCTAATGCAAGC CGTCACACCCCATACCACAAGCATGCAC | p000870 | R | — |
| 160 | IM000778 | GATCAGATGTGGAAATTAGAGAGAAGTT TTTAACGGCTCATGCACATTTCTGAAAAC TCTTTGCGAGGTATACTGGTAGATAAATG AACATTGGTCAGACTCCTCTAGTTTAAAC CACTCTCTTCCCCGCTATGGGGGAGG CGAGAGGCATTTCTAAAGCTTATATGTAG TTGCAAAGTGTGTGTGGTGTGTGTGCAT GTATGTGCATGTGGTGTGTGTGTGTG CATGTGGTGTGTGCATGTATGTGCAT GTGGTATGTGTGTGAGTGGTGTGTGTGC ATGTGTGTGCATGTATGTGCACCGTGTT GTGTGTGTATGTGCATGTGGTGTGTG TGCATGTATGTGCATGTGGTGT | p000871 | R | — |
| 161 | IM000779 | CTAACATCTACTAACTTGCTTTTTTTTTTT TCTCAACACCCTGGTGGTGATC | p000872 | D | — |
| 162 | IM000780 | GATCATAAGGACTGTTAGCAGGCAAAGG CGCGTGCCCAATTAAAAGATGGCTTTCG TTCCAAGAGGAATACTCTGGCAAAGTCC CAAGCGCTTCGGAAGCCCCTCCCTTCGC TCTCCCACCCCAGCTGATGCTCTGATT ATCCTAA | p000874 | D | — |
| 163 | IM000781 | GATCAGGCTGGCCTTAAACTCAGGGAGA TTCATATGGCCCTGCCTTCAGGGTGCTG G | p000875 | B | Mm.8363 5 |
| 164 | IM000782 | CTTTCTTTCTTTCTTTCTTTCTTTTTTTC TGAGACAGGGTTTCTCTGTATAGCCCTGG CTGTCCTGGAATTCACTGTAGGCCAGGA | p000876 | R | — |

TABLE 1-continued

| SEQ ID NO: | MUTATION | SEQUENCE | CLONE | CLASS. | GENE |
|---|---|---|---|---|---|
| | | TGGCTCAGTCTGCTTTCTTATAGAACTCA GGACCACCAGCCCAGAGATAACACCACT CACAGTGGGCTGGTCCTCCCCACATTGA TC | | | |
| 165 | IM000783 | GATCACACACTTCACTGTGGCTTGTCAA CTGTGATTTGCTGATACAAGGGCTGTTTA CAAGTCAGCTATAGCTCCGCATTGCAGC TGCAAC | p000877 | D | — |
| 166 | IM000784 | GATCACTAATTGAGAAAATGCCCCACAG CTGGATTTCGTGGAGGTACTTCCCCAAC TGAAGCTCCTCTCTGTGATAATTCCAT CCTGTGTCAAGTTGACAGAAAACCAGCC AGTACACAAGTCGACACAAAACTAGCCA GTACACAAGTCAACACACAACGCGCACA AGCTGAAGGCAAAGAGAACCAAGCATCT ACCAGGCCTCAGTTGCTATGTCCACTTC TGCAGCCACTCCAAAACACCTGTCAGAA ATTCGGTTTGATAGAGAACTCACCGAGG GATTTCCCTAACACCAGGTCAACCAGGG CACCTCAAACCTGGAGGCACGACTGGCA CAATACAACCTAA | p000878 | A | CcT5 |
| 167 | IM000785 | GATCACTTGATAAAGATGCTCTGAGCAG AGGCTCACAGGAACCCAGCCCTGTGTG CTCCCCAGGAGCGAGATTCAGCAGTCAA CAGTGCAGTGTTCACGTGACCGTGCGCA GGCCATGAGCACTAC | p000879 | B | AI615991 |
| 168 | IM000786 | CTCCTTTTCAGCAAGCTCCTCACATCACA GGCCTTCTCTTGGGATGGCAGCCGCCTT CTATCTGGAAAGTATGTGACAGCTCACA CAATCCTGTAAGTCTTCCATGTAATCACA TTCCACTGCCTCTCTCTGAACGTGCTCC ATGCCAGGGCCATGTGGAGGGAGCAGC AAGACTTGAGCTCAGCTAGTCTATGAAG ATGGTGGCAGAACAGGCTCTGCTGCCTT GATC | p000881 | B | MMU767 54 |
| 169 | IM000787 | GATCAAGAGTTCAAAGTCATCTTCAGCTA CAAATGAAGTTGGAGACCAATCCAGACC CTCTCTCAGAAAAAAAGGAAAAAGGAGA AAGCAAAAGGAAAGGAGGGGGAGACCG AGAAAGAGAAGAGGGAAGGAAAGGGAA GTCAACAGAACTGAAGGTCAGCCTGGGA GGGTGAATGAGGCATTGTTGTCT | p000882 | B | Mm.1388 09 |
| 170 | IM000788 | GATCACCTCCACTTTATGGTGGACAGAG GATGGCAGTAGTAACTGCCCCAAGGAAA CAGAAACAACAACTACAACAACAACAAC ACCTCCAAAAAGACCAAAGCAGTAAGCT GTAGAACAAATGCAAAGAGCCAAAC | p000883 | R | — |
| 171 | IM000789 | GTTCCACCTATAAGGTTGCAGACCCCTT TAGCTCCTTGGGTACTTTCTCTAGCTCCT CCATTGGGGGCCCTGTGATC | p000884 | R | — |
| 172 | IM000790 | GATCACATGGACCGATTGCCGCGGGAC ATCGCACAGGAGCGTATGCACCACGATA TCGTGCGGCTTTTGGATGAGTAGAACCT GGTGCGCAGCCCACAGCTGCATGGCAC TGCCCTGGGTGGCACACCCACTCTGTCT CCCACACTCTGCTCGCCCAATGGCTACC TGGGCAATCTCTAGTCTGCCACACAGGG CAAGAAGGCCCGCAAGCCCAGCACCAA AGGGCTGGCTTGTGGTAGCAAGGAAGC TAAGGACCTCAAGGCACGGAGGAAGAA GTCTCAGGATGGCAAGGGCTGCCTGTTG GACAGCTCGAGCATGCTGTCGCCTGTG GACTCCCTCGAGTCACCCCATGGCTACT TGTCAGATGTGGNCTCGCCACCCCTTCT TCCCTCTTCATTCCAG | p000885 | K | Notch1 |
| 173 | IM000791 | GATCATACGCAATGATTTCTTACCTTATG TATAATTATGTTTAGAGGGAAAACTTTT TTTTAAATTGAAGTTCATTTATTGTATGTA ATTATTTCATAA | p000886 | C | — |
| 174 | IM000792 | GATCAGCATGGTCTACAGAGTAAGTTAC AGGACAGCCAGGGCTCCGTGGAGAGAC CCTTTGTCAGAAAACAAACAAACAAAAAA TTAGAAAGAGACCCTCTCTCTGATTTGAC CAATCACCCGTGTCAAATCTTGCCACAA CCGAATCACCACCAAATTGCCAGACAAG CGGCTATGCTGGGTTTCTGAGGTTGGAC TCCTCAGGTAGCCCGTGTCTAGGCAGAA |

TABLE 1-continued

| SEQ ID NO: | MUTATION | SEQUENCE | CLONE | CLASS. | GENE |
|---|---|---|---|---|---|
| | | TGATGCCAGCAGCTACACTTTTGAGAAC AAGGTCAGGTCAGGACTTGCCGCCAAAC CTAGGAATGCAGC | | | |
| 175 | IM000793 | GATCAGTCATGTCCTTTAGACGTTTACTT TCATCCCAACTTGGAACATTTCAAGC | p000888 | D | — |
| 176 | IM000794 | TTACAAAGGCAGAAATATCAGAAAGAGC CTGAAGTAGCAGCTGTTAACCTGTACCA GGAACTGGCCGAAGTACACACGGGTTAA CTCAGCCCTAATTATTCTCGGGAGATAC AGTTGATTATCATACACATGTCAAAATGG AAAATAAATGGGTAACTAAAAATTGAGGA AAATAAGATTAACACTTAAACAACCTAGT TCATTATGCCACGGTGATC | p000890 | D | — |
| 177 | IM000795 | GATCACAGTGGGACAGATTAAATGTTA | p000891 | D | — |
| 178 | IM000796 | AAACAAATACAAAGTGATAATTGTGTGAC ATCTGAACTTGTCAATGAGATAGGTAATT ATCTCTGGGCAATGGGTAAATGTGCTGG CCAGCAAACCTCACAGCCAGAGTTCAAT CTCCAGGAACTTAGGTGGGAAGGAGAT AACTGACTTCCAAATGCTCACCCCCAAAT ATACAATTAAAATAAAAATCTTCCTTTTAT GAGTAGCAACTGATC | p000892 | D | — |
| 179 | IM000797 | TACCCCTGGTCCTCCAACACTCCGATC | p000893 | D | — |
| 180 | IM000798 | GATCATGACATAGACTTGAGTCACTTCTC TGCAGTTTGTCAATAAAAGCCCCTAAGG GACAGTGTGGACTTTAGAGATAAC | p000894 | D | — |
| 181 | IM000799 | AATGCCAGCCATAGTGGCACACACTTTT AATCCCAACACTCAGGAGAAGTTAAGTTT CTCTTAGCTCAAGGCCAAGTAGCTTGGT CTACTCCGTGAATTCCAGCCCAACTACA TAGTAAAACTAGCCTTAAAAAAAAAGGCA CAGGCAGAGGGAGATAACAAAAATGCCC AACTCCTAGCTACAGTAACTGTAGGAATT AAGATAGAATCTGTAGTTTGTTTATCATT ATCGTGATGATC | p000895 | A | — |
| 182 | IM000800 | GATCATGGCTTGATTGTAACATTATCAAA GCTTCCTTGGCACACTGCAGGGCTGTCT TCGGGAAACTGCGTATTGTGCTCTTCAG GTACAAAGCATAGAGCCCTTACATGACA AACGCTGGGGTTAACTTCTTCTAGTTCC CTCTGCCCCACTTGTGGCGCTTCCCACT CATGACTTCTTCAGTGTGTATTCACTT | p000896 | D | — |
| 183 | IM000801 | GATCATGCTGAACTCTTGAAAGTATTCTA GCAAAATGTGGCTTAAAAGAAAGAACAA ACATTAACTAGGTATGCTTTGAAAAATTA CCTGTGGTAAAATTTCCACAAGCATGAG AAGTTGTTTCTTTTGTTGAACCTTCAGAC | p000897 | D | — |
| 184 | IM000802 | GATCATATATCAATTTTATTTTTAACTTTG TTTGTTTGTTTGTTTGTTTGTTCGAG ACAGGGTTTCTCTGTGTAGCCCTGG | p000898 | R | — |
| 185 | IM000803 | ATTGTGTATCCAGAGTGTGACAAGGTAT ATATGGTTGTGTGATC | p000899 | D | — |
| 186 | IM000804 | GATCTTCTGTCTGGAAGAGTGCTTGCTG GTTCCGACTACTTTTTTTTTTTTTTTT TTTTTTTNGCTTGGGTTTCANATTGGCTTC AGGTTCTGGGCCCTCGTGGGTTGTGCTG CANAGCCCCANACAATGTCTTGGG | p000900 | R | — |
| 187 | IM000805 | CAGGAAACCAGGGGAAATGGGACACAG TGACATCTGAGTCCTTAGAAGAGGTCCC ACAAAGGTCTATATGACCTAGCAACGTC ACTTCTGAGTTATTTCTCAGACACAGTGG ATGTTTGTCACAGCACACTGTAGGACAT CCCAGAACAGCACCATGGGAGACCATG GTTGGTGCAACAGAGAACATGCACACTG AGACAGTACAAGAGTTCCAAGCAAGCA GACACAAACAATGGACTCAATACACATA CAGTGGCAGATC | p000902 | C | — |
| 188 | IM000806 | GATCTGCTCACCAAAAATCTTGTCCTAG GGAAGTTGAGTTTGAACTGCGTGCTTAC GGCAAACACGCGGTGCCCAAATTTAAA | p000903 | D | — |
| 189 | IM000807 | ACAGTTCCCCCTGGAAATGGTCCCTGTA CCAGAGGAGCAGATC | p000904 | D | — |
| 190 | IM000808 | CTGGGGCCCAGACTCCAATCCCGAAATA TCATTAGCTGCTGCGCACTTCTCCGAGG AAGTTTACACCAGTACCCTAAGTTCAAGT CTCAGAAGCCTCCAAATCCTCGTTGCAC CCCTATATTTCACTTGGTCATCCGACTGT | p000905 | B | Mm.2179 8 |

TABLE 1-continued

| SEQ ID NO: | MUTATION | SEQUENCE | CLONE | CLASS. | GENE |
|---|---|---|---|---|---|
| | | AACTCACTCACCGACAAGACAAAGAATA TCTTAGGCTCCGTCGTAAAAGAACGAGC CCGGTTCACCGCAGCTCCTTTTATAGTC TCCTTTGTGCGAGATC | | | |
| 191 | IM000809 | GATCTGAAGATATTTTGACAACAGCTAAA AAAAAAAAAACCAAAAAAACCCCTTATT ACTAACCAAGGGAAAATGCAAAATAATT AAAAGTTCCTCAATTTTAAGTAAATATCC AAAAAGATTGGTTGTATAACAAAGTTGAA GAGTCAAACAGTATGAATAA | p000906 | D | - |
| 192 | IM000810 | AGCTCATTGCCGTTAATTTTCCTCAGCCT AATGAGAATCTAAGCCTTGATTTGTATGT CCATAGCATCTAGATC | p000907 | C | - |
| 193 | IM000811 | CCTTGAACCTAGTTCAGGGAATAGGCCA CCTGGGTGGGACTAGTGCTGGTTGGGG ATGAAAAGACAGTTGGCTCAGGTGAACC CTGCTCGCACCCTGGTCATCCTCTGAGA CTGCTTTGATTGCTGACCCCAGTGCTCC GCAAGAACTTGCGTTCTTGTTCTCTCCA CTCAAGCCGGAAGAAATCTGAGGAGAG GGTGTGAATCCTGAGCCAGGATGTCCAA AACAACGGAGTTGAGCCAGAAGGACGTC TAGTTGGGCAGAGTTAGCTCAGTCCCCT GACCCCCAGTCCGTGCAAGCTCGAGGG GTTATATAGTGATACAGATC | p000909 | D | - |
| 194 | IM000812 | GATCTCTTCTTATCTCTACCTTTTGGGGC ACAATCTTATCTGGGGACACCACAGAGC CCAAGAATTGTCCTGTATCAGAAATTTGG ACCTTTTCTGTGGCTATCTGTAAACCCCA CTGACTTAAAGTTTTAAGTAGAAAAGGAT ATGCCTTATGTAGCATGGTAAGGTCTTTA TGGCACAGGAGGATGTCATCCATGT | p000912 | R | - |
| 195 | IM000813 | CTTCCTTTCCTTTTTTGAAACAGGGTC TCTGTGTAGCCCTGGCTGTCCTGGACCT CAATCTGTAGACCAGGCTGGCCTCGAAC TCAGAGATC | p000913 | R | - |
| 196 | IM000814 | GATCTGCTCCACTTTACACAGCTGACCA TGAGACCATGTNCACATAG | p000914 | D | - |
| 197 | IM000815 | ACATGACATATCACCCTCATTCAGAGTTC AGAGTCTTCAGAAAACTGGGCGCCTGAA CCTGACCTTTTAAATTTTCGTCCATA GTTTCTTCTGTTGAATGAATATTCATAA AAGCTTCATAAATGCCTAGATC | p000915 | D | - |
| 198 | IM000816 | GATCTTCACAGCGCACCCAGGGATC | p000916 | D | - |
| 199 | IM000817 | CTTTTTCTTGGTATTTAGGGAGTCAGGAA AAGAAAAACCATTGGGTTTTTACATTAGC TTTCAGGTAGGGTTGTGGCTTTTGAGCA ACAATAACGTATGACCTTGTGGTCGGTT CTAGATC | p000917 | D | - |
| 200 | IM000818 | GATCTTCTTATATCTGGTTTCCTGGGCGG TTCCTGGTAT | p000919 | D | - |
| 201 | IM000819 | GATCTCTGACAGGGTTTCAAAGAACTGT TACTGATGTTTAGATTGCCTCTGAAGACA TCACATATACTGTGCTACTCTGCCTTGTC AGAGTCCCGGGCCCTGGGCACCCCAGA CGGCAGCAGAGGAAGAGCGGGGTATCA CTTTTCTATACTTCGGTAAAGTCATTGGGA TATGTGCCCT | p000920 | C | - |
| 202 | IM000820 | GATCTCCTCTATCATTTATCTTTCTTCCTT CCTTCCATCTGTTTGTTT | p000921 | D | - |
| 203 | IM000821 | GATCTGCTCACCAAAAATCTTGTCCTAG GGAAGTTGAGTTTGAACTGCGTGCTTAC TGGCAAACACGCGGTGCCCAAATTTAAG GAGTGCCTACGACTTCGCGGGCCAGCA AGGTGAAACCGGAGCGCGCACGAGTGA GCAGTGGCCAGGAGGCCTGGCCAAGAG GCCAGGGTCCCTGAGCATGACCGAGAG CTGGCGTGCTCTCTGTAACCCCCAATCA GTTCACCTAATCTCGGGTCGAAACCTGA GCCCTGCAGGAGGCGGGCTGAGACTG CATCCCAGCTCCTGGCCCGCTCCAGGG GCGACCC | p000922 | D | - |
| 204 | IM000822 | CCAGGCATCTCCATTCTTAATCCAGATC | p000923 | D | - |
| 205 | IM000823 | CATAGACTCTTTCATTTAGAATAAAGTGT TCCACCTAACATCCTGTAGGAAGTGATG AAACTAAAAAGAAAAATAAACGCATTTTC TCTTTCTCTCGTTACTTTTTCCATTCACTA | p000925 | D | - |

TABLE 1-continued

| SEQ ID NO: | MUTATION | SEQUENCE | CLONE | CLASS. | GENE |
|---|---|---|---|---|---|
| | | AACAAAATTGACTTTTTTTTCCATGAGA GTTCACACTGGGTCTGCCTCAGTAAGAG TCACACTGTTCAGCCCACACACGCTGTG ATATGTTATTTACTCATTCTCTTCTCAGG AACCACTCTCACATGTGAACCCTGAATA CCAGCTCCCTCCCTCTTCAGATC | | | |
| 206 | IM000824 | ATAGGTTCTGTCTCAAAACAAACAAAAAA CCAAAACATGTCCACAGGGTCCAACAGA CACAGTCTCCGCCACTCACAACTAATGG GTACACTAATACACACCTCAGCCTTACAT GGTTACAGAGAAGCAGGACCACAAG GTAGGCAGGCACCTAACACTTGCTTCTT GGAAGTTGGAGCACACACACACACACAG AAACACACACACACTTTCTCACACTCACA CACACATTCTCTCTCTCTCACACACACAC CATGCACACATGGTCTTGTACAAGCTC CTCCTGGGATGGGCACACACAGGGGTA AGAGGACTCCAGATC | p000926 | D | — |
| 207 | IM000825 | GATCGAACACNCTNGGACTTGNTAAACG NTTCCCACACNGACAGA | p000928 | D | — |
| 208 | IM000826 | GATCGTCTGGCCCGACCGCGCCTCAGT AGATGGGTCCTGGTCTGAGCAGCCGG GCTGGTGCGGGTGTCCTCACTAGGATAA TGAATACAGCTCCACTACCTATACTACCC AAGACGACCCCTCACACGCTCTGCGAG GAAACCGGTCTTCGGAC | p000930 | D | — |
| 209 | IM000827 | GATCGACCGCAGATGAGGTCTATGCAGG AAAAACGATGTCTGGAATTTTATTAAAAT TGCTCAGC | p000933 | K | Myc |
| 210 | IM000828 | AGTAGACTGAGATTTGTGAGCGCTAAGA TAAAGATGAGCAAAGCTTTGGCAGCTCT TAGGTATCTGAGGGCCACCGTCCTCTAC AAAGCAACGAGAGGCACGGCGGATTAG GATAGACTGGTTGCATCCAAACACTACC TTGCTGCCTCAAAGGCTTATTGGACACC ACAGAAAGACCTCTGCTGGAGGCAGAAG TCACAGGACTCCTCGTCACAGACGATC | p000934 | D | — |
| 211 | IM000829 | GATCGGCCTCCTCCAAAGCTACCTGCA TAGAAGAGACCTCTGCTCTCACCTACTC TCCTCTACAGTTCAGCCCATATGGCTTCA CCTGCATCCCCTACACACACACACACAG ACACACACACACACACACAAACACACAC ACAACACACACACACACACAACACACACA CTCACAACACAAACACACACAACACACA CTCACAACACACTCACACACACACACAC AACACACACACACAACACACACTCAC AAACACACTAGTACACAAAGACTCCAAC ACACACATTCCCATGCACTACTCCCTCA GTATCCGCCGCATTTGTGCTCACACTCA TCCACACTCTCACACTTGTAGCACACAC ACATCATTCCTACACAGGCATGGACACA CATGCTCCTATACAGGCATGCCCAGTAC TCTCACATGCATGTTTGCACGTTCCCAAA CAGGTTCCCACAAGGGTTTGGCAAAGTA CATGCATCCTCACACGCAAATGCAAGCC GTCACACCCCATACCAAGCATGCAC | p000937 | R | — |
| 212 | IM000830 | ACACCACATGCACATACATGCACACACA CCACATGCACACATACACACAACACA TGCACATACATGCATACACATGCACACA CACCACTCACACACATACCACATGCACA TACATGCACACACACCACATGCACACAC ACACACACCACATGCACATACATGCACA CACACCACACACACTTTGCAACTACATAT AAGCTTTAGAAATGCCTCTCGCCTCCCC CCATAGCGGGGAAGAGAGTGGTTTAAAC TAGAGGAGTCTGACCAATGTTCATTTATC TACCAGTATACCTCGCAAAGAGTTTTCAG AAATGTGCATGAGCTGTTAAAAACTTCTC TCTAATTTCCACATCCGATC | p000938 | B | Hs.17043 4 |
| 213 | IM000831 | GCTGGACCCCGGTGACAGACTGTGCAG ATGGATC | p000939 | K | Pim1 |
| 214 | IM000832 | TTAGCAAGTCCGAGCGTGTTCGATC | p000941 | K | Nmyc |
| 215 | IM000833 | ACTGCACACATTGCCGGTTGTCGATC | p000943 | K | Notch1 |
| 216 | IM000834 | CAAGTGTAGACATTGCAGGAAAAAATAT GGTGACAGTGAACAAAGCCCGTGAAGGT GACAAAAGCCAGTTAAAGTAGGACAAGG CAGAGCGAGGCCCATGACCGGGACCAG | p000944 | B | AW32146 8 |

TABLE 1-continued

| SEQ ID NO: | MUTATION | SEQUENCE | CLONE | CLASS. | GENE |
|---|---|---|---|---|---|
| | | GCCCAAGAAAATAAACGAAGGCCACGATC | | | |
| 217 | IM000835 | GTCGGAGGAGCTGGCTGGACCGGTACATGCCCTGGCCATCCAGGCGAAGACCCCCGCCCAGTGGAGAGAAAACCCACAGTTGGACATTAGTCCCCCCTGCCTAGGTGGGAGCAAGAAAACTCGAGGGACCTCTTAATAAATACCTGGATTGGGAGAACGATC | p000946 | R | — |
| 218 | IM000836 | GATCGCGGGGCTATCTATAGAGTCCCCGGGATGTCTGAGAAATCAGCCCTAGAAATGACTAGAAAGAAAATCGAAGTATTCTTGGCTCCTGGAGACTTCCGCAGCGAGAAGTCACAGATTCAGGACACAGATTGACAGGAGCTGCGGGCGCTGGTAG | p000950 | D | — |
| 219 | IM000837 | GATCCCAGGATTTGGGAGGCAGAGGCAGTTGGCCCCA | p000953 | R | — |
| 220 | IM000838 | CAGGCTGGCCTCAAACCTGCAGAGATGCTCCTGTCTCTGAGTGTTAGATTTTATAAAGGGGTTCACGATC | p000954 | K | Lck |
| 221 | IM000839 | GTTGCTGGGCCCTAAGCGCCCACATTTCACAGCTCCGATGCTCATCAGCATGACTCTCCTGAGCACATTATCTGGTGGTGGCTGACACTCTCTTCAGTACCCCCCCCCCTCCCAAAAAAGAAAAAGAAAAAAAGGACTGGTTGCTAAAAGAAGTAAAAGTCAAGTCATCAAAAACAATGTAATATCCTGTGTGAAAGTCACGAAGCCTTGCGGTGAGTCCCTCGATC | p000955 | D | — |
| 222 | IM000840 | GATCGGCCGGCTGTCCAGCGACCGGAGAAAGGAGAGCACTCGAATCGCAGAAGCTATCAGGTGAGTCCGACCTCTCTCTGAATGAACGCTTTGGGGAGCCTGCCAACGGTGACCAAATTTAGCCAGTTAAAAGTACAGGCTGCCCAGCTGTAAACGTACATCAAACAATGTGCGATTTTATTTTTAGTGTGAA | p000956 | D | — |
| 223 | IM000841 | ATAGTAACACTTGGGAGGAGCCATTCCCAGTGAGGCTCGTATAGCATAGCCCTGTCCAATAGAGCCTCTGTTGCACTCTGTGTACACTTAGCTCCTTGCTTAGGGATTTTTTTTACATGGGTGACTACAGCACCCCAATTTCACATTGGACAGACTCCAGGACACCCCTCGGTGTCCTGTGACGCATACAACAGCCCCCCACGGGGCTGCACCGAAAACGCCACAGTACTGAGGCTGCACCTCACTCACTCACACACACCTCTATGGCTCAACGTCCTGGAGAAAAGGCTGCGACAGATTCCCACATCTGGGAATGCAGTGAAAAAGCACTCACACTGGGGGTGGGGTGGGGCTGGGGGGCACCCTGTCTTCCCGTCTTCCCATGACCCTCTTCCCTTCCAGGAGACCATAGCCAGAGCTGACAGGAGATTCAGTCGCAGCTGCACACGCTGCTGCCTTGCCGATC | p000957 | D | — |
| 224 | IM000842 | GATCGGGCAGGACACACATTGGGAGGCCCATCAAGCCCGAGCCTGCCTTGTGAGCCCCCGGATTGGCAGGGCAGAGAGGAAAGCTGCTGCGTGCTTTATAGACTTTGGGGAAGTCACAGGCTCCGCTTGCTTGGGGGAGGCAGGAAACCCCTCCACCTAGGCGTCTGCCAGAGCACCCGCAGGCTTCCTCTTGTCTCTGTCCCCCTCCCCAGCACCTCTTCCCCTGAACAGCTTCCCTCTCCTGGCCCTGCTGTCCCTTTAAAGGAACTTGAATCAGAGTTGAGAATGATGGTGACTCAGGGTGGAAGGGGTGGTCACTTG | p000959 | D | — |
| 225 | IM000843 | CCAGGGCTACACAGAGAAACCCTGTCTCGAACAAACAAACAAACAAACAAACAAACAAAGTTAAAAATAAAATTGATATACGATC | p000960 | R | — |
| 226 | IM000844 | GATCCAGGACATGGCAGAATATGGTCATCTTCTTTGCTTGCATGTCACACGAATGGCCTCTGGCTCCACCCCTGATTGCTTGCTCCCCTTGGAAGCCTCTTGAGCCTAGCTAACTTTTCCTGTTCACCTTTGTATTATGTGCTCCCACCATGCCCACCAGGCTCTGCTTGCAGCACTGCAGCCTGCAGCTCCAGCGGCCTTTACATGGCTCCTGTAAACAAGTCCCAGAGGCCTCAGTGTCATCATTTCAG | p000976 | D | — |

TABLE 1-continued

| SEQ ID NO: | MUTATION | SEQUENCE | CLONE | CLASS. | GENE |
|---|---|---|---|---|---|
| | | CAACCGCCTCACTTCTTGGTGCCGCCTT CCTTTATTACTTTCATATTTCTGTGACCG AAATACCCCAAAGAAGCTACTCAAGGA AAGCAGTATGTGTGGGCTCACCATTAGA GGTCAGTCCCTGCAGCAGTGGAAGCAT GTGCTGGTGACGC | | | |
| 227 | IM000845 | GATCGCTACTTTTTCAGAGACGCCTTCAT TAAGGGGAGAATGGAAAGATGCTGGTTG ACTTGAAAGATTTCTCTCTGATTTGTTTTA CAGGAAGTGCATTCTGTACACATGAGAG ACTCCGGGTGGAGAGGCATTGTGGCGG TTGAGATGCACCTGGGAGTGCCAACTGC CCCCGCTTCTACCACAGCTCTGCATAGC AGGCTGGAGCAAGCAGCCAGCCAACCA TTGTGCCCTAGCCTCATCTCCTCCAGAA GAGGTTATCTGGGCTCTGTGTAACCTCT GCTCTTTGGCTATGGTATTCCTTCTTGGT GCTTTCTGTGGTCAACCTCCAGGTACAC TTAGGGCCTATCCTAGACAGACTGGGAA GAAAGTATGACATTCCCATTGACCTCTGT TTTTATTTCCTGGAAATCCAGACCTTGTT CCAGTTAGTGGAGCATGGGGTTAGACCA ACCACACTGCTAAGAGTTTTGGCCTGTA GACATATCTGG | p000983 | C | — |
| 228 | IM000846 | TAGCAAGGTAAGTACTTGTCTCAATTTCC AGGTAGTATAGAAGAAACATATATGTTAC AGCTTTAACACCAGAACTATCACACAGT GTTGTATTTTAGCTAAAATATGACTCTGT GGTTTTCAAATGGCATAGTTGTGGACAA CTTAATTAAGCACGCTCTTATAAGACGTG ATAGAGTATGTGCCATCCAGATACTAAG AACTGTGTCCAAAGAGCTTGGGACACAC ACTAAGGGGCCTGCCTCTTTCATAACGG GGATGAAAATGACTGAGGCTTCACATTT GCACAGTACGATC | p000988 | D | — |
| 229 | IM000847 | AAGCCATCTGGGTCTCAAGTTGCTAAAA CTTAATAACTCCCTCCCTGTGTTTGTCCT TTATCTAATGGTAAAATATGACCTAATGA AATAGGTTCCTAAGGCTTTCATATAAGGC ATGATGTTGAAGGATGGAGGACAGAGTG GGATGGAAAATCAGAGCCTGCACAGAAA ACCACAAGCAGCTAACAAAAGTCCACAA CCAAAGCCTGTGCCTGAAATGTCACCTA CAATGCAGTGGACTATTCATATGCCAGC CTGGTCCTCATGCGATC | p000991 | D | — |
| 230 | IM000848 | CCAAGAACAGAGCCCCAAACTAATAGG ATGGTTTGTTGCACGTGTACATGTGTATG CATGCGTGCATATACGTGTGTGTGTGTG TCTGTGTGTGTACACCCACACGTGTGCA TGTGTGTTGTGTGTTTTTTAAGCAAACCT CAGTGTGTCATACATACTCTCCTATACTT CCCCTCCCTTGTTCCATATGAGGGTGCC TTCTTATCTCACAGGGTTGTTTTGTTTTTT TTCTATAACAGAATGCCGCTGATGCTCTT TTTTCTATATGAACCCTACATTTAATACTT ATCCATAAGCAAAGGAACAGTATCTTATC TTGCGGATC | p000992 | R | — |
| 231 | IM000849 | CTGGGGGCTCTGCTACGCGTCAAACGC CTGGAGAACCCCTCGCCCCAGGCGCCG GCACGCCGCCTCCTGCCTCCCTGAGCG GTGCTGCATCCTGCACGCCCTGGAACCC AGGAGCGCCCCAGCGACCCTGACTCCC TGCCAGCACGTCCAAGGCTGCTTACCCC AGCAACCTCCCATCCCCTGAGCCCCTCAG TAAATGCCATCTGTAGCAGCTGTTTGTCT GAGCGCCCTGTACTAGGGGCCGGTGG GCTGGGTGACTATGATAATGGAATAGTG GCTGTCCTACTGAGGACAGCACAGTACT GTTTGGGACCTGTACTGGTAAGGAATAC ATGCCTGCTTCCTCTGGACTTTGCGGGT CTCACCGGGTGCCTGGGCTACCCTTCTA GGCTTCACTGAGGCGGGTTCCCTGGGA GGCTCTGAGGTTACTTTCAGCGTCTGCC GGGGTCCACAGCACTTAGCCAAGGGG CTATGGATTCACTCGTGGTCTGCCAGGA CCAGGCTTGTTGTGAGGGCCCCAGGT GATC | p000993 | A | Saas |

TABLE 1-continued

| SEQ ID NO: | MUTATION | SEQUENCE | CLONE | CLASS. | GENE |
|---|---|---|---|---|---|
| 232 | IM000850 | GTGTTTCTTTTCTCTTTTTTCTTTTTTCT TTCTTTTCTTETCTTTTTTTTTAAATCTAA GTAAGGTGCAACAATGTAATTCGAAGGG GCAGTGTCTTCCCTTCCTGTAGTCTCTG CTTAATTCCTGAAGTTTGCCAAACCAGGA GTTAGGAAAAGTTGGAAACCTGCAGAGA GAGCGTTTGAGAGGTTTGAGATGTTATA CGAGAGGGTTTGGCAATGTGTGGAGTAC AGGTAACTTGCGGTTATTGTTTTCTTGGC CCTCTATCTTCATCCTTTGTGCTTGCTAT TTACCTTGCTGTCGGATC | p000994 | R | — |
| 233 | IM000851 | GATCCTTGAGTCTGTACTTAGCCTGAGA GCGCTATAACACTATATACAAAGTACCGA CTAGAAACTCCACACACATTTGTTGACTG ACTTAATGTGTAGCCCTGCAATGGTTGA CAGTTGGGGGTCAGGGGGCTCTTGCAC GAGGGTAGTGTATAGCCTAAAGAGATA TCAAGATGATAAGTACATCCACACTAG GACAGGAGCTTTAACAAGAGCTTTTAGT GAAGGGAACTTTCTGGGAGCCTCAAGGA AGGCATAT | p000995 | D | — |
| 234 | IM000852 | AGCAACACCTCATGTGGGAATTCATACA TTGTAGGTAATCAGTCTACTAGCTGAACT ATATCTCCAACCCAGGAGGTCAGGTTTG TTTGTTTGTTTAACAATCTAGTTTTGAAAC AGTCATATCCTAGGCTGGCCTCAAGTTA TGTAGTCAAAGATGGCCTTAAAAGATGA CTCTTGGTTATTTTCCAAGTGCTGGGATT ATAGATATGCACACCACCACACCTCATTT GTCTCGGGGCTGGACTCAAATCCAGAGC TTCATGCATGTGAGGCAAGCACTGTACC AACTCGACTTTTGCATACTCCATTGAAAG TCATTTTTATAACAGGATC | p000996 | D | — |
| 235 | IM000853 | CTACTTATCTATCATCTATATGTCTATCAT CTATCTATCTATCATCTATCTATCTATCT ATCTATCTATCATCTATCATCTATCATCTA TCATCAATCATCTATCTAGCATCTATCTT CCAGAGCTCATGTTGTGGCTTGGGCTTC TCATTTCACCATCATCGAAGGTAGTTGCA TTTTTTCTATTGGCTTCTTAGAAGCAGGA GGCACATGAAACAACTTGCTAACCCTTT CCTGGTCTTTTGTTGTTGTTGGTGGTGG TGGTGGTGATGGTGGTGCTGGTGGTGG TGGTTGATGTGCACAGGAGACCTGTCCG GTATGGAGATATGGAGAGCGTCTACGTC CTCATGGGATC | p000997 | R | — |
| 236 | IM000854 | GTGGGACGCGGAGGGTGGAGATGAATT GAGAAGCAGTTGTCGATTTCCTCCTTCTT CCAAACATCAAAGGCAGCGGTGGATGAC AAACTGAAGGACAGAGGGTTTGATGATG CAAGAGGAGCCAGCAGCAACCAAGGCC AGCCTCTTGCGGGTGTGGGCAGGGCCT TCTTTACAATGAGTTCACACACACACACA CACACACAGAGAGAGAGAGAGAGAGAG GAGAGAGAGAGAGAGAGAGAGAGAGA GAGACTGCTCTTTCAGAACAGCCCTAGG AGGTTAGCTTCAGACTAAGACAGGAGAC AGAGAGTCCTTGATTTTGCCAAGGTTGC ACAGCTGGGAGAAACCCAGCTATGGCT TCACCTTGGCCCTTGTTAGGACTCCTTC CTAGTCCGGTTGCAGTCTCCTGGATC | p000998 | R | — |
| 237 | IM000855 | GTATTAGAGGCCAGGCCATTCAGAAGAT GTGGCAAGATTGTCATGTGGAAAATATTT GAAACCATTGTAACCTAGTCATTCCATCA TCAATAATAATAATAATAATAATACTACTA AAATGAAAAAACCTAGATATTTTGAGACT GTACTGCTGTATTTTAAGAAATACACGGA AATTTAGCACTGAAATTTAGTGCTAGTTT TAAGAATACTTTGTACCGTTACTTGGACC CACAATTGCTTAGAGCAAGGGATC | p000999 | C | — |
| 238 | IM000856 | GATCCTGAGACAGTACAGGAACTTTAGAA GCCCTGGGCAATTTGCAGTGTGCACACC CAGCCTGAATTTGCCTGGTTCTCACCAG CCTACCAATAGAGCATTGTAGTGGCAGG GATGTCTGCTGGTGTCTCGCAGACAACT TTTGAGGTCCTGCTTCTCCAGAAGTGTG CAGCTGGCAATTAGCAGCCTGGTCTTTT | p001000 | D | — |

TABLE 1-continued

| SEQ ID NO: | MUTATION | SEQUENCE | CLONE | CLASS. | GENE |
|---|---|---|---|---|---|
|  |  | CCTGTCCCCAAGACCAGTGCTTCCACCA ACCTGGTCTCTTCCCACAGCCCAGCCCT TTCTCTTCCTCTTTGACACCCACTTCCTC TAAATGGTGGTCACATGCTTTGTCTCTTG AAAAAAAGTTGTATGAGTCAGGGTATTTT CAACGCCGGGACAGAAAAATTGACTCAA CCTGGCTTTTTCAATTAACCACTAATGGG TTTCACTTACAGTCCTGACAAATACCAGG CACAATTCATCCAGGACAATAGTGAAGA ATTTCATCTCTTCCCCCCAAGCCAGTCA GTCTGGTTTTAATATGCACGGTGGATAG CCCATAGCATGCAATGACTGTGAGCAC CCCTCTGGGAGTCAGCAGAGACACACAC ACAGGCACCCATACCACACACTGTGCTT TGTATCA |  |  |  |
| 239 | IM000857 | GATCAAAACAATATTCAAATAATGACATC AGTCAAAGTATGATTTGATGGCCATCACT CATGTCAATAGGCAACACATAAGCCTGA GAGTAAGTTAAGGAGAAATTCAGCAATA AACTAATTGACATACTATGTCCACTATGA GTAAAACCTGCCTCTCTTAAAACGTTTTA CTGTACTCCATGGCTCTCCCCAATGTG CGTTCGTGAGAGTCCCCACCCCTGTGAC TCCATCTGTGTGTGGGTTCAGGAGAGAC TCCTGTGTGTATTCAAAAGAGCCCCCCA TGTGTGTACACACAAGAGACCCAGTGTG TGTACATGAGAGGCCCCACCCCATGTGT GTTCATGAGAGACCCAACCCCTGTGCGT GTACATGACTCTCCCCATGTGTGTTCATA AGAGACTTGTGTGTATGGGAGACTCCAC CCTGTGTGTGTACATGAGAGACTCCTGC CTCTCCTGTGTATATGGAATACCTTCAGA GTATCAAATATTTCACCCACTGAGCCAT CTTAGAACTTCTCTCCCTT | p001001 | C | — |
| 240 | IM000858 | ATACATATGTACACACACACTCACAAACA CACATATATACACATACATACACTACTCAC ACATATATATACACACTAGTACACACATA CGCAAATACACACATGCATATACACGTA CTCACACATACATACCCATACTCACACAA ACACATATATACACACATACTCACATATA CATTCATACATACACACACATATATACAT ACACACACTTGCATACACACAGCACACA CTCACACACAGAGACACACAGACACACA GACACACACACAGAGGAACCCAAAGGAT TGGAAGAATAATTTCCTGTGCTCAGTGG GAAAGTTTACCAGAAAGACAAGTGGTCA TGTGGGATGATC | p001005 | C | — |
| 241 | IM000859 | GATCAGGGACCCTGTACCCTCCCCCGTG CAGCCTGTGATTC | p001006 | C | — |
| 242 | IM000860 | GGACTGTAACCAACTCGGAGAGGAAAG GGCTTATTTCATTTTAGTCTTTACAGTCC ATCATTGACGGAGGTTAAAGCAGGACGC TGCTTACTGACTTAGCTCCCCGTTGCTTT ATCAGCTACTTTCTTAATACAACGCCACC CCCGCGGCCGCCACCTCCCTAGGCAAG ACCCACAGGTCAATCCAACAGAGAGGAT TCCTCAAGTGACACTCCTATGTCAACGC TATCAATGGCAAAGGTATATTGAGCTAAG AATTGATC | p001007 | D | — |
| 243 | IM000861 | GATCTCAGGCTGCCCGTGGGCGGGGCT GACGGAGGGAAGCAGACTAGGCCTCTA CCATATCCGTGGGAGGGACTTCCAAGGA CCGAGACTGAAGAAACAGCGCGAAACA GGAGACACTGGGAGGAGAGGCGGAGAC CGACACTTAGTAG | p001009 | B | Mm.7675 3 |
| 244 | IM000862 | AGAGAAAAAGACTATCTTGACCTTTGGATA TGCGGGTGCAAAAATGAGAAGACCACAG TGCAGCTGTGTGCCCTGCACGGGGCAG CGAGAGGAGAAAGAAGCATTTTACATGA AGCACAGAACACGCCTGACAGTTCTCAA CAGCAGCACGTCAGACCACCGCAGCAC TGCTCGTTTTTCTCAGCAGACCCCCAGG AAGCACCACCCAGGATGGACATGTAGG GGTGCATCCGAGAGAATCAAAATCACAC AGGGGCCATCCTTTTGGTTCGGCATGAA TGATGGGGGCCGCCTGCACTGGCCTCC ACCTTCTATGGTTGTTCTTCCTTGTATCA | p001011 | R | — |

TABLE 1-continued

| SEQ ID NO: | MUTATION | SEQUENCE | CLONE | CLASS. | GENE |
|---|---|---|---|---|---|
| | | ATGTTTCAAAAAAAATCCTTGGGCTCACA ACTGCCTAATGACATCTTCAGGAGTCAA GTCAAGAAAGAGAAAAGTAGCCGACCTG GCACGTGGTAGATAAGACTCAAGGGTGC AATAAGCAGATGAACTGGCTTAGTTGGG CTTTCTATTGCTGTGATAAAACACCATGA CCAAAGCAACTGGGGCGGGGGGCGGG GGGTGTCATCTTACACTTCCATATCACAG TCTATCACTGAGGAAGTCAGGGCAGGAT TCAGGCAGGAACC | | | |
| 245 | IM000863 | GATCGGCCAACACAGGATAGATACCACA CAGGATAGGAGGTACAGTGTCTGGAAGA TTATTATCGAGCCCCTGAACGTAGTAGA AGCTGGCTGTCGTTCCAGTGCAAGCTGA GCAGATGGTCC | p001013 | D | — |
| 246 | IM000864 | GATCCACATGAAAGCCAAGCTGCACATT TGCTTCATATGTATGGAGAGGCCTAGGT CTAGCCCATGTATGTTCTTTGGTTGGTG GTTCAGACTCTAAGAGTCCCAAGGGTCC AGGTTAGTTGACTTTGTTGGTCTTCCTGT GAAGTTCCTATTCCCTTTGGTGCCGTCA ATCCTTCCTCCTATTCTTCAATAAGAGCC CGCAAGCTCCATCCACTGTTTGCTTGTG GGTATCTGTAA | p001015 | R | — |
| 247 | IM000865 | GCCTCAGCTACATAGTCAATTGCCATCTA GCCTGGGTATGCGAGATGGCAGTAAAGA CACTAGCTGCAAAGCCTTACTGCCTGAG TTTGATC | p001018 | D | — |
| 248 | IM000866 | GATCCAGTCACAGGAGAGCAACTGGGG GAGGGAGCAGGACAGTAGCACACCATA GCCCTTTCAGGGGGCCGGGGGCGAGG GGTGGACAAGAAGACAGATTATGACT CACAGGATGAAGAAGCCTCCCACAGCCC CTCCCTGAACTGGCCATCTGTTCTGGGG CCCCAGAGCAGGCGAGTACCGTGAAGC TTGGGGACTAGCAGCCGGACCACTGAA CAAGGTCAACCAGCCAGTTGTCCCACGA GGGGAGAAGCTACCATTGAACTGTCACT TTGGAAAGTAGCCAGAGCCCATCCCTGG TCACCACCCAAC | p001019 | D | — |
| 249 | IM000867 | GATCCCTAGAGCTGCTGGTCAGCTGGCC TGGCTGAAACTACTTCTGTGCAGTGAGA GACCCTGCCTCAAAACACAGATAATGGA GACAGATAAATGACATCGTCCGCTGTGT CTGCGTGTGTATATGTAACACAACACAC AGTATACACACATACACACCACACTCATA CCGTCACACATGCACTCTCAGTGCATGT GCTACACAACACAGTGTACACACATACA TACACCACACACATACACATACCACC ACACACGCGCACACACACATAA | p001020 | R | — |
| 250 | IM000868 | GATCCTTGTGCATCACTGAGCCATCTCC CCAGCCTACAGTGTAAGTATTCTATACAT ATTAATTTAATCCTGCCGGGTGGTGGTG GCGCACGCCCTTAATCCCAGCACTCAGG AGGCAGAGGAAGGTAAATTTCTGAGTTT GAGGCCAGCCTGGTCTACAGAGTGAGTT CCAGGACAGCCAGAGCTACACAGAGAAA CCCTGTCTCAAAAAACCAAAAAAACAAAA CAAAACAAAACAAAACAAAAATCCTATGG GTATTCTAAAAGTAAAACCGTATCATTA GCACTGCCAAATAACAGAAAGGAAGACC GCAAA | p001021 | R | — |
| 251 | IM000869 | GATCCTCTGAAAATGGAGTTACAGATGG TTGTGAGCTGCCATGTGAGTGCTGGGAA CTGAACTCGGGACCTTTGGAAGAGCTGC TGGTGCTCTTAACAGCTGAGGTGTCTCT CCAGCCCCTTTGGGTGTGTTTTGTTTTGT TTGTTTTGTTTTGCTTTTTCAAGACAGGG TTTCTCTGTGTAGCCCTGGCTGTCCTGG AACTCACTCTGTTAGACCAGGCTGGCCT CGAACTCAGAAATCTGCTTCCCAAGTGC TGGGATTATAGGCGTGCGCAACCACTGC C | p001022 | R | — |
| 252 | IM000870 | GATCCAATATATTCATATGGAGATACATG TATATACATAA | p001023 | D | — |
| 253 | IM000871 | GATCCAGGTCCTTTCCCCCTTATGGTCC TATACACCCCTGGGTACTTAGAGGCTTT | p001024 | D | — |

TABLE 1-continued

| SEQ ID NO: | MUTATION | SEQUENCE | CLONE | CLASS. | GENE |
|---|---|---|---|---|---|
| | | CAGCTCTGACTGGTGGTGTGGGGAGAA GTGAGGGGTTACACATGTGACACAGGTC CTAAAAGCTGTCGCCATTGGCACATGAC CATCCTAAGTCTGTGGCAGAAGGCTGCT CAGAGCCTCTGTCCAGGAACAACCCAAC ACATTGCAGAAATAACTGTGCATCTGGG CAATGGGGCAACTACTACCTGTCCATCC AGATAGCTCTTCTAGAGGCATTCGAAATA ACACGTAAAGTGGGGTGGTGATGAACAC ATATAATCTCAGCCCCTGGGAACCGGAG ACAGGGGAGTCACAAG | | | |
| 254 | IM000872 | GTCACAGTACTTGCTCACTTGCCTCTCTC ATGGTTTACTCGCCCCTCCTTCTCGTAC CCCCTTTCCTCCTACAATCCTCCTCGTCT ACTTTCATGCCGTATATGTCAAACACCGT CATATATAACAATGTATGCATGCAGCATT TCTTTTTCTTTCCCATCAGCCTCCCTTGC TCCCCATCCTCCCGCCCTTCCTCCTTCC TCCCAGGATC | p001026 | D | — |
| 255 | IM000873 | AGTTATGCTTGCAGACAGGAATGTAGCA TGGCTATCCTCTGAGAGGTTCCACCCAG CAGCTGACTCAGACAGATACAGATACCC ACAAGCAAACAGTGGATGGAGCTTGCGG GCTCTTATTGAAGAATAGGAGGAAGGAT TGACGGCACCAAAGGGAATAGGAACTTC ACAGGAAGACCAACAAAGTCAACTAACC TGGACCCTTGGGACTCTTAGAGTCTGAA CCACCAACCAAAGAACATACATGGGCTA GACCTAGGCCTCTCCATACATATGAAGC AAATGTGCAGCTTGGTTTTCATGTGGATC | p001027 | R | — |
| 256 | IM000874 | GATCGTGGTCTCTTCTCTTTTTTCCCTCT ACTTCTTCTTCTTCTTCTTCTTCTTCTTC TTCTTCTTCTACTGTCTTCTTCTTCTTCT TCTTCTTCTTCTTCTTCTCTTCCTCTC TCTCTGTCTTTCTCTGTCTGTGTCT CTGNCTCTCTGTCTCTCTATCTCTGTC TTTCTCTGTCTCTCTGTCTCTGTCTCTCT TTCTCTGTGNGNCTCTCCCTGTCTGTCTGT CTCTCTCTTTCTCTCTCTGTCTCTCTCTC TCTGNCTCTCTNTCTCTGNCTCTCTCTGN CNCTCTGNCTCTGTCTCTGTCTNTGTNTN TCTCTCGCTCTCTNACACACACACAGAT GTACATGCAC | p001028 | R | — |
| 257 | IM000875 | GATCGGCGGTATCATATTTTATGTGTTTT TTTCTGTGTCAGTAAGTTTAAAAGGCCT CAGATTGGAAGTCTGGTTTGCATGGAAT GCATATGAGCTTTTTCATCTTATTGCCCA ACAGATTTAGTCTAAGAACCACCTCTATT ATATAGGGTATGATAAGTAATATAGGTAA GGGAATGCATCCCATTTGATAAGTGAAA GTTGAACACACATAGAGTTGGCTCACCC CGGGGTCTAGGCTCTAATCCCCTGGGG ATACCCAGGCCTACTAAACGCTATAGCA ACAGGCATTGGGGCATGAAGATACTTTT TGTTGTTTGTCTTGAATTTATATAGGGGC TTATATCTCATTACAATTAATCATGAGTTG CAGTCAATAAATCTTCATTGCTCAACATA TTTGTACCCTCAAATATTTTTTCTTTTTT TGTGTGATAT | p001029 | C | — |
| 258 | IM000876 | CTTGTAAACACGATTATTTTAAAGATATA AATGGCTCTTTACTCTGTTTAAAAATTGT TTCTTTACCAGTTCTTCGTGTACATTGGT CTCCATTTCACATGAAATAAAATATTTTGT TTAATGTTAGATTTTCAATACCAGCTGAG TGTTCGATGTGTGCCTTTTGGACATATAT GTTGTAAAGTGGTCATTTGGGATC | p001031 | D | — |
| 259 | IM000877 | GATCAGATTCAACTCCCGCATTTCTAGC CCCAGCATCGTGGAAGGGCTACTGTGTC TTTTCAAGCACTATGGTGGATACACATAA TGCCAGCTTCCCTCATTACTGGTGATGT GAGCTGTTTGCCTAAGGTCCTCTGCC AGGCTTCTCTGCTGCCAAGGCTCTGAAT TTCCCTTTGTAGCTAATGCGTAGCCCTAT TGGCAGACTCTTCCCGTGGCTGACTTCT GCCTCCCGTCACACAGCAGTACCTTGTT TGTTCTCACCTTGATGTTTCTTATATGCA TTGATGATGGTGAACAGCCCAGCAAGTG | p001032 | D | — |

TABLE 1-continued

| SEQ ID NO: | MUTATION | SEQUENCE | CLONE | CLASS. | GENE |
|---|---|---|---|---|---|
|  |  | CGCCTGTTTCTTCCCTTCCTCCCACTTTT GTTCTCAGTTGTACATGGCAAGGAAAAC CAATTCTTCTCATATTTCTCCCAGAA AAAAAATCCTCTTTATAAGAGTTCACATC CTTGAGCACACATGATAGGAGCTGGTAG CCAG |  |  |  |
| 260 | IM000878 | GATCATGATATTGTACTGCTGAAGACAAA CATATTTAAGATATAAGACTTGGAGAAAT CAAGCTGGTATTGACATTGGAGATTAATC TCTTTTGGCTAGCTTTTGTAGAGCTAGAA GTTGGTATGTAAGCTATAAGGAAGAGAA GTATTCATAAGACTTACCCAGTTGTCTCT CCTGTAAGCTAAGACCAGCCTAAGAAGC TAAAATTATCTTTAATGTAGAACCACAGA GAAAGAAATTGTGGTATGAATTTTGCTTG TTCGTGGACATTAACCATTAACTCAATGA TAATCAAATGACAATACATAGAGACAAAG ATATGCATACTAGTAAAATAGTGATAA | p001033 | D | — |
| 261 | IM000879 | GATCGTGCTAGAGAATGGTACACTTGGG TTATATTAAGAAATCTTGGTTGAGTGGTG GTGGCACCCTCCTTTAATTCCAGCACTC AGGAGTCAAAGGCAGGCAGACATTTGAG TTTAAGGCCTGCCTGGTCTACAAAGTGA GTTCCAGGAAAGACAGGGCTATAAAGAG AAATCTTGTCTTGAAAAAAACAAAAAAAC AAAAAACGAAACAGTAACTGAAACCGAA AAAAAAAGAAAGAAAGAGAGTAAGAAA GAAAATCTTACAATGTGGGAGCTGGAGA GCTGGCTCAGTGGTTAAGAGCATTGGCT GCTCTTCCAGAAGACCCAGGTTCAATTT CTAGCACCCACATGGTGGGTCACACCTG CCTGTGGCTTCAGTTCTAGAGTCTGA CACTCACACACAAACATACATTCAAGT | p001034 | R | — |
| 262 | IM000880 | GATCCTGTATTTCTTCTTGGCTTGTCTCC ATAGGAACAGGCAGCACAGCAGAGGTCT GGGAGATGGCTCCGAGGGTAAGGGACC AAGCAAGGTCACCTGCGCTCACTCCCTG GAACCCACACAGTGGACAAGAGAGAAAG ACTCTATGGCCTCCACGTGCGTGCGTGC GTGCTGTGGTGTGCACGTGCCCCTCCC CCAAATAAAGAAAACTTAACGAAAAATAA TTAAAAGTAAAAAAACAGCACTGCAGTAG CTCCAGGAATCAACTGGTCAATCAGTGT ATCACATTTGACTATCCGATGATGGTTTT ATTTTACATGTATGCACGTGTTTGCATGT ATGTGGGTGCACATGTACAAACACATGT GCCAAGGCCAAAGGACAACTTTGGGTGT CCTTTCTCAGGAGTCATCGACCTTATTTT CTGAGACAGGGCCTCTCACTGGAATCTG ACTGGCCAGCAGCCTCCCAAGGATGCTC CCCAACCTCAGAAGGATGCGCCTGTCTC TGCCTCCCAGCCCCGGGGGTTACACTG GTGGACCACTGGGCTCTTTTCACCTGGG TG | p001035 | B | Mm.1388 34 |
| 263 | IM000881 | GATCTCTTCTTAAAATTACATTACAGTAG AAAATGTTTATGAGGCCGTTTTTATCTCT TATATTAWTATTACCACTCTCCTACCCC CAGAGTCTTACAGGCATCAGGGAGTGGA CAAAGGCCGGCGGTACTGAATGGTGAT GTTATTTTTGAAATAATGAAAAG | p001036 | D | — |
| 264 | IM000882 | TACCTGTTGCTCCAACATGGTCAGAAAT CAGTTTGTTTCAATTTTAAGATACAATGA GAGTAACACCCTAAAGACTTCACATTTTA TGCATATGCTACTCTGTGAGCACATGA ACGCTTCTCCTTGGGCACGATC | p001066 | D | — |
| 265 | IM000883 | GATCGCAGATACTGCAGGTATGTAGTAA TGAAGTCTGTAAACATACAGAATGGAGA AGGCCAGAGAGGAAAGTGCAGGCATTG GGTAGTCAGTAGGTAAAATAT | p001067 | D | — |
| 266 | IM000884 | GATCGCAGCTCTTCCTTGGTGCTTTTCC CCTCAGTTCAAGTGCTGTGGCGGGGAG GACTACAGAGACTGGAGCAAAAACCAGT ACCATGACTGCAGCGCCCCCGGGCCCC TGGCCTGCGGGGTGCCCTACACCTGCT GCATCAGGAACACGGTAACTGCATGGGT GCTGGATGTGAGGGTCACCCAGTTTGCC AAACACTGCCCTCACTCTGCCCAAGTGG |  p001069 | B | Mm.2811 2 |

TABLE 1-continued

| SEQ ID NO: | MUTATION | SEQUENCE | CLONE | CLASS. | GENE |
|---|---|---|---|---|---|
| | | AGCAGGCAGTGGGAGTGGGTGGGACGT GGTGGCCGGGGCTGAGCTTGCCTTAGA CCAGGGGCCCTAGCAATGGGAGATGAG TGGGCAGCTTCCTCTGGGAGTGTGTCAG TGAGCGTGTGCGTGTGTGGGCCTGGCC CAGGCGCTTTGGTTGTAGTTACTTGGTT CTTACAACAGCTTTGGAGGGTCTCAATT GGGGTAGTGTTGCTTTAGCCACTTAGGG GGACTTGCCCAAGGTTGGCAGGGCTCTT CCCAGCAACAGAGAGCCAGAGTGCCCG GCAGGTGCAGCAGGCTCTACCCAGTCA CTGGAGGCAGAGTACAGTGCAGGTGCT GTGAGCACTGGCAGCAGAGCCCTGGGC AGCGGCATGCGGTAATGTAAATG | | | |
| 267 | IM000885 | CCATGTCAGGTGATTAACCTGTGAGTCT AACTTCCAGGAATGCAATGCCTCTGGCA TCTACAGGCATAAACATACTTGTGGCTTA CACTCAAACTGACACACCAACACATATGT GCACGCGCACACACACACACCAAATT AAAAATAAAATAACCCTTTTTAAAAAAAT ATAGAACCTATAGATAATTGCTTTACTGC ACTCACAAACATTTTAGGATC | p001070 | D | — |
| 268 | IM000886 | GGGGCACATAGTGAGTTCTAGGATAGCC AGGGTTATAGAAGCTATAGTGTGAGACC CTATCTCAAAAAACAAAACAAAACAAAA AAACAAAAAAAACCTAAGCCCGTGTGGT GGTGTGTCTCAGTCTGAGCGCTTGGAAG ACAGAGGGAGGTGCATCTCTGAGCTTGA GGCTAGCCTGGTCTACATAGAGAGCTCC AAACCAGTCAAAGTAACAAAATGAAACTG TCTCAACAATGACAACAACAAACAAACAA GCACTAGAATAAAAAGAAGCCAGCATGG TGTCATGTGCCCGTCATCCTACCACTTG GAAGGAGAGAAGCCAGTGCAGGAAAATT AGGGATC | p001072 | D | — |
| 269 | IM000887 | GATCCCAGGCTTCCTGTAGGCTAGGCAA GCCCTCTCCCCACCCTGTCCTGGTAGAA TTCATCCCGAATGTCAGCATTCCTTCAGT TAAAGGAATGTGCTCCCTCAGGCTCTCT CCCATGGTGCATTGCTTCAGCACGCAGG CAGACACTTGTCCAAGCTAGGCTCCCTG TCTCCCATCTGTAGGAAATGCTTGGTAT GAAGGCCCTGGTGGACCTGGCTAGATG GGCAGCGCCCAGTGAAGGGCTGTGTCT GGAGCCTGGGCTGTAATTAGTGGTGA ACTGGGTGCTCTGGGGAGAGGCAAGTA AGAATTTGCTTTCTGTTTTTAGAGCAGGA GGGAGCTGGCGGCTGGCTGTGCCTTAGC CGGCTCCTCGAAGAGCATGAGGTGTT CGCCATCTTAATGGGTTAAGACTCTCCT GTGCTAATCTGGTGGGTTGCTTTTAGGC ACGGTGGTCCCACTGTGGTTGTGTGAAC AGTACCTTAATGCCAACACTTTGGAGGC CTAAGGTATCCCCATCTGCAGGAACTGG GGTGCACA | p001075 | D | — |
| 270 | IM000888 | GATCCTCACACAAATTGAGTAGTACTAAC AAGAGTGTGATTCACATAGTCAATAAAG GTATAGGCCATCTGTGCCCTGGCTTGAC CTCCGCAGACCAGAAGCTAACAAAACCA AAACAGACTCAGTTTCTGCATGCTAACTT AACCATGATTTTCCAGACTATTTCTTTTAT CCTGTGAAAAATATATTAATCTCTATTCT GCAGAGTATCCCTTCTTTAAGAGAACAT GATTTCACTGTTTTTGACAATATGCCTAG ACACAGAAAAAATCATTTAGTTT | p001078 | B | AA79335 6 |
| 271 | IM000889 | TTTTGAGTGCTCAGTGAACTACTTAGGG CAGCCTAAGGAATACAGTGACCCACCAG GAAATGCCTTGTGTTTTGGCAGTCTGATA GGATCACTCACAGCTGTCGGTCGTGACT TCATTGGATC | p001079 | A | Edar |
| 272 | IM000890 | GATCCAGGGACAAAGAGCCCATTCTCCT GTTCCTTCGTAT | p001081 | D | — |
| 273 | IM000891 | ACTTTCAGGCTAGCTCTTTGCTCAGTGA ACCTGCTACCACACACAGACTCCTCCTC CCTGTTCCCGTCGTTAAAAAAAGTTTTAT TTGAGGTTTAGAGCAATGGCTCAGTGCT CAAGACTACTTGCTGTTCTTACAAAGGAC | p001082 | R | — |

TABLE 1-continued

| SEQ ID NO: | MUTATION | SEQUENCE | CLONE | CLASS. | GENE |
|---|---|---|---|---|---|
| | | CTGGGGCTAGTTCCAACACCCACATGAT GGCTTACAATTCTCCAGTCTCAGGGGTT CCAGAACTCTTTTTCTGGCATTGAATGCA CATGATGCATATATAGACAAGCAGGCAC ACACACACATAAAATAAAACAAATCTT TTGAATGTAATTTTAAAAAGATTTATTAAT TTTAATTTTATGTGTATGAATGTTTTGCCT GCATGTATGTCTATGCACTGCATGTGTG CCTGGTGCTCAAGGTGTCTGATAGCCTG GTGCTGGGCTTGGTTCACTCAACAGCTG GCCCTATGAAGGCCAGCCGTGAGGACA CCTATCCATGCTGACAGACACAGATGCT CAAATGAGACAGCCCCTTCTCTATGAAT GCCCTCTTGAGAATGAACAACCTCCCTG CAGCAGACCTCCTTCTGGATACCCTGCC CTTCCATACTTTCTGGGTGTCTAGTTCTC TTCC | | | |
| 274 | IM000892 | GATCACACGCTTCACCTAATTACAAATGA TTCTTTAGAGGGGTCTGTATATAACAGA GATGATAAAATTCAACGGCAGCCCTCCA ACTGCATTGATATACAGGAAGTACTCATG AAATTGGAGACACTGATTATCTCTTTGTG TGGTGTCCACATATGTGCCATCATATCAT ATTATTATTATTACATGGCTAAAAAATGG GGTCATAGGTTTCATGACCAGAACCAAA ATATCCCCTGTAATTTACACAGGATTGA TGGTAAGAAATGAAAACAGTTTACATTTT TGATAATTACTTACTTGACATAAAATGT GACTTCATTTCCTTGCATTCCTTTTCAC AGGTAAGGCTACGACAATAGATTCTCAG TTCTCCACCTCTCTATCTTGTCTACTC TATCAGCAGCAATAGCAACAGTTTTCCAT GGTCCTTCCATCTGTAAAGCAATAAAAA TAACAAAGTAAACCATACAAACCATTAG AATATGAGTTGGTATTCACAACTCTCCTC TCAATACTTCATATTTAAAAATTACTAGA TATTCATCAATAATATTTCATTTGTTAG CTCTAGATAATGTTTCCAGG | p001083 | D | — |
| 275 | IM000893 | GATCATGGTTATTTTTGTAGGGTTTATTT ATACATGTCTACATGAATTTATGTGCACC AGATGTGTGCAGGTGCCCATAGAGGCCT GCGAGGATGCCAGATACAGATAGTTATG AGCCACCTAATATAGATGTTGGGAATTG AACCCATGTACTCTGCAAGAGCAGCAAG TACTCTTAACTACTGAGTCATCTGTTTAG CCCTCCTGTTGGGATTTAATGGTCAGTG TGAAATACTATGAAGATAGAAGGGTTTCC TAGACTCTGGTGTGTAGGGGTGGGGTAT CTGTGAGATGGGTAAGCTCTGTTGGCTT TCTAAGAAGGAGAATGAGCAGAAGGCAC ACATAGACATTCACACTTTCACACACATG CATGCCAAACACCACACATGCACACCAC ATACCACACGCGCCCTCCTGTTTCTTACT ATGTAATAATGTTCTTGTAATAACTTAGTA CTCTGCTAATGAAAAGGTCACCACTAACT AGATGCTAGCCTTCAACTTTGGACCAGA ACTATGAGCCCAAATAAACCTCTTGCATT TATAATTTAGCCAGCATGTAGAACTGTGT CAATAACAATGGAATAGTGTTG | p001085 | R | — |
| 276 | IM000894 | GATCATCTGGCTAAAATTTTATAATATGA CTCTTTAAATTCCTTAAGAATTCACAAGG ACCTTTATGTTGAAATTACTCATATGTAA GCTTACTGGAATGAGATGGCTCCCCAGT TGAAAACACCATTCTTAAAATACTCAGAA AATAAGAACGAGGCCAGCCCGGTCTACA AAGTGAGTTCCAGGACAACCAGAGCTAT ACAGAGAAACCCTGTCTCAAAACAAAAA CAAAAACAAAAACCTAAAAAAAAACAAAA AAGAAAAAAACAAAACAAAACAAAAAGAAT GTAGATATAAAGAAAGAATAGTGTTTGCT GGAAATAAATAGTAATATAAACTTAACAG CAGCCTGTCAATTGCAGGGTTTTTGCAC TTGCAGCTCAGAAAGAAGTGACCCTCCT CAGGAAGTAG | p001086 | R | — |
| 277 | IM000895 | GTGGGTTGTGTGACTCAGAGAGCAAGCT TCTACCTCCACAGGCAAGGATGCCTGTG CACACAGAAATGAGATGAAGTCATATGT | p001087 | D | — |

TABLE 1-continued

| SEQ ID NO: | MUTATION | SEQUENCE | CLONE | CLASS. | GENE |
|---|---|---|---|---|---|
| | | GGGGACTGGAGTTGCAGTGGCTCCCAG AAGGAGGTGTGCAGAGTTCAGGCTGGA GTCCAGATGAGGAACATCAAATAGAGAG GCCTTTGGAGGGAGTGGGTTCTCTTGAT AAGTAGGACTGCCACCCATATCAAGTAT AAGACTGCCAATCATACTGAATCTCAGG TTATTTCCCATGTAGCATTGGGAACATAT AGCATTTGTCACACTGCTATAGCAAAGAA TCTGTGATGAGGTTGGGAGTGGAGGGG AACGCCTTTGGTCCTAGAAAAGAACCA AAGGTAGGCTGATC | | | |
| 278 | IM000896 | CCTGCCCTTGCCAGACCCGACCGCAGC TCATCGAGGAGGTACCCTCTAAAGTCGT CACCTTGAGGAGACAAGCTCTGTCATAG TGCTCGCAGCCCCGCGGCCCCTGCGCC AGGTTGCGGACGCCATCTTCCCGCGCC GTCGCCGCCATCTCCTCCTCCTCCTCCT CCACCACCTCCCCCTCACCTGCCACTGA ACCTTTCCCCAGCTTGGAAGCCACGCC TTAAGGAAGCAGAGTCGGTCGGACACCC GCTCCTCCTCAGAGCAGCGGCCACCAG AGTCAGGAAGGGGGGTCCAATCACGT GATC | p001088 | R | — |
| 279 | IM000897 | GCTCAATTAGTTTATTTAAATTCAAAACA AAGCTAAAAGCCTGATGTGTCAGTTGCCT TCAGCAGAGCTGTTTGGGGCCCATTGTT ATGTTGTGAATTAAGTTCTGATGTAAGT AACCAAGCCACTCCCCACACTCTTACTT GCAAGAGTTCCAGGCAGATGTTAAGGTC AACCCACCTGACTCTGATC | p001089 | D | — |
| 280 | IM000898 | GATCACAGTGTTTATCTCAGCAACAGAAA GCAAATGAGGACACACCTGGGTCTCACT GATATACTTGGTGATATGTGTAGTTATTA TGTCTCACAGTAATTGGACAAGGAAGAG AGTTCATTGTTTTAGAATGTTGTTACTGG CATTGTTCTTCTCTCTCTTGTTTTCATAAA ATCTCACAATATCTACAGCTGTGAGGTC CAAGGGGCTCATTGGTGATACCCACTCT TTCTACTTTGTGTGACCAACCTCTTTTGG ATGTCAAGGGT | p001091 | C | — |
| 281 | IM000899 | GATCAGTTGCTATTGCTTGATTGATTGCG AGACTTTCTTAACAAGAGTCTTTGTCTCC TCTCACTCCCTAGCTTCATCTTAGAACTT AAACCCACAGCCCAAATGAGTAGTTGTA TGTCATATGCCTCGGCCAAAGCACGACT GAAAGGAAAAGAAAGGCAGACACTGGA GTGCAGGAAGAAGACACAAGGCAAAGC CCAGAATTCAAAAGTAGAAGCACAGATT GTTTTCTTTGTTT | p001092 | C | — |
| 282 | IM000900 | GTACCCTGCATCCCCGGTGTGGCCTTGG AGTCTGATGCCAGCACTACAGAGCCAAG CCATAATACTAACCAAATAGAATTAACAA GAGCTCCATATGATC | p001093 | D | — |
| 283 | IM000901 | GATCACCTTCCTAGGATGAACGAAGAAG GATGGCTGGAGGTTAGGGACCCAAGGG ACTTCCCCCTAGAGCTGGCTGTGTACCC TAGGCATGTGTGACTGCAGCTGTACAAG CAGGGTATTCTGGGATTCACAGTCCTCA GGATAAGATGACACTACAGATTCTAAGC TTTATACCCAACATGGTGGAACCCCATG GTCACACTCTTTCACAGATGGTCACTCC CATTGCCCGAAGCCCAGCCTTTATCCAA G | p001094 | C | — |
| 284 | IM000902 | GATCAATAACAGCAAAAGAAAAAAAGAA GTACTTTTCATGTAGCAATGTGGATAA TTCCCATCCAGAGAAACAAAACCAGTTC CAG | p001095 | C | — |
| 285 | IM000903 | GATCAGGGAAGATGTCACCTCCAACCCA GCCTAGACATGGTGCTGTGACCA | p001096 | D | — |
| 286 | IM000904 | GATCAAGGAGCAACCCAATAGCTTCTAT TCCCCCCTACTAAAATATGACCCACTG ATGGATTCTGGGGATGCACAGATGTTCT CAGAAGTTACTGATGAACACACCATGCT CTAACAAATAGTATCAAACCCACAGTCAC AGATGGCCCTAGTTAAGCACAGTGCATC ACAAAGCAAAGCAAAGAGCCTTGACTGT GGGAAAGGTACTTGTGGTGAGGACTAGT | p001097 | R | — |

TABLE 1-continued

| SEQ ID NO: | MUTATION | SEQUENCE | CLONE | CLASS. | GENE |
|---|---|---|---|---|---|
| | | GGGGTATGAAAGAAATTAGAGAGGATGA AGGTAGTGATATTCAGTGTGTGTGTGTG TGTGTGTGTGTGTGTGTGTGTGTGTGTG TGTGTAAGACTATTAAAGAACACCCTTTT TTAAAGAAAGGCTTTCTTGAGTGTCACC | | | |
| 287 | IM000905 | GGTTAATAAGCTAGATTATCGTGTATATA TAAAGTGTGTATGTATACGTTTGGGGATT GTACAGAATGCACAGCGTAGTATTCAGG AAAAAGGAGACTGGGAAATTAATGTATAA ATTAAAATCAGCTTTTAATTAGCTTAACA CACACATACAGAAGGCAAAAATGTAACGT TACTTTGATC | p001098 | K | Myc |
| 288 | IM000906 | GTGAACGACAGCAGAATCGGGTTGTACC TCAAAGCACTTACCTTTCCCAATACACCT GATC | p001099 | D | — |
| 289 | IM000907 | GATCAGTGACAATGTAGCTTTGCCTGGA AGGATACTTGAGTC | p001100 | D | — |
| 290 | IM000908 | GATCAGCAAAATGGGACATCGAAGTTGA ACCAAAGTCATTATAAAACATCCTGAGGT ACATAAACACTCTGTAATAGACTAATACA GTTCCTCCAGGCACCAACAGAAACCTTG ACTACTTCCCTTGACTACTTCAGTCAAAT CTTCTGATAAAACCAGACCCAACTTGGA AACGTCCATGTATACTATG | p001101 | D | — |
| 291 | IM000909 | GATCATCTGCTTCTACCCCCAATTAAAAG ACGGACTAAGAACATAAAAAGAATCCAG GCACCTAGGTTTGCAGAAATCTAAAGGT TGAGTTCCTTT | p001102 | D | — |
| 292 | IM000910 | GATCACAAGTTATAGTTGAATAACAAGTC CTGTGTGTGTCTATGTATCCGTATATCAT ATTTTCTTTATCTGTTACTCTATTCATGGA AACTAGGTGGATGTGTTAACTTGGCTATT ATGAGTTTTGCTGCTAT | p001103 | D | — |
| 293 | IM000911 | CTACAATGGTTCAGGCTTTGGAATATCAC TCTATAGGCTGTCTGCCGGCCACCACCC TTCAGACTGCCACTCACAGGTGCCCGTG AAGGCTGCCGAGAGGCAGTCCCCATCA GCCTGTCTCCTACACCCACACACTCTGT GTGGAGACCACAGGCGCCCAAAGGGTA TGCTAGTCTCTGCTCTACCGCGTACCCT CTCCTGAAGGCAGGCATTTCAGAGATTC CAGTTTCACCAGGAAGCTCAGATC | p001104 | C | — |
| 294 | IM000912 | GATCTTTTCCCCCTTTGTAGTATCAGAGA GAAAAGCCATGGCATGCATGGCACATGC TAGGCAAACACTCAAGCATCCTACTCTG TGATGCAGTTTGAACAACTTTTTTTTT CTTTTTCTTTCTTTTTTCTTTTTTCTT TTCTTTTTCTTTTTCTTTTCTTTTTTTTT TTTTTGAGT | p001105 | R | — |
| 295 | IM000913 | GATCTCTCCCCATCCTCCTGTTGCCTCTT GTCTGTCATACCTCTACTACTCCATCAGT TTGCTGCCTCTGAGTCCCTCTTCTTCCTC TCCTATCCCTCCTCCCATCTTCCTCATCT CCAGGTCTCTCCAGGTCTTCCTTCTTCC CTCTTTTCTTCCCCTTTTCCTCTTTTCCACT GTCTTGTATTCCCTTCCTTTCTCTGTTGG TCCCTTCCCTCGCACCTCTTTCCTCCTGT CCCTCCTTTTCATGTACCATATTTCTCTT CCTCTTTCTGTGTCTCCTCTTTCCTTCCT CCTTTACTTTCCTTCTAACCTTCCTCTTTC TCCTCCTCCGGCAAGCCTTTGCTT | p001106 | A | Gata1 |
| 296 | IM000914 | GGTTGTTCCAGTTAAATTGGCTCTCTACA GGAACATGGCTTAGTTCTCCCTTAGCCT TTCATGACCCTACACCTCAGACACTAGT CAAAGTCTAGCTTAATAAAGTGTTCAGGA TGTTGGTGGAGGGGGGAGATTGTTAAT ACAGATC | p001107 | D | — |
| 297 | IM000915 | GGACCACTTTAGTATGGGTCATATGTTCT AACTTTCTTTCATTTTCTAATTCTTTCCAT CTGCATTGATTGTGCCCAGTTATCATTAG TGACTTATTTTAGTAACTTAAGGGAAAGT TGTCTATGCTCTACTTAGTGTCGATTTAA CTTACTCTCCAGACATGGGAGTGCTTATT TTTGTTTGCCTTACCTCATCCAGGAGCTT GTAGATC | p001108 | D | — |

TABLE 1-continued

| SEQ ID NO: | MUTATION | SEQUENCE | CLONE | CLASS. | GENE |
|---|---|---|---|---|---|
| 298 | IM000916 | GATCCGATTATGAAACCGGTTTTGAAC | p001109 | D | — |
| 299 | IM000917 | GATCTGTGGAATGCTATCCAGCTCTTCC AACAAATAC | p001110 | D | — |
| 300 | IM000918 | TTAGTATCTGCATCTGACTCTTTCAGCTG TTCGTTAGGCCTTTCGGAGGGCAGCCAT GCTAGGCTCCTGTCTGCAAGCACACCAC AACATCAGTAACAGTCTCAGGGGTCTGA GCCTCCCCTTGAGCTAGATC | p001111 | R | — |
| 301 | IM000919 | GATCTGTGGTAATGATTCTGTAAATACAG ATAAACAACGTACACATGGGAATTGTTCC CTGTGTGAAAGTGTTCATCATAAGGTGTT TTTATTTTATCTACAATATCTTTGGGTTTT TAG | p001112 | D | — |
| 302 | IM000920 | ACTGCCACATTCCCTAACACCTCATCAAA GAAAACAACACCACAGGTCTCAGGCTGC CACTCTAGACCTCCGAGTTGACTCTGGC TCCTGCTCTCTGCTAGCAAACACGCATC CCTCAAGTCTTCATGCTGGTTCTCTCAAG TCTTCATGCTGGCTCTCTGTAGTTCTGTA AGCTTACCCTTTCAGTGGTGATTTGGGG AGATC | p001113 | D | — |
| 303 | IM000921 | GATCTCCTGGCTTTGTAGATAAATGTAGA GAGTTCGTTACCAACTGAACTAAAGAGC GGCACAGGAAATTAAAAAAAACAAACAA ACTGATAGTTAACTCAATTGAGTAAGTAT GGAGTTTTGGGACCAAGACATATTAGGC AAACAGACAGTTTAAGGCCTAG | p001114 | D | — |
| 304 | IM000922 | GTTCCTGTACTTTATCATGTCTTACCCCT ACCTCCCTCCATTTAATCATCTTTACTG GGATGTAATGCATTCCTTTGTCCATTCCA GGATGCTATAACAAGATACCTTCAGCCT GTAAGCTATAGAACAGTGTGGTCCTCAA CCTTCCTAACTGTGACCCTATAATATA GATC | p001117 | D | — |
| 305 | IM000923 | CCANCGTGCCANACTCANAANGGAATTT TATTCATAGATTCTNTCANACTGCTGTCC CACATGTGTTCAAAANCAGGTAGGTCTT GTCANAT | p001119 | D | — |
| 306 | IM000924 | GATCTCATTGCACACAGAAGAGTTAGAAGA AAGAAAGAAAAGCAGACTGGGAAAAATT TTTGCAGCGAGCATTCAGAGATTGAACA TCTATCTAACTTATGCAAAATTCCTATCA AAAGAAAAAAAAAGCTTCAACAGCTGGG TAAGTTAAAATGTAACTATAAGGCAACAC AAGGCAAAGTGTTGTTCTTTTTGCTTGTT TCCGAGATGAGCTCAATTAAAAATATCAAT AGCGACTACAATTCTGAGCTGGACTAAC GAGTAGTTACAATACTACCCAACGCT TGTGGTTAGGTAACCTTACACAATATTTT CCTAATGCTATTCGGCAATAATTGTCAAG AAAA | p001121 | D | — |
| 307 | IM000925 | GATCTTTTCCTACAAGACTTCTGGGTGAC CTTGCCAAGCCCAGCCACTGGCTGTGGT ACCTCACCAGGACACTCGGTGGACATTA GGTAGTGCTCCCCAAGTGCTAGGTGACA GTTTATGCTTCAAAGTGACTCCTGCAC | p001122 | D | — |
| 308 | IM000926 | GTGCTGACGCGCCCTTGCATTTGGGAGA GCAGTCAAGCTATCTGTACCTTCACCGT AAGACTACATTGTCACTGCTGGCTTCCC TCCTGTGCAAGGGACGCATTTGGGTCAG ACTATGCATGAAACAGGACAACAAAGGT AGGGCCATTGGTAGATC | p001123 | D | — |
| 309 | IM000927 | GATCTCACTGAATATAAAAAGACATCAGT CCAAGGGTGGAAATTTAACCAAAATAATA CAATTGTTGTTG | p001124 | D | — |
| 310 | IM000928 | GATCCTCCAGGAACTAGAGTTACAGACA ATGCCCGCCTTGTATT | p001125 | D | — |
| 311 | IM000929 | GTGGCAGTGACTGTCCGTGTGGGAAAC GTAGCAAGTCCGAGCGTGTTCGATC | p001127 | K | Nmyc |
| 312 | IM000930 | CAGGAGAGTGTCTCAAAAAGCAGCAAAG CACCCAGCACCTTAGGGTGAAGGACCAC TTCTGGAATGTATCCTCCCAGTTGCAAAT GTACACTGTCTCATTCACTCCTGTGACAT ACTTTGTTTGTGAATGCTAATATCACATA GTTCGATC | p001129 | C | — |
| 313 | IM000931 | CCAGCAGAGACCAAGCATCCAAAACATG AGCCCATTTCAGGCTTCAACCATAGCAG | p001131 | D | — |

TABLE 1-continued

| SEQ ID NO: | MUTATION | SEQUENCE | CLONE | CLASS. | GENE |
|---|---|---|---|---|---|
| | | CTCCCATCTCAATCCTGTTCACCCCCA CCCCACCCCCGCTTCTCTATTTAAATCA CCACTCTCAGTGACCAAAAAGATGCTCA TGGCAAATGGACTCTTGGCTCTCTTTTAC CTAATACTGAAGGTAACAAGATAATCAAC TGTTTCCTCTCCTTCCCGGGGACCTCAT CATACAACATTCTCCCACATGAAATTATC ACCACGTCCTATACCCACATCCTCCCCG TCCTGTAGAGAAACCACATGCCTAGCAG CAGTGGTTTCCCACCTCTGTGCTCCCTT CCACCTCGATC | | | |
| 314 | IM000932 | GATCGCTGTGGTTGGTGTCTGTGTATAT GCACTGTACATACTAACCAGGTACACAC TAAATATTTAATATATAAAAAATAAAGTG CTTTCTAAGAGGCCCCTAGGCAGGGACG ATAAAACATTTCACAAAGCAGCAAAAC TTGATACAATCAAAAAAACAACACT ATAACCAACATAGGTGAAAACAGCCAAA CACATAATGTACAATCTGGTGTTGCAGG ACAAACATCTGTCATATACATGGTATATA CATACATACTTTTTCACTCAATAA | p001132 | B | Mm.36692 |
| 315 | IM000933 | GATCGCTAAGTGTGCGCGGCCGCCGTC TGCAGAATGAATGGAGGGAATGAATGAG GGTGCGCGCGCCCGAGGCCCGGCTTGC GTCAGCCATGCGTGCCCGGCATGGACA CGGCCTGGCCTTCCTGGGAGGATGGGA CCGGATGCAGTTAGTCCAGGCGTTCAGC ATCCCAGGGCCCTTCCTCTGTTGCGTGG TCTGAGTAATCTGTCTCGCAGAAGATAC CCT | p001133 | B | Mm.151528 |
| 316 | IM000934 | GGAGGTCTCTGTAGGTGCTTAGACTCAC GTTACAGTCATTCCAGAGGAGGGAGCTG CAGCTGCTAGTTTCTGTGCACACCGATC | p001136 | D | — |
| 317 | IM000935 | GATCGGCTGTCAAGACTGGGGAAGGGT CCTCCTAG | p001138 | D | — |
| 318 | IM000936 | AAGCAAGAGGTAATAAAATACATGTGGA TGGATGACTCAGGGGTTCAGAGCATACA CCGATC | p001139 | D | — |
| 319 | IM000937 | GATCGGGGACCTTGCATAAAGGGGTCCA GGGCTCTCAGTCCTTGGGAAGG | p001140 | B | AA709647 |
| 320 | IM000938 | GATCGTGATGACTTCATAACCATCACGT GTGAAAAGACTTAATGGCGCTGAATTCA CATGACACTTAAAATGCACAAAGTAACAA ATTTTATGTCACATGTATTAAACTACAGC TAAGTACATGGGGAAAAAGTTAGACTTA GAATAACTCATCCAGAGTCATATGGTAG | p001141 | C | — |
| 321 | IM000939 | GATCGAGGAGTAACCCAATAGCTCCTAT CCCCCCTTACTAAAATATGACCCCACTGA TGGATTCTGGGGATGCACAGATGTTCTC GAAGTTACTGATGAACACACCATGCTC TAACAAACAGTATCAAACCCACAGTCACA GATGGCCCTAGTTAAGCACAGTCATCA CAAAGCAAAGCAAAGAGCCTTGACTGTG GGAAAGGTACTTGTGGTGAGGACTAGTG GGGTATGAAAGAAATTAGAGAGGATGAA GGTAGTGATATTCAGTGTGTGTGTGTGT GTGTGTGTGTGTGTGTGTGTGTGTGTGT GTGTGTAAGACTATTAAAGAACACCCTTT TTTAAAGATAGGCTTTCTTGAGTGTCACC | p001144 | R | — |
| 322 | IM000940 | GATCGGGCCACATCTCAGACACTCCTAT AGCTACAGAGAGATACCGTTTCCTGTTAT CTGCAGACAACTTTATCTGTTACTCAG AGAAAACCTCCAGGTGCCCCTAAAGAAA CTGGGCCCTACATCACATACCCATACCA CACACATGCAACATGCAAAACATACACA CATACATAGACACACACACCACACGCAC ACAGACACATACAGACACACACACATAC TATACATACAGACACACATATGCTACACACA TACAGACACACACAAGCACACATACTTC ACACACAGAGACACACACACCACACACA CACAC | p001149 | R | — |
| 323 | IM000941 | GCCTGCCTCTGCCTCTCGAGTGCTGGGA ATAAAGGCGTGCTAGAGCCTTCACTTGG CTCTCTCTCTCTCTCTCTCTCTTTTAACC TCCTTTTTCCTTTAATGAGTTATTTATTTT TATTTTATGTGCATTTGTGTTTTGCCTGT TCCGATC | p001151 | R | — |

TABLE 1-continued

| SEQ ID NO: | MUTATION | SEQUENCE | CLONE | CLASS. | GENE |
|---|---|---|---|---|---|
| 324 | IM000942 | GCTTCAATATTCGAAAAGTATTAGTAAGA AAGGCTGTTCGATC | p001152 | D | — |
| 325 | IM000943 | CTACCAGGAAGTCAGGGGTTTCCAGGAA CCCACACTTGGCTTCCTCTGCACAGAGG GACCTCATACCAGTGAGATGGTGATATG CTCCCTTGTTCCTGAGCCTCAGTGGAAG CGACTTTCTATGGATACTCCCTCCCTCGT GCCTCTCCTTCTTTCCCTCTCTGCTCTCC CCCCCCCCCCTCGCCCTCACGATC | p001154 | D | — |
| 326 | IM000944 | ATACACACCATCAGATATACCTCATTCTG TATACCTACAGGTACACCAATCACACAC ACACATTTACTCACATGTACATGCACACA CCACATCGGTTAGAACCAAAGACCTCAC ACACACCCCTCACACATGTTTCATCTCCA TTATCAGTGCCGATC | p001155 | D | — |
| 327 | IM000945 | GATCGTCAGGTTATGAATGCCAT | p001156 | C | — |
| 328 | IM000946 | GTTCTCAGAACCAGCTACTGTTTACACA GGGCCTCATGCAGCCTTGCTGTCCTCCA TTCTGCAAGCACAGGATACACACCCCTG AAGGCCAGATTGTCAGGTCAGCCCGATC | p001157 | C | — |
| 329 | IM000947 | CTTCAAACCGGTCCTGCGAGGAGTCCAC AACCTCTGCCTGCCGATC | p001158 | D | — |
| 330 | IM000948 | GATCGAGGCCAGCCTGGTCTACAAAGTG AGTCCCAGGACAGCCAGGGCGATACAG AGAAACCCTGTCTCAAAACAAACAAACAA ACAAGATTCCATTGAGGAACACCCAGAT GGAGACATGGGTGTTCTCCATAGAAGGG TTAGGGGCTTCCACACCGTTGACAC | p001159 | B | Mm.8136 6 |
| 331 | IM000949 | GATCGGTGTGCTTTCTGCAGTTTCAGCG AGGACTCTGGGCCCAAAATGTTTTAAAG CAGAAAATTGGTAACACTAGAGATATTGT CAAAATACGATTTCCTCTGGTTCAGAAAT GGCGAGAGGGAGGGCTGGAAGGGTGG AGTGGGAAGGAATTGTCATCAAAGCATT GTTGATAC | p001160 | B | AA40894 5 |
| 332 | IM000950 | CTGTCTCAGGCATGAAAACACTAAAAGA TGACCAATTTCAATAAAGATGACCTGAAT GTCTACTCAATTCCCACCATTAGGTCTAC AAGATGTAAATGGGCCGATC | p001161 | D | — |
| 333 | IM000951 | GATCGTGGAAACAGAGCCTTGAATATAA TGAAGAAACAGAGGGCAGGCAGCAGCC GCAGCACAGCAGGGGCACTGTGAGCAG GCAGCAACAGGGGG | p001162 | D | — |
| 334 | IM000952 | CTCCCTACTACCTTCCCTTCCTGGACNT CCACTGAGATGAGGCAGGATAAAGGGTC AAAAGAGACCTGACCTTCTCTGCCAAAG CCAGGGATTTCTGGAAGAATAGAAATGG TTCTGGAATTCACAGATGCAGTGGTCTA GGATC | p001163 | C | — |
| 335 | IM000953 | GATCCATAGGTCTCTGCTTTCCCCATTCA GGGCTGGAGTTATAGATATCTGTCTATC ACCCAGCTTTTATGTAGGTTCCAGG | p001164 | D | — |
| 336 | IM000954 | TATGTATCTACAAGCCAGAAGAGGGCAT TGGATC | p001166 | D | — |
| 337 | IM000955 | GATCCGAGTTCTCTCCGGCCACGTACCT TCACATCCCATGCACCCTGGTATGTAAG AAGAGCCCAGCTCAC | p001167 | D | — |
| 338 | IM000956 | TCCCATAATATTTCCTCAGAAGGATC | p001168 | D | — |
| 339 | IM000957 | TATAGTTCTGCCTGTGGAGTGTGAGCAG AAATGTGTATCGTTTCTGGGTCAGAGCTT TCAGGAACTGAGCATGACTGCTCTACAG TGTCTTTCTCCTTCTGGCTGCTGTAGCC CTAGGGGACAATAGAACCACAGGATGAA AGGACTCGGGATC | p001169 | D | — |
| 340 | IM000958 | GATCCAATGGCAGCTAGCAGAGTCAGAG AGCCCTCACTCCAGTTAACTAGGGGACC CACATGAAGTTCAAGCTACATATCTGCTA CAAATGTTTGAGGGACCTCCTAGCTCCA CGCCACATGCTCTTTGGTTGGTGGTTCA GTCTCTGTGAGCCCCACTGGGCTCAGGT TAGTTGACCTACAGTCTTCTTGTGGTATC CTTGACCCCTCTGACCCCAGAGTTTAAC AATAGGCCTTCTGACTCTAGAAATCTACC TACATTTTTTCCACTTTAAATTCCTCGGC TCACATAATACCAATGAACT | p001171 | R | — |
| 341 | IM000959 | GATCCATCTGCACAGTCTGTCACCGGGG TCCAGCAAGTAGCAGCCTTTCTGCTGCT | p001172 | K | Pim1 |

TABLE 1-continued

| SEQ ID NO: | MUTATION | SEQUENCE | CLONE | CLASS. | GENE |
|---|---|---|---|---|---|
| | | GTCTGTCAGACCCTCCAGGGAGGGAGA GCTTGTCTTCTGGCCTCCCAACAGGACC CTGCGTGACGATGCAGGGACAGCAATG ACAACTCATTCCAGACTCCAGGTCCCTG GAGGAGCCTCCCACAAGGGAAAGAGAC TACTTCACTGGTCCTGGGCCCCTCTTTG CGCGCCCCGCCCCCAGACTCAGCGTCT AGTGTTGCTGGGCTCCCCT | | | |
| 342 | IM000960 | GGGTAACAGGCTTAGTTTGGGGCCTTT CTGTTACAGGAAAACCATGAAATGTCCT GAAGTGCTCAACAAACAGGGAATATAGA TCATAATGGTTCCTCCCTAGCACAAG GAAGCATGTTTAAAAATTGCAGCAAAATA AAAAAGAACAGATTCTTAAGATTGAGGG ATTTTACGGGGTGGTACTTTTTCTTTCTC TTATAAACATTTATTTACTTTTGTTATTCA AGACAGGATC | p001173 | D | — |
| 343 | IM000961 | GATCCAGCTGTTTGCTAACATACGTAAA GGTATGGATGCTGAGAGAGTATCTATCG AAAGCGAAGGCACCCTCCCCAAATTCAA GAAAGCAGCTGTTTCTAGAACCAJAGAC ACCACCGCCGCCGCCGCCACCACCACC CGCGAGGGCCCGGACCCTGTTAGAGAG TGTC | p001174 | C | — |
| 344 | IM000962 | GATCCTGAAATTATCACATTTGAATCAAA TCATGCCCTGCCGAGGATAAATAACCCA AACGACCGAGAAAACCGAGAAAAAGAAC ATTTACTGACCATCCTTC | p001175 | D | — |
| 345 | IM000963 | GATCCAGTCCAGAGCAATGTTCACGTCT GTGATGGTAT | p001176 | D | — |
| 346 | IM000964 | AAAGGTGCTCTCAATACTTAACAATCCAT AAGCTTGTGCTCTCTTAGTCGTAAAGGT GGGGTCCATCAAAATCCCATGACACCAC AGCGAGACCAAACTCCTTTTCTCTTACTC CGAATCACCCATCCCATGTGGGAGACGA ATAAGAACACAAACTACATCTTCAGTGAC ATAGAGTAGCATCTGCAACAGAGGAAGT GGATGGAGACCTTGTCTCTGGTCATiAGA CAAAGCATGTGACAGCTGAGCCTGGCAC TTCCTACTTGGGTCACAGCTCAAACCCA CCTGAACCAACAGCAGAGCCCCACAGG GATGGGACTCACATGTTTCCCTCTTGCC CTGGAGCTTCGTGCATGTTGTTAGAAGC TAACTGGCTAACACGCACGGGAACAGGC AATGTAGTTGGAGTATGAATCGAAGTCA CTGGGCATGGTCCTCAGTCAGCCAGGAT C | p001177 | C | — |
| 347 | IM000965 | CTAGACTAGTATGGCAGAACCTATCTTCT TCTAATCATTTAGATGAATACTCCACATG AGAGAGCCCTGAGAATATCTGTAAAAAG TAATCCAGGTTCTGTTACTTCTAGCTAAT CTTATCTAGGTAATAATAGATAAGGAATC GGGATTCACGAACACAAATACCTGTACA AAGCATGTTGTCTCACACGGGACGAACA CTGTTTCTGCTGTGCTTTATAACGCTGG GACATACAAAACTAGACTCTGCCTAAGA AGTGTTTGGAAACATGGGTTAAATTAT AGTCAGATAAAACAACAACCATGAGTAAA TCGAAGAATATAAAACTAGGGATC | p001178 | C | — |
| 348 | IM000966 | TTTCCTGGACAATAATGTTTTCTTCATTAA ATTTACACTTAGAGCATTGTCTTAATCCA TGAATAATTCCCAGCTCCTAGCTCATTAC CTGTGACACAGCAGGGATTCATACATTT ATTGAATGAATGGATGAGTGAATGAATAA AAGAATGAGCATATCAAGAGGATC | p001179 | D | — |
| 349 | IM000967 | GATCCCTTCTGTCTTTGGTTATCTC | p001181 | D | — |
| 350 | IM000968 | GATCCACCACTGAGCCACTTCTTCAGCC TGTGACTGTCATTCTTAATCATCCACACA GACTTCTCCTTGGCAGATTTTGCCCACC TCTTAAGACTTTCACAAAGGTTTTTTCTT CTGCAGGGCACATGAGAAAACAACTCTG TCATAAAGAAACCCAGGAAGAAAACCAG CAGAGGCAGGTGAGTTAAGCCTGTGGT GGACATTCCTTCTGGGGATGACCAGATG GGAACAGTAATTCACAGAGGCAGAGGG GTCTGCAGTCACTCTGCATGCCACATGT GTAACCCTTAAGAAGTGAGGAATGCTCT | p001182 | C | — |

TABLE 1-continued

| SEQ ID NO: | MUTATION | SEQUENCE | CLONE | CLASS. | GENE |
|---|---|---|---|---|---|
| | | CAACAGGAAAAACACAGCAGCAAATGCT ATGATACCAAAGCCACAACTCCATGGGT CCCTGGAGCCTCTCGAACTAAGCTGCCA GCTAGGGAGCTAACACTAGCTTTGGATG AAACACAGCTCTGGTAGAGTT | | | |
| 351 | IM000969 | GCTGGGATTTGAACTCAGGGCCTTCAGA AGAGCAGTCTGCTCTTACCCGCTGAACC ATCTCACCAGCCCCTTCCGTTCTTCCTT TCTTCCTTCCTTTTTTTTTTCCACATTGTT TTCAGACTGCACCTTGTTTAGTAGTCTAG GCTGGCTTCCAATTCCCCAATGATTGAG CTATGGGTATACTCTTCACCTACTTTG ATTTTTTGTTTGTTTATTTGTTTTTTGTTT TTTTGAGACAGGGTTTCTCTGTATAGCCC TGGCTGTTCTGAACTCACTTTGTAGAC CAGGCTGGCCTTGAACTCAGAAATCTGC CTGCCTCTGCCTTCAAAGTGCTGGGATC | p001183 | R | — |
| 352 | IM000970 | GCTTCATTTAATATACATCATTTACCAGA AACCACAGACATCTTTGTACCAACATATA GTAATATTAATCACAATAGCCATCACTCT TATGTAAGGATGAGAAGACTCCCAGCTA ATATGCTAATGTGTAGAAGATGCCAGAT GGATC | p001184 | D | — |
| 353 | IM000971 | GATCCCTGCTTCTGTAAATCCGCAACGA CAATTGTTATCTTCTCCTTTTCTTTCTTTT ATTTGTTTTATTCTATTTTATTTTTCAGAT GAAAA | p001185 | C | — |
| 354 | IM000972 | GATCCTCCTGCCTCTGCCTCCTTCAGCA AATCCTACCGGCGTGCGCCACCACTACC GGCGAAAAA | p001186 | R | — |
| 355 | IM000973 | GATCCCCCTTTCTCTCTGTCTACGGGCT CTGTCCTGTGTTAGCTGTAGGCCTACTC TGTATGAACAGACCTCAGCGGAGGGGTT TGGACTTGGGCTTGTGTTTCTTAAGAGA ATGGGGCTTCCATGACTGTCCCTCTGTC CCTTTCATCCTAACCCTGCCTCCCGCTA ACAGGCAGCCTGTATGTTTCTTGCACTG TTCCTTCCTCCTGACGGTCTGAGTCGTTT CCCTCAGAGACTGTTGCTGCTGCTTCAG CTTTCTCTCAGCTTCTCTCAGGGCTTCC GCTCTGGAGTTTCTCCTGCTTCTCTGTTT ACTTTTCAAAGCTCAGCCTCCATCTTCTG CACCTGCGGAGTCATCACTGATTCCCAG CTGTGGCCTGTCACCCTTCCCTTTGTTTC TTCCTCCTGTGCCACCACCATGCACCCT CCCCTTCTGTCTGTTGTGTTGTCCTAACC TTCTTCTCCCCATGCACCCTCCCCTTCT GTCTGTTGTGTTGTCCTAACCTTTCTTCT CCTCTCTGTGCTCTGCAGGTTTTAGGGT CTCTGTATGATTTGTACCTGCATTTATTT GAACCTCCACTCTTCTCTTTCCCTCTCTT ATC | p001187 | D | — |
| 356 | IM000974 | GATCCTGCAATACCTCTCCTGGGCATAT ATCTAGAAGATGTTTCAACTGGTAATAAG AACACATGCTCTACTATGTTCATAGCAGC CTTATTTATAATAGCCAGAAGCTGGAAAG AATCCAGATGTCCCTCAACAGAGGAATG GGTACAGAAAATGTGATACATTTACAA | p001188 | R | — |
| 357 | IM000975 | ATCTAAACTATAATAGTTGCAGGGCTAGT TCATTGTCAGGTGCGTGGCGAAAGAGTG CAAATCCCGGGGGTTCTTTCTTCAGAAT CAACGAGGCAATACACTTGAACATGTAT GTTTTTGTAATCTGCGGGGCATCACCCG TCCTCCAGGATC | p001190 | D | — |
| 358 | IM000976 | GATCCCCCAGAAGTGATAGTTTAACAGT GAGGTGAATGCAAGCAATAAGCTACCTA TATCATTAAAACTTCCTATTTATTAGCAT CTATTAGTTGCACACAGCAGTGATGGGT TTCATT | p001192 | K | lrf4 |
| 359 | IM000977 | GGACCTCTGTACAAATGTCGGGAGATAA GGGAAGAAAAAGACGACAGAGATAGCA GTCAGGATGTAATGTGTACTAGATGAGT GGTTCAAGCAATAGGATGGAAAGGGCTT AGCAGGAGAGATTTTTAAGGATGGAGGC AGTAGATTACATCTGGGAAATGTCACTG GAACTGGATC | p001194 | D | — |

TABLE 1-continued

| SEQ ID NO: | MUTATION | SEQUENCE | CLONE | CLASS. | GENE |
|---|---|---|---|---|---|
| 360 | IM000978 | GATCACCAGGCTGGGCAGGCCACCTAA GGAAGTGGCACGGGCACGGGCACTTCC CCAGAGCACCCTCTGGGCACTCTGAGA GGGGCACAGATGTACTGCACTAGGCTG GGCCCGGAGGAG | p001196 | D | — |
| 361 | IM000979 | TATAAAATATCGAACGTCCTCTGGCTTG TAAATATCATGTTAACCTTCAAAGCGTTC GAAAGCGCAGGAAATCTGAGTCAACAGA ATAGTATGTAAGTATTTTTATAGAACCT GCCTGAACTGCAAGGGAGGGGCGGGGC GTGGACCCAGGCCTGCCTGCCAATCTG CGCTGCCAGTGAACTAAGCCTGATC | p001197 | D | — |
| 362 | IM000980 | GATCAAGTCCTGGTCAGTACCAAGTTAA AAAAAAAACTATATAAAAGCTATATTAGG GGACAGCTGTGGCTTTTGTAGAAAAGAA GGTCCTGGTGCTATGACCTGCAGATGCC CATGTGGAAGTCTTCAGATGAAGACTTT CTCATGGAGTAAACATACTCTGTTGTTTG ACCATGTGGACTTGGTTCAAAATGCCCA TGGATGCTCCTTTGGGTACCAGGCTTCA GTGGGAGTCCCAAGCCCATGTCTTTATT TGAGCATGAGCAGTACTGATGCTTACCT GTCTTATTCTTTCCTTGCCCCCTGCCTG GACCGTCTCTGGTTACAAGGATGCTGCA GTGGGAAGCGGTATGACCGTTACCTTTA TGGGACTGAGACCAACTAAGGGGAGGC TGAGGAGGCTGCAGTGAAGTTATTGTTG GGACTGTGGGCTAAGATGGAAGATAACA TGTTAACAAACTCAAGTGCGGAGGTCTC AGAAGTAAAATTGCCTGGTTAGTA | p001200 | D | — |
| 363 | IM000981 | GATCAATTGGTAACCAAGCCTTGAACTG AAGAGTCGTGAGGTGGGGGACTTTATAT | p001201 | D | — |
| 364 | IM000982 | GTATCTCCCACCTGGCTCAATATAGGCT CTTTTCAAAGGCTAAATTAAGACCAAGGA CACAGAAGGGTAGCTCGCTGGGCAAAC GTGATCCCTGCTGATAGTGTAG | p001202 | D | — |
| 365 | IM000983 | CTCTCGTGTGGAGATATTAAAGGTGTGA ACCACTAAGCCCTGATC | p001203 | A | Scp2 |
| 366 | IM000984 | GATCAAGCAGAGGGGTAAAATAAGGGCA AGCTCAGTGTTAGACAAGCTCATAAGCC AAAGCTGTGAACTCTCCAACGCCT | p001205 | D | — |
| 367 | IM000985 | GATCACTTCAACATGAAGAAGTTACCCA GCCCCGGGAAGAAGTACATTTCCAGGAA GCAGTGTTTTCATTTTTTGAGTCTGCTCC CATCCCGTTTCTCTGCAGCTGGGTAAAC TTGAAGCTGGGCTAGCCTCTGGGTAGAA GGCAGCTAATGACAACTACCTTGCCTGT CCCACGGAGCCCGGACAGAACCTGAGA TAACACACCTAGCTTGCTGAGTAAAGGC AGGTTACTGTGTGAATGACTCTGAGCTG TTCCAGCTCTGCAGAGCAGGAAGTCTGA CTGTGGAGATAAGAGATAT | p001207 | D | — |
| 368 | IM000986 | GTCATGATTTGTAATTCCCTGTCCAACTC TCATTGCTTAGGTCAAAATGGCTTAACTC CTAGCCTACTTCAGTGTAAAAGTCATGC GTAATGATC | p001209 | D | — |
| 369 | IM000987 | GATCAGGCTGGCCTCAAACTCAGAAATC CACCTGCCTCTGCCTCCTGAGTGCCGG GATTAAAGGCGTGCGCCACCACTGCCTG GCTGCTTTCTTTTTTTTCTTTTTCTTTGTG TGTGTGGGTAGTGGTGGTGGTGGTGG TGTTCGAACC | p001210 | A | Hsc70t |
| 370 | IM000988 | ATGTGTGTGTGTGGCATGTGTGTGCCAT TGTGTGTGTGAGTGAGTGTGTGTGTG TGTCTGTGTATGTTGTGGAACAGATTCCT GTGTATGTTTCCTTCTTCACACATGTTTT CAGAAGTGAAACCAGGCTATGAAGACCG CCAGGCAGCTCTGCAAAGCAGTACTGAG AAGGTGGGACACTGCGGGGGTGAGAAC AGTATGCATGATC | p001212 | R | — |
| 371 | IM000989 | GATCACACTCCATGAAGCTTCTCTTCTGC AACAGGAAACAAATAGCAAGCAAAACCA CTGGTAATCATTATGTGGTGTCTAACAGA GAGCGGTGACAGGGGTGGAAAACTGAA TGACATTTAAAAGGAGCTGGAGATGTTG GTTTAAGGCGTGTGGGGCAGCCTACA GCATGGAATTGGTCCATAA | p001213 | D | — |

TABLE 1-continued

| SEQ ID NO: | MUTATION | SEQUENCE | CLONE | CLASS. | GENE |
|---|---|---|---|---|---|
| 372 | IM000990 | AACCATCATGGTAGCTTCTGCTTCTCTCC ACGAAGATGGTTGTCCACAGTTGCCC TCTCTACAGAGTGGTCCTGTATTAAGTCA CAGGTGCCATCCTGGTGATC | p001214 | D | — |
| 373 | IM000991 | GATCTTACCACCCGTTTCCTGCCCGGTC TTAGATAGACCTCTTGGCCCCCACGCAC CTAGACAATGGAGTAGACAAGACTTCGA GGGGAAAGAGGCTTCCCAAGATGACCC AGCTCATTGGCTTGACTCCCTACGCCAC CCACTTACACAGTGAGTATCTCTGGTCTT TGCTGT | p001215 | A | Farp |
| 374 | IM000992 | GATCTATGTCATCTTCCAGGACTCAGAG TTAAGAGAGTTACCAAGTGAGAGCTCTC ATCACCTTCTGAAGCAGTTGAGAATTGG AACCCAGAAAGATGCACATGCACGGGCA CACACACACCCACGGGCACACACCCAC CCACCCATGCAGAGAGAGAGAGAGAG | p001216 | D | — |
| 375 | IM000993 | TAGGTTGTGCCTGGCCTGTGCAGGACAT GCCTATGGGGTCTTCATCCCTCTCACTT ACTCTAATGTTCACTACTGACAAGCACTA GTAAGAAAGTAGGTGCCTGTAAGAGACT GGAGCAGCCTGCTGCTGACTTCAGCACC TGGGAGGCCTCAGTAGCAAAGCTTAGG GTTAGCTATCCTTGGGGCTGTGGCTGGC TGAGCTCTGGGGTACCGTTTAAGAGGAA AGCTGGAGTCCAGGTTCTCCAGGCCCTG GGTGCATCCCACAACCTCTCTCTCTC CTTTACCACTCGCAGCCTTGGCTAAGGA TGAGGACCGGGACCTGGAGTTATCTGAG ATC | p001217 | A | Snn |
| 376 | IM000994 | GATCTCTCCCCATCCTCCTGTTGCCTCTT GTCTGTCATACCTACTACTCCATCAGT TTGCTGCCTCTGAGTCCCTCTTCTTCCTC TCCTATCCCTCCTCCCATCTTCCTCATCT CCAGGTCTCTCCAGGTCTTCCTTCTTCC CTCTTTTCTTCCCCTTTTCCTCTTTCCACT GTCTTGTATTCCCTTCCTTTCTCTGTTGG TCCCTTCCCTCGCACCTCTTTCCTCCTGT CCCTCCTTTTCATGTACCATATTTCTCTT CCTCTTTCTGTGTCTC | p001218 | A | Gata1 |
| 377 | IM000995 | GATCTTAGATGGCCAAATGTTGTGAACG TTTCCTAGATGTGTCGTGAGCACTCAGG GTTGAGAGCCCTGGTTATTTAGCAAGTG AAGTGGATGTATACACAAGCAGAAGGCT GAAACTAGACCCCGGTCTCTAATCCTAT ATAAAAACCAACTCCAAATGGACAATAGA AATAAGTGCAAGACTAACTCCAGGGTCA CTGGAGGGATACAAAGGGAGATGC | p001219 | D | — |
| 378 | IM000996 | GAATGAATATATATATGGGACTAAATGCC ATGCCATAACCAAGAGAACTTAAAGAAG AAAGTGTTTAGTTATGCTTACTCTTTCAA AGAGTCCAGCTGCCAAAGGGATGCTGTC AGGAGTAGCTGAGAGCATACATCTGGAC CCATTAACAAAGAAGGGATGCTTCCCCA GCAAGATC | p001220 | D | — |
| 379 | IM000997 | GGAGGAGGGGCACCTTCTCAGAGATC | p001221 | D | — |
| 380 | IM000998 | GATCTTAAAGCTAATAGGTGTGTGTGTGT GTGTGTGTGTGTGTGTGTGTGTGGTC AGTGGTAAAATTGTCTACCAAGCTCTAG GTTCACCCCTCACAGAGCCGGAGAGAAA AGGAGAAATCAACTCAAGTCAACCCAAA CAAAACAAAGGACTCAACA | p001222 | R | — |
| 381 | IM000999 | GATCTGTTCCCAAATCCTCAGTTACTCTC TGGGAAATGGCTTCTGTATGTACACATG TTTCTCTAGCTATGTAATAAAAGACCTCTC TTCCTTGGCAAAACTTAACTCTACCTTAG AAAACTCTGATGAGTACTAGAAAGATGA CATGTTCCACAAACGTCTTAAGTGATTCA GGGTTCACAACAAAGAAGGAGATGCTAT ATTGTCTTTCATGACATAGCGTCTAAGTC CCATAGCATAACTTCTATAACACACAAGT GGGT | p001223 | D | — |
| 382 | IM001000 | ACACTAGCTTCGAAACTTCTTAGTTGTCT GTCCCTGAGCCCTTTGTGGTACTTCCTC CTCAGAGCCCAGCTCCAGCAGTCCCCTT AGCGGCTGTTTTAGCAACCACACCCTC TGACTGTGGGTTTGCTCTGCAGTGGCTT | p001224 | D | — |

TABLE 1-continued

| SEQ ID NO: | MUTATION | SEQUENCE | CLONE | CLASS. | GENE |
|---|---|---|---|---|---|
| | | TAAGGTTTGAATACGAAATGCCTTCCACA AACAGACACTACAGAATCTTAGGTGTCG AGACAATGGGCATTTGAGAAGGAATTGG AACCTTCAGATC | | | |
| 383 | IM001001 | GATCTTAAGGGAAACCCTTGTCTTTTTGA ATCTGAGCCAGCACAATATTGTATTTCCT TCAATACGTGGTGAATGTTGTATTAGCAA CAATAAATGGAAGCAGGGAATCTCTCAT CTCATGAGTGATATTTACAATGTCTGTCT GGAAACAAACGGCTAATCAAGTTAGTCA CTTACTGTTCTTTAGAAAACACAGTACTT TGAAATGCATACCTAGCAGAGAATATAAA GTATTTACTGTTGGACTAGACTGGGCCC CCGGGTGTGAGGG | p001225 | D | — |
| 384 | IM001002 | GATCTATCTCATCCTGTTATAGCCGGAAA CATGATAGCAGGATTGGGCAACTCTCCA GTCCCTTTCTCTTGGGTAAAGTCTGAAA GCAAATCGCCCGGACCCATCTCCTGTCT CTGCAGCCTGTCCCAGTTGCCTCTGCCA CTCACTAACTTCACTCCTTAATTTAAAAA GCCAGCACATTTATTGACCGTCT | p001226 | C | — |
| 385 | IM001003 | GCATGTCTCCAGACTCTCAGCTGCTTCC TGTCTGCTCCTGCTGGATGCTTCATGAA GATGGAGTGAAGCAGTGGTCAGCTTGTC TGTCTCAGCTGTTCTATGTGCATGTGTG CACTTGCTGGAGCTTATGTGCACCACAA GCACGCAGGTGCACACAGAAGCCAGAG ATC | p001227 | D | — |
| 386 | IM001004 | GATCGAACACGCTCGGACTTGCTAAACG TTTCCCACACGGACAGTCACTGCCAA | p001229 | K | Nmyc |
| 387 | IM001005 | GATCGTGAGTTCAAGACCAGCCTAAAAT ACACAGTGAGCCTCTGTCTTTAAGAAAC AAACAAACAACAACAGCAAAAACAAAAAT ATTGCTCAAGACCCAATGTTCCTCGGAC TATTTATAGGAATCAGAGTTGCTGTTCTT CTCAGGGCATGCCAGTTAATTTGAAAGA CAAGGTGTAGAGGCAAAGGAAAAGTGAT TTTACTTGGATAACCACCTCATGGAGCA GTCAGGGGAACTCTAGCCTCAAAGCTCT TGCAGAAGTTATAT | p001230 | D | — |
| 388 | IM001006 | GTAGAAGCTTTTTAGAAATACGTTTCTTA TCTATCTATCCATCTATCCACCCATTATC ATCTATTATCTATATTTAACATCTATCTAA GTATCTGTTTATCTATCTACCTGTCTATA CCTACCTATCTACCTACCTACCTATAGCG ATC | p001233 | R | — |
| 389 | IM001007 | GATCGTGCATGCATGGGTGTGTTTTGGG GAGAGGTTCTGT | p001235 | D | — |
| 390 | IM001008 | GTTACTATTCATCTGAGGTTCTCTTTTGT TGTATTTGAACAGGAGGAAGGAACCAGG AGCTCAAGGATGTAGCTGGAAATGCTAT AAAACTGGGATGCCCTAGAGAATCACAC GGACAATCCTGCTAACCCATGGATTGTA CACTCCAATATACAAGATAACATGTTTGT GCAGGGATGCCACCATGATGTTCGATG | p001239 | D | — |
| 391 | IM001009 | GATCGACCGCAGATGAGGTCTATGCAGG AAAAACGATGTCTGGAATTTTATTAAAAT TGCTCAGCTACTCACTGCCACGTATACT TGGAGAGCCACTTAGGGAT | p001240 | K | Myc |
| 392 | IM001010 | CCAAGTATACGTGGCAGTGAGTTGCTGA GCAATTTTAATTAAATTCCAGACATCGTT TTTCCTGCATAGACCTCATCTGCGGTCG ATC | p001242 | K | Myc |
| 393 | IM001011 | GATCGTAGAGAGATGGACCCAAATATCA GCCAGAGAATTAGACCAGAAAATGGAAC CAAAGTACCTGTCAGTCCAAGGATGTAG TGGCACTAC | p001244 | D | — |
| 394 | IM001012 | GTCCCCAAATGTAAACAAAACTATCAAAA GAATTGGGCATGCCAGAATTTTGTTCTT CACATTAAGGGAATTCTGAAATTGAAATC TTGCTAAGGGAAGGGTGGCTTGAGAATA TTTACAGAATCCTAGGTTGAAGGAGCAG GAATAGAGGATC | p001246 | D | — |
| 395 | IM001013 | CAGCTAGCCCATGGAGCTGCTGGGACA CGAGGCCGCAGGCTGAGCATAATGGGG AAGAGATGGCAGATTCATTCACCCACTT GAGGAGACCACAATTAGTCAGAGGCATG | p001247 | D | — |

TABLE 1-continued

| SEQ ID NO: | MUTATION | SEQUENCE | CLONE | CLASS. | GENE |
|---|---|---|---|---|---|
| | | CTGGGCCTGGTCAGAGTGCTCAAATAAA<br>CATTCACAGGACCAAAGTAATAAGCATT<br>GGTGTTACAGAGATAAATCCTTTAGCAG<br>GGACACGGGACCCCAGAAAACCGGAAG<br>GACATCGTTCCCATCATGAGAACAAGGA<br>CAGCAAACAGTCACTGAGGGTATACTAC<br>TGACCAGTTCCAACAGGGATGGTCAGAA<br>GTTGAACGCTGGATATATCATGAGCTCT<br>GACCTAAATATTCTGAGTATTCCCCATGT<br>TTGAATGGACTGAATACTCACATTTTCTA<br>TGCTGAATACTGAATTTTCATAGCTAC<br>CATCATAAGGCATGGTGGCAGAATAATA<br>TCTCTCACTCAGAAAGCAAACTATTCTAA<br>GTTGGGGATC | | | |
| 396 | IM001014 | GATCCCGTGGGGACTGAGCCTGCAGCT<br>CAGTGGTAAAGCAGATGTCTAACGTGGT<br>CAGGGTCCCAGATGAGATGACACAAGT<br>ACCTGTCAGTACTCCGGGAACACTGGGT<br>GGGACTTTTATATGTTTATTTGTATTCTTA | p001248 | D | — |
| 397 | IM001015 | AGTCCATTGTGTACTGAGAGAGGAGTTA<br>GGTTTAGAAAGCCTTCCTCAGATGTCCC<br>TCAAAGAAGCTGCTACAACTGCCCTCAT<br>CCCAAGTTGCCAAGGATC | p001249 | D | — |
| 398 | IM001016 | AGATTGCGTGAGTTCTGATGCATGCTGG<br>CCATGATGTGAGGCAGGGGCAGTGGTT<br>GGATTCGGAGTCAGAAAACTTTCCCGTC<br>TACTGCCGTAATTCCCAGCTAAATTCCTA<br>TCCTCGTTGTAGCTGTTGGTGAGGATC | p001250 | D | — |
| 399 | IM001017 | GATCCTTCCGAATCTGCCATTTATTGAAT<br>ATTTAAAACACACCTCACTGCAGACTAAA<br>CACATTGCAAGCACTGGGAGCAGAGGT<br>GGCTAGTGAGCACCACTCTAGATGGTCC<br>TTC | p001253 | D | — |
| 400 | IM001018 | GATCCTCCTGCGTCTACCTTCGGGTGGG<br>ATTGCAGGCATGCACCACCATGCTTGGC<br>TTTGTGTGGTACTGGACATTGAACCCAG<br>AACTCTTTGAGCACTAGGCAAGCACATC<br>CTGAACACCAGTAAAACATTTTCAAAGAG<br>AAAAGAAAATTTTAAACATACACCTATCT<br>ACATCCATTTCCACCATGTTAGTAAACCA<br>GGGACATTTTGAAGTGTGGTCTTTATAAA<br>AACACCCGGGTGCTTATCTCCCACGCTCT | p001254 | R | — |
| 401 | IM001019 | CCAGCGGTGCTCACTACTGCATGTAACC<br>AGCTCCAGGATC | p001255 | D | — |
| 402 | IM001020 | GTCTCAAAGAACAAAAATAAAAGAGGAA<br>ATTAGTAACGAGTCCTGAGAGATAGAAG<br>AGTATTCAGCCTGGGACCAGAGCTCTGT<br>CTTACAGTCTTGCCATTCTGTGGGGCCT<br>GGGACACAGCATCCTTGGTCTTTAGAAT<br>GCCATAGGCCTCCTGAGGGAGCCTTTTC<br>TGTAGGCACTTCTCCCACATTCTTGGAT<br>GGATGCGATTTATTCTGTGTCAGGGGAC<br>TAGGGTGCTGGATGTGTGGGTCGAATGA<br>CTGTTGTTCTGTCACTTGGGAATTTGGG<br>ATAGGAGTTATTCTGAGTGCAAGGCTAGT<br>CTGCACTTGAACGTACATATCGGGTTTTA<br>AGCCAGCCTCTGAGCTACCACAGTGAGA<br>CTCTCTCTTAACTAAAATCAACATAAATA<br>GTCTTAGTATGGAGAGGTTAGGGGATC | p001257 | C | — |
| 403 | IM001021 | CGTTTTCCTCGGAAAATGTGAAAAGAAG<br>AAGCACGAGACGAAACCCCCTCGAGAAT<br>GAGAAAATTAAATCTAGAACCCAAATGG<br>CGTCCAACAAGAACATTAGCTCTTGAAAA<br>TGAATATTGCGCCTGCGCAGCCACCGCC<br>CGGCCAGCTGCTCAACTGCAGCTAGAG<br>CCCGACCCCAAGCGATC | p001260 | C | — |
| 404 | IM001022 | GTGTCACATGTATGAACAGCATCACATG<br>GTATGAATGGTATCATATGGTATGACGT<br>GAATGTGTGCACCGGCACTGATC | p001262 | D | — |
| 405 | IM001023 | TACCACCCACTCCCTTAAGAAATGATC | p001263 | D | — |
| 406 | IM001024 | GACTGATATTAGTAGGTTGTTCTCTAAGG<br>GCCGTGAAATTTTTAGCTAGAAGTTCTTG<br>CTTTCATTAACAGTGCCAAGTATGAGTTC<br>CATCTCATGGGGTGGGTCTTGAATACAA<br>TCAGAAGGTGGTGAGTTATCGCCATAAC<br>ATCTGTGCCGCTATTGTACCAGTGGACA<br>TAGTTGCCAGGCAGGCCATTACTGTAGC | p001264 | D | — |

TABLE 1-continued

| SEQ ID NO: | MUTATION | SEQUENCE | CLONE | CLASS. | GENE |
|---|---|---|---|---|---|
| | | TCTTAGGTCATTCCTGAAGCTCTCTGGG GTCTGTTAGGTGAGACTGATGATAACTC TTCTCTTCCGTTAGTGTACACAGCACCTT TTAGCACTATGAAAGCGAGGCAGTATTG ATC | | | |
| 407 | IM001025 | GTTCCGATGTTTGTATCTCGTTTGAATTA TCCATCAGTTGATTAAGTTGATGGTCATC TAGGCTGATTCCCCTACATGGCCATCTC AATATTGCTTCTTTAATAAGACCTGGACA ATTAACAGCACCAGTTGACATGCCAACTT GGATTGGGGAGGGGTCTTAAAGGGCC CCGCCCTTAGATGAAGAGCTATACGCAA TTAATGACTGTCAGAAAGGGAGAATGGC TTTCCCAGAGATGAACCCCCTAATGGAT TACCCAGTACCAAGTGATC | p001265 | A | Rad52 |
| 408 | IM001026 | ATTCAACCTATGGGGCCGTTAGACCCCT GGTCTTGGGTGGGGTGGATATGTTATTC TTTTTTGCTGTGGTGGCAGCAATTTTGTT TGCTTTCTTGTTTTTTGATACAGTTTCTC GTCATGTAnCCTGGTTGCCTGGAATTCA CTTCTATAGACCAGAATGGCCTCAAATTT ACAGTGAACCCCCTGCCTCTGGCTTCAG ATTACTGGAATTACAGGTTTGTGCTATCT CACTAGTTGGTGTGTGATC | p001266 | C | — |
| 409 | IM001027 | GATCAAGTCCCCAGTTAAATGCTTTCTTT GATAGGTTGCCTTGGTGATGTCTCTTCAT AGTAATAGAAAAGCAACCTAAGACAAGA GGAGAGAGTGGGTTTAAGAACGAGGAG AGAGAGGAACTCAGAGGGTCCTGGAGG TCCCGGGAA | p001267 | C | — |
| 410 | IM001028 | CTCACACATACATTCATACATACACACAC ATATATACATACACACACTTGCATACACA CAGCACACACTCACACACAGAGACACAC AGACACACAGACACACACACAGAGGAAC CCAAAGGATTGGAAGAATAATTTCCCGT GCTCAGCGGGAAAGTTTACCAGAAAGAC AAGTGGTCATGTGGGATGATC | p001270 | C | — |
| 411 | IM001029 | GATCATCACCAGTGTAGTGTTGGCTTTAA CGGTGCACGCCTTTAATCCTAGCACTTG GGAGGTGGAAACAGGTAGGTGTGCTTAC TTCAGTGAGTGAATTCCAGGCCAGGCAG GGATACAGAGTGAGAACCTGTTATCTAA ATAAATAAATAAA | p001271 | C | — |
| 412 | IM001030 | CACCCACGGCTTGCTTCTTTTCTCTATGT GTAATTGAAGCACATACCCGGTGGGAGC CATGTTAAGCCTGTGTCCATGATC | p001272 | D | — |
| 413 | IM001031 | GATCATGTGTTAATGAAACTGTCAGGGG TTGGGTAAGATGGCTCAGTAGGTAAAGG CACTTGCCTCCTAGCCTGGAGACCTGAG GTTCCTCCTGGGGCCCACAGGGAAAAG GAGATAACCAGCTCTCTGTCCTCTGACC TCCTGGGCCCCTCCCTCACAAACAAACA AACAAACACACACACAAACGACCAGACC ATTTCCCACAGTAGCTGTGGTGCGTTAC ACTGTAACGGGCACCATGTGAGGGTTTG GGCTTTATCACATCTCCGCTAGTCATACT TGGTGTTTCCTGCGTCTTGCTTACAGTTG TTCTAATGGGTGGCGGTGATATCGAAT TGTGGTTTTAGCATGTATTTCCTGTGCTC TGCTAAGACCACTTACAATTACAG | p001274 | R | — |
| 414 | IM001032 | CCTTAACGCTCCCTTGATGTCCACTCCC GTTTTCTCTGCAGCGATTTATTGCTTAGT CTATCTATAAGGTGTATGCAAGCTGCAAA GTCAAGTATTTCCTTTGTACTTGAGCAAG TCTCCTAAGTATTATGCTTCATAACGTTG TGATATGCTTGAGCAAATTTGAGTCTATT TCATAATTAAGCCACTGTTCTGATAAAAG ACCCTAGAGTGCTATATCTGATC | p001277 | D | — |
| 415 | IM001033 | AAAAGAGTGTCAGATGTCAGAACTGACT AGCTGGGCTGACACTGAGGAATGAAGGT TGGGGATATATGCACCTCCTGAAAACAG GAAGCCTTTTGTTGGTTGATC | p001279 | D | — |
| 416 | IM001034 | GATCAACCTTAGTACACAGCAGAGTGTT TTCTGGGAAGCTCATGGAGACCCACTTT TGTCATCCCATAGAGGTTACTACAAATCT GAGCATGAGAATAACTACTTGCTGTTTAA TACAAAGAACCATTAGCAGTCAATGCCC | p001281 | D | — |

TABLE 1-continued

| SEQ ID NO: | MUTATION | SEQUENCE | CLONE | CLASS. | GENE |
|---|---|---|---|---|---|
| | | CAAGTTCTAAGGGCACAGACTTCATACG AGAAAAAAAACAAAGCAAAACAAAAACT ATCACATGCTACTATCTGTACTGGGGAAT GCATACAATTTTGTAGGTAT | | | |
| 417 | IM001035 | GATCAGTAGAGAGCAGAGGGGTCTATGA GGGAGGTAGAGCAGCCTGGGAGGCCTG AGGAAGGAGGGACAAGGGCAGAGTCTT GGTCACTCTTTGGTCTAATTGCCTTCAGA AGGCTTGCAGACTCTGGTTTGGAGTTCC AGGTGGGTGGCTG | p001282 | C | — |
| 418 | IM001036 | CAAGTAGGGTTTGTGTGTGTGTGTGT GTGTAGCCAGTGTCTTTCTCAATCACTCT CCACCTTAATATnTTTTTTGAGACAGAA TCTCTCACTGAACCTGTATGCTGTCAATT TGTCATGGCTGACTGGCCAAGGAGCCC GAAGAATTTATCTCTATGCTCAATCCAAC CCCCAGATC | p001285 | R | — |
| 419 | IM001037 | GATCAGATGGACCGATTGCCGCGGGAC ATCGCACAGGAGCGTATGCACCACGATA TCGTGCGGCTTTTGGATGAGTACAACCT GGTGCGCAGCCCACAGCTGCATGGCAC TGCCCTGGGTGGCACACCCACTCTGTCT CCCACACTCTGCTCGCCCAATGGCTACC TGGGCAATCTCAAGTCCGCCACACAGGG CAAGAAGGCCCGCAAGCCCAGCACCAA AGGGCTGGCTTGTGGTAGCAAGGAAGC TAAGGACCTCAAGGCACGGAGGAAGAA GTCCCAGGATGGCAAGGGCTGCCTGTT GGACAGCTCGAGCATGCTGTCGCCTGT GGACTCCCTCGAGTCACCCCATGGCTAC TTGTCAGATGTGGCCTCGCCACCCCTCC TCCCCTCCCCATTCCAGCAGTCTCCATC CATGCCTCTCAGCCACCTGCCTGGTATG CCTGACACTCACCTGGGCATCAGCCACT TGAATGTGGCAGCCAAGCCTGAGATGGC AGCACTGGCTGGAGGTAGCCGGTTGGC CTTTGAGCCACCCCCGCCACGCCTCTCC CACCTGCCTGTAGCCTCCAGTGCCAGCA CAGTGCTGAGTACCAATGGC | p001289 | K | Notch1 |
| 420 | IM001038 | GATCTAACTCAGGCTGTTCAGCTTGGCC AACAAGCTCAAATATCCATTCCGCTGTCA CATCGGGCCCCATGTGATGCTTTATATA CTAAATAGAACAAGCAAATTGATACTAGA TGGGACAGTCTGCTTACCCAGTTTGGTG TTTGGTGGGGGAGGTGAGACATATCCCA CAGTCCCAGAGCAACTGTCACTGCAGGG TCCCAGGGGAGGAGCCAGGTGTGAAGC TGGCAGTGTGTGAGGTACCCTGGGGAA AATGAATGGTTACT | p001292 | D | — |
| 421 | IM001039 | AGGCCTGGTAGTGACCAGCAAGTACTGA ACGCTCGCTCTATGCCAGACACAGACCC TCTTCTTCCTTCGTCTTATCCTATTATCCA TACTGAACAGACAAGGAAATGAAGGCTT AGATGAGTCACCCGACTTGCTGAGATC | p001293 | D | — |
| 422 | IM001040 | GTGGGGCCTGAAAATCACATCTGGGCA CCCTGAGGCCTGCCAAGTCCTCATCA GAGGGATGCCCTCTTCATCCCAGGTGCT TTCTGACTATAAAATAAGGTGAATACTAC CTCCCCTGAGGTTACACCTCCAGGGTTA AGCTGGTTAGAGAACCCAGGGACACACT GGGAAACAGCCCACAACAGCAGGAGCT GGAGCACTCACCCACGGATGTCCATGG GGTCCAGCTCCCTGCGCTGGCGCCCAC CACTGGTACCAGGAAGCAGTGAAGAGGT GGCCCAACCCCACTGTAGAGCGCTTGATT GGGTGCTTGCGCAGCTCTTCCTCGTGGC CATAGTACGGGAAGATC | p001297 | K | Notch1 |
| 423 | IM001041 | AGTGGAACCAGATTCCTCCTACGCTTTG CACTCCACTTTCGTTTTCTCTTTCTGTACC ATTCTAATGGAGGCCAGAGTAGCAACTG TATAGACAAATCAAATCGTTTACTCTTCC AGTCTTGCCCCTTAACAGTCTTTCCTTTG TTCTTCCTCTTAGCCTCATTTTCTCCTTTC TCAGATC | p001298 | B | A1604147 |
| 424 | IM001042 | GATCTTCTGCTTCATCTGAGTAGGCTTAG ACTGGTTTGTATTATTATTATTATTACTTG TTGTTGTTGTTATTTTGGTGGGAGTAGTA | p001300 | R | — |

TABLE 1-continued

| SEQ ID NO: | MUTATION | SEQUENCE | CLONE | CLASS. | GENE |
|---|---|---|---|---|---|
| | | GTAGCAGTAGGTGTGTGTGTGTGT<br>GTGTGTGTGTGTGTAGATGTCACAGC<br>ATGTATATGGAGGCCAGAGAACAGCTTC<br>TAGCGGTTGCTTCTCCTTCCTTCCACT<br>GTGGTCCAGGGAATAGAACTCAGGTCAT<br>CAGGCTGGGCAGCTGTCACCTTTAATGC<br>TCTGAGTTATCTCACCAACGTTAATAAAA<br>GGCTTTTCAAACAGCAGTTTGGGCTGGG<br>CCTGGTTGTGCAGACCTGGAATTGCAGC<br>TTCTTAGGATGCTGAGGCAGGAGGACTG<br>GAAGCTCAAGTTGTGTCGGGGAAACTTA<br>GTAAGTCCCTATTCTCGTCCCGCACGCC<br>CCCAAAAAGCCAAGACCAAGACCAAGCA<br>GTTTGGTACAGCAGAAAAAGCACGAGAG<br>TCTCCTCCTCCTCCTGCTCCTCTTTAATG<br>TGCAGAACCC | | | |
| 425 | IM001043 | GATCTGTGCATTATTCTGTTGGAAATGTG<br>ACAAGATTCTGTTGAGAATCTCATACTCT<br>ATGAAGTCTTAAAAAAAAAAGGTTTCTGC<br>TGTTTTGAGACAAAATTACTTATAAAGGT<br>TTATGATGTAGTTAAGGCCCTGAATGTCC<br>CCCAAAGACATGTGTGTTGAGGGTTTGG<br>TCTCCACTCCGTGGTCTTTTGGGAGGTG<br>TTTTTATGTTAGCTGGTGAGGCATAGTGG<br>CAGGGGAGGAGAGTTGGGTCATAGTCC<br>TTTTGAAGAGGCTATTCAGGCTCTGGTG<br>CCTAA | p001303 | D | — |
| 426 | IM001044 | GATCTGACTGTGATAGGAGGGTCCTGGG<br>GCCACCCTGACATAGGCCTGGTCTATGA<br>ATGCTCTCATGGACTGGGCCTGTTTGTC<br>A | p001305 | D | — |
| 427 | IM001045 | CTGCCTCTCTCCCTGGTCCCTCTCTGAG<br>GTTCTGGACCCTCAAAAGGCCCTTTCCC<br>ACCCCAGCCTTCAGGCCTGTAACCCAGC<br>CTCGGTTTCTCTCCCATTGCCAAAGCAC<br>AATGGCTGTTATAATTAACGGATTATCTC<br>AGCGCGACAGCTGCGCCCCTTTGAAAAT<br>TAGGTTGAATAACAAGATC | p001306 | C | — |
| 428 | IM001046 | GATCTTGGACCACCACGTCAAGCCTCTT<br>GTACATTTCTTTGAAAAACAAAGCTTGGT<br>TCCCCCTAGTCACCACGGTGAAAAAAAC<br>CCAGGACAGTAAAGGTCCCAA | p001307 | D | — |
| 429 | IM001047 | TTAGTACCTCTGGTGGAATCACCATGCC<br>TGACCTAAAGCTTTACTACAGAGCAATTG<br>GATAAAAACTGCATGGTACTGGTATAGT<br>GACAGACAAGTAGACCAATGGAATAGAA<br>TTGAAGACCCAGAAATGAACCCACATAC<br>CTATGGTCATCGATC | p001308 | R | — |
| 430 | IM001048 | GATCGCACCGATTGCCAGTATAGTACCT<br>AGAGTGTCAAGTTGGCCTCTCAGGGAAG<br>AGAGAACATGTATTAGGGTAAGACGCAA<br>GCCCCAGTAAAAACATGTGAG | p001311 | D | — |
| 431 | IM001049 | GATCGCTTCACCAAGTGTGAACTGTTGG<br>TAGGGACAGAGCAGACCACAAGCCCCT<br>CTTTGCATTTACATGGGGGCGTCCTAGT<br>GTAGGTGGCTAGGGATGGTGGACAGGA<br>GAGGAGGGAAGACAGTATCACATAAGAA<br>CAATAGTGGAGGGCAGGGGAGGAAGCC<br>TTCTCATGGCTGGGGTGAAGTCACTTCC<br>GTAGCCAGAGCTGACTGAGAATATCACT<br>GCTTTCCTAGTAAGGAAACACCGGAAGT<br>CGGAAGATGATAAACGCGAAACTCACTA<br>CATCATAGACACCATTCTGTCTTCATCAA<br>CAGAGAAATTTATTA | p001313 | D | — |
| 432 | IM001050 | GATCGTCCACTTCTGTGTTTGCTAGGCC<br>CCGGCATAGTCTCACAGGAGAGAGCTAT<br>TCTGGGTCCTTTCAGCAAAATCTTGCTA<br>GTGTATGCAATGGTG | p001316 | R | — |
| 433 | IM001051 | AGGGTACAGCGAAGCTTGAAAAAAGCAA<br>GGAGTGCTCTGGGACCGGGAGTGATGG<br>AGAAAGTCTGAAGCCCCTTTGCACACCC<br>CTACAATGGGTTTGCGCCAAGAGAGGCG<br>CCGGCAACTCTACGCGGCGTGGGGCTC<br>TCCCCAGCGCTCTAGGTTCTACTGTGCT<br>GAGCCACACTAGTTTCTCTCCCTAGACC<br>TGAAGAGACCCCAGAAGTCTGAGAGTCC<br>CTTTGGTTCTCCATCTCTCACCACCCCC | p001317 | D | — |

TABLE 1-continued

| SEQ ID NO: | MUTATION | SEQUENCE | CLONE | CLASS. | GENE |
|---|---|---|---|---|---|
| | | CACTCTCGTGCTTTAACTCTGAGGAGGG CCACTCAAGTTCATTCATAAGAACAAGG GCTTTGCTCTTAAAGGAGCCGCATACCG AAAGCGTTTGTGTGACTGAGGGTTCACA TGCACAGAGCTCCGCGTGTCTCGACATC CTCTCTCTCCGATC | | | |
| 434 | IM001052 | ATCTCAGGAAACTCCTAGCAGCTTTAGTA CGCATCGTGCTGTTTCCAGCTGTCGGTA TTTTACACAGGTTTTGAGCGATC | p001318 | D | — |
| 435 | IM001053 | CCTTCAGGATTACTTTGGATGATTCATTA GAGAATCTTGTCTTTAGACTATAAAGCAC TTGTTGAACAAGGTTACAATGTAGCAAG CAACCTTGTTTTGGAATGTATTTTGCTAC ATTGTGCTCTTCCCTGGTCTGGTGCTTTC ATTTCACATATTTTGCTCTTAATAGAAGTA GGGTTCAGTGCTGGGGATTTCATTTGCT GTTTTCTCCATTGACCTCTTGAGCTGAAG TTATTCTTATTAGAAAGTCAGGGTAGGCG ATC | p001319 | D | — |
| 436 | IM001054 | CCAGCAGGCAGCGAGACGCATTTTCGC GTGGCGGTGGTGAGCTCTCGTTTCGAG GGGATGAGCCCCTTGCAACGGCACCGG TTGGTCCACGAGGCACTGTCGGAGGAG CTGGCTGGACCGGTACATGCCCTGGCC ATCCAGGCGAAGACCCCCGCCCAGTGG AGAGAAAACCCACAGTTGGACATTAGTC CCCCCTGCCTAGGTGGGAGCAAGAAAA CTCGAGGGACCTCTTAATAAATACCTGG ATTGGGAGAACGATC | p001321 | B | Mm.1045 31 |
| 437 | IM001055 | GTTTTTCCTGCATAGACCTCATCTGCGGT CGATC | p001322 | K | Myc |
| 438 | IM001056 | AAACTAGGAAAGGGTATAGCATTTGAAAT GTAAATAAAGAAAATATCTAATTTAAAAA CAAAAAAGAAAGACAAAGGAAAATTAAAA AAAAAAAAAAAAGWCTTiTGCCACTG CAGGACTGCCCAACAGTCTACTGAAAAC TGTGAGCCTTATTCCTAGATGAGCCTCT GATGCCTCCACTTACAAGCTACCTTCACT CCTCCATCTATCTCCTTTTGTTATGTCCC GCGATC | p001324 | R | — |
| 439 | IM001057 | GATCGGACTCGAAGAGCAGAAGAAACAA AACTCAAAGCAGGGATTAGGTCAAAATT AAAAAGGGTTTGCACACAAAAGGAAACC ATCCSAAGAGACAACCTACAAAGTGAGA GAAACTTGTTTTGAAC | p001325 | D | — |
| 440 | IM001058 | GTCTGAGAAATTGTCTTTAATGTAGTGAC TGTGGAGCCTTGCAGGGATACCCACGAT GGGGGTGTCATTCATATGTCACTGCACC TGGAAGACCGATC | p001326 | D | — |
| 441 | IM001059 | GATCGCACAGCCTGCTTTCTCAACAGTA GGTAGGACCAACAGCCTAGGTGGCACC ACCCACAGTGAGCTGGGCCTTCCACATC AATCATCAATCAAGAAAAATAGCACAAAA CCCTTTCCCGAAGGCCAATCTGCTGGAG GCATTTTCTCAGTTGAGATTCCCTCTTCC CAAATGACTGCATAATiACTTGTGTCATGT TGACATGAAACTAGCCAGCACAGGGTGT | p001327 | K | Pvt1 |
| 442 | IM001060 | GATCGGGTAATTTAGTAATAGTTCATGAT ATTCATTACTCGGCGTAAATCAGGAAAAA CATTTCTAGATGAATGTGGTATTCTCAGT GCACAGTTTGTTTAGTTTAGAAAACAAAT | p001328 | D | — |
| 443 | IM001061 | GATCGAGGAGGGGAAGTCCTTCCTTCCT TCCTTCCTTCCTTC | p001329 | R | — |
| 444 | IM001062 | GATCGGGGGTTCAAGGTCCTCCTCGGG GTACCTATTAGGAGGGCAGCCCAGGCTA CGTGAGACTCTGTCTCAATAAAAATATAA ATAAAAAGCTGGGTGGTGGTGGCGCAC GC | p001330 | R | — |
| 445 | IM001063 | GATCGACCTGCCTCTGTCTTAAGCAAGA AGGGAGATAGATATGCATAGTATTTAGT GTAATGAAAGTTACGTTGTATTACGCTGA GGTTTATCACA | p001331 | D | — |
| 446 | IM001064 | ATCTAAGTAGTATAATGTTTAAGACGATC | p001332 | D | — |
| 447 | IM001065 | GATCGTCGTCTAACTTAGCTGGCTTTATA GTGATATAACAAAATATTAGAGGATGCTT TGGTTGAAAAAGAAGTTTATTTGCATCAC AGTTC | p001333 | D | — |

TABLE 1-continued

| SEQ ID NO: | MUTATION | SEQUENCE | CLONE | CLASS. | GENE |
|---|---|---|---|---|---|
| 448 | IM001066 | GATCGAACACGCTCGGACTTGCTAAACGTTTCC | p001334 | K | Nmyc |
| 449 | IM001067 | GATCGTCATCATTTTTATTACAGTAGTGAGGAGATGTCCCCTGGGGCCGCCCTGGCTCTGGAGAGGGAAGCCACATGCTCCAAGGGGCTATGGTGAGGACCACAGCCTTTACATTTGGCTT | p001338 | D | — |
| 450 | IM001068 | GATCATGCACTGTCTGGGATAGTGATGGGCTGTGTCCTTTGTTGGCCAAGAGGAAGTGGCAAAAGGCAAAGTTGCTGTTGGCTCCAGGAGTCAGTCTGGGGACGGGGCTGAGATGCTGTGGGACAGACTCTGGAAAGGGCAG | p001339 | D | — |
| 451 | IM001069 | GATCGTGGCCACTGAGAGACCTTCTTCTGGCCACCAGATGCACACAGCTGCATGAACATCTGCATACACATTTAACACATACAAAGTTGAAGAGAAGCACGTGTGTCTTGTGGTCTGACCACTTCCTGGGCACCACCAAGCTGCTCTGACAACGGATTCCCACTGGGTTCGGCCATCTTGCTTCCTCCCCTCAGAGTTTGCCCATGTCCTCTGTCTTTTCATAGCCACAGCCTTGCCCAAGATAAGATACATCCAACTGTACAGTGCTCCAT | p001341 | D | — |
| 452 | IM001070 | GATCGTACCAGGAGCTCCAAGCGTACCCCTGATGCTACAACCTCATTCCTGAGCCTTGATTCTGTGGACTCTAG | p001342 | C | — |
| 453 | IM001071 | GAACAAGGAAGGAAATAAAGAATAAAGGACATCTGACACTACCAAAGTTAGGTCAGGATGTGTCTTACAGATGGCCACTCAAGAGCCTATAGAAAGCACCGCACAGACCAGCACGGTCTTTTTCTCCCAGGTGTCTCTGAGGTACTGCTTTCTTTCCAGGGATC | p001344 | D | — |
| 454 | IM001072 | GATCCCGAGTCCTTTCATCCTGTGGTTCTATTGTCCCCTAGGGCTTCAGCAGGCAGGGAGAAAGACACTGTAGAGCAGCCCCCTAA | p001345 | D | — |
| 455 | IM001073 | GATCCTGGGATTTTCTGGGCAATTGGAGGCCACAATTTAGATAGTTTCCGGAATCGATGTCCCTTAAAGACCAGCGCCTGGACTCTACTGAGTAAACTCCCATTTCAACTTCCTCCTCTTCCTCTATTTGAACAACGTGTATCATTAAATTATAAAATTGTTGTTGTTGTTGTTGTTTCAAAAATTAACTTTATTGGGGGAGGGGCAGTTGCCCGAGGACTTACTTGTGAGAACCAGGTTTTGCCTTCCACACTTAGGGGTCCCTGGAATGGAACTTATGT | p001346 | R | — |
| 456 | IM001074 | AGAGGAGAAATGGGGGTGCGAGAGGACAAAGTCTGTGCCCCACAGCGCTGGGGCCAGAGCCCAGGAGGGCCTCATGGGAGAGGTTGCCTGAAGGCAGTAAGAGAGGCAGAGGATGCTTGGGCCAGAGAGGTTCCCCACAATTGCTTGGATC | p001348 | D | — |
| 457 | IM001075 | GATCCCAAACAACTGGAACAGGGGTTATCCCAAAAGCTGTTGCCTG | p001349 | D | — |
| 458 | IM001076 | GATCCAACTCCTCTTCACAAAGAGACTATGTGCAGGATGGAGAAGAAGATGTATCCAAGCATATCCTGTGAAATTTATGTCAATGCTGTGAAATTTGTCCCAGCACTCACAATCCAGATCTGCTTTTTAGGTGGCTTTTTCTATTTCATTTCTTCTGGCTTCATAGAAGTTTGAGGTGACATTTTAAGACCTGTGCCACTAAAATTTCAGACCCTATTTG | p001350 | B | Mm.123802 |
| 459 | IM001077 | GATCGGTTAGTTTGACCAGCCATACTATAACTTTAGTGCAACCCTTTACTTGGTGGGTGGTACTAGGAATTAATCCCAGGACCTTCACATATACTACTATCATTGAGTTACATTTCTAGCCCTTTTAACCAATTTCCCTTTAACCCTTTTTATCCTTTG | p001351 | D | — |
| 460 | IM001078 | CTCAAGATTCTGTTGTCTGAGAATCTCTCCCTCTGCTTGGGGACCCATTTATAATGAGGTGATACTTCATCTGAAGTAATGGCCAGGCCACGGTGTGAGACTCTTGAATGTCACATGCTGGATC | p001352 | D | — |

TABLE 2

| SAGRES # | SEQUENCE | SEQ ID # | CLASS. | GENE |
|---|---|---|---|---|
| IM000127 | CATGTGAGACTTGTTAATTTAGATTTATTCTGTAGTGTTTTTGATATGAGTATAAATAAGACAATTAAATTCTATATTAGAAAGTGGCTTTTTACATTGAATATGCTTTCAGGATATGCGTGAGAATTTGGCGATGTGTAATC | 461 | D | — |
| IM000128 | CCTTACTGCAGAGATGACTCGGCCAACGGCTNCGAGCTCCTGACCACTTCCTCAGGTTTGGTTTTGTTAGTTTTTCTCACAGCAATGGGAAGCATAATCAATACAACTTCCCAGAATGCGACCTGTGACAAGACCAATGAGCAGACTCAAGGCTGGGCACATAAAAGCACCAAAAAAAAAAAAAAATTCCCTTGCAATTATTGTTCATG | 462 | D | — |
| IM000129 | GCTGCTCATCACCAAAGGAAGTCAGGACTGGAACTCAAGCAGGTCAGGAAGCAGGAGTTGATGCAGAGGCCATG | 463 | R | |
| IM000130 | CATGGCAAGATGGAGACTTTGTCTACCAGGGCCACTCCAAGCACCCAGCTG | 464 | K | Fgf3/Fgf4 |
| IM000131 | GTGAAAGGGCAGAAATAATTCCTGAAGGTTGTCCTCTGCCTTCTACATG | 465 | C | — |
| IM000132 | CATGACTATGTTTCTTTTAGGTATATCTGAATAGTATGGATCTAAATGATGAAGTTACACCATTTTCTACAAATGGGCACAGAACACAGGGCATAGATACAAATGGCAAGGTGAACCCAGATCTCTGTGCTTATCTGCAATATAACAACACTAAGAAATATTAGGTCTCTCTGTGGTTTTCCTTAAATCTA | 466 | D | — |
| IM000133 | GTATTTCCTGTCAGAGGAAAAGAGTTTTCAAAAACTTTTAAAATTTTTATTTGTTAGCCTGGACCAGTTTCATAGCAACCTGTCATCCATATCCTCAGATTCACTTATGAGTTTGTCTGCCCATTAAGATCTTTAAAATGGTTCTAACAGCTTACTTCATTGTTCATTAGTAAAGGGTTTATATCTACACTTTGATATTTGCTTACTCCATACATG | 467 | D | — |
| IM000134 | CATGAGATGAAAAAGAACCTTTTGGACTTGAATTTTGTTGCTTCAAATGCGTACTGCAGTTGATGGAAATT | 468 | D | — |
| IM000135 | AGGGTCCCTTCAACTTCCTCAGAGCCAAGGCTGACTTACTACCGTTCCCCAAGATCTCATG | 469 | D | — |
| IM000136 | CATGCCTCTGGAAAGTACCTTAAACATAGAATCCCCTCCCTAGTG | 470 | K | AAyb |
| IM000137 | CCAGATCCCATTAACAGATGGTTGTGAGTCACCATG | 471 | K | Wnt1 |
| IM000138 | CATGACTTCTTTCATTTCTTCTGTGTGTCTGTCTTCCTGTGTTTGCCTGCCCTCTCTTTCTCTTCTAACAGCCCCCTTGAACCAACTGATGCGCTGTCTTCGGAAATACCAATCCCGGACTCCCAGCCCCCTCCTCCATTCTGTCCCAGT | 472 | K | Braf |
| IM000139 | CATGGGAATGTAATGTATTAATGAATATTATATAAAAGAGGCTAAATAGCTTGGCTTTAATTTCTCACTTTGCCTACTCAATTGAGAAGTTTATGGATCACCAAAAGT | 473 | D | — |
| IM000140 | CATGTCCTTATTCTAGGAAGCCCCCTTTTTTACCCCTGCCTCTGAGAGAAACAG | 474 | D | — |
| IM000141 | CATGAACACCCAAATCCATATGAATACACACATAAAATATTTTATTTTCTCTATAATTTATGCCCACC | 475 | D | — |
| IM000142 | GAAAGCATTGAAATATACTGGCCTTATTAATGGCACATG | 476 | D | — |
| IM000143 | CATGTGCACACACCCCACAAATGACCTCAGATGTCAGTGGTACTGAAACTGAGAAACTGATGATAGAGCCAGTAAAAATACTGAAAGTGCCTGTTTTGAGAGTTTATATTTTACAATACTTTAATATCTAACTACACACATACACCTGAAAAGGGCTCAGAATACACAGGCCTGAGATGGCTCTCAAGAACCAGCCTC | 477 | D | — |

TABLE 2-continued

| SAGRES # | SEQUENCE | SEQ ID # | CLASS. | GENE |
|---|---|---|---|---|
| IM000144 | GGCCTTCCACTGCTCAAAGCTCAGACTGCAGAAAAGGTTGATAGCCTCCCAGGGGCAATGACACCCTTTCTGCTTGAGCTTCCCCCCCCCCCTCTCAGGATGTAGTCATG | 478 | K | Wnt1 |
| IM000145 | CATGCCAGTCCACATCTGCTTCTATGACAPATGCCACATCCCAACGACAAACTCACTCATTCTTCCTGTATCAATTTACGCATACACATAATACTTTTGCTCAAGGTACATTCATATTTCCGGCAAACAGACAGCTATAG | 479 | D |  |
| IM000146 | CATGTCACTCACTTGGAGAAAGAGTTCTAATTATTTATCACGGCATTTTTCACAACTATAGAAATAAAGTTAATTTCTTTGGAAATAAAGTTGAAGTTGTAATTTCCAGATGGGCTCAGGTTGCTGTT | 480 | B | AATTT.60552 |
| IM000147 | CTCCTCCTAAAAGAAAAAAGGAAAAGAAAAGTTAAACCTGCAACAGCATCAGCAGAGCTCACCCCTCCTCACCTGCAGCCCTGGTTGCCTCTCTTCCTTTCATG | 481 | D | — |
| IM000148 | GAAAACACTGTTCTGGGTTCAGGGGTTACTTAGCCTTGGAATCAGAGTCTACCCAGAGTCTACCTGCTTCTACCCAAAGCAGGTGGAAGAAGCTGCCAGGACGGGGCTCAGAGTCTACATTTGAACTCCCTGTGCCAAGAAGTCTGGATAGAGTATAGTGTCTGTATATTCTAAACTTTCTGGAACAACCCCTGCTTACAATACTCTTTCCAACTCTCAGGCCATG | 482 | D | — |
| IM000149 | ACCTCTGTGCCAGCTTCTCGGACATTTAACAACTCTGGATCATG | 483 | K | Fgf3/Fgf4 |
| IM000150 | CTGGCAGTAACACACTTAAACTGCTAGCACCTGGGAAGTGGAAATAAGATCAGGAGCTCAATCAAGGTCATCCTCAGCTAAACAAGACCCCCCCCAAAAAAAAGAAGAAGATGGCCTAGAAAGAGAACTCAGCAGCTGCTGATCTTACAGATGACTAGAGTTTGGTTACCAGCACCCACATG | 484 | D | — |
| IM000151 | CATGCCTGGTCCCTGCTGAGTGCAGAAGAGGGTGTCAGATTCCTTGGAACTGGAGTTATATACAGTCGTGTGTCACTGTGGGTGCTGGGAACTGAACCTGTGTCCTCTGCAAAAACAAGAGGTCTTGGTTGTTGTTGTTTTGTTTGAAACAGGGTTTCTCTATGTGGCCCTG | 485 | C | — |
| IM000152 | GCAGGAGCCCTTGTGCAGGCCACAACCTGCACAGCTGTACAAGGCCTGCCTGACTGCCTGAACAGATGTGTGGGATCTTGCCCCCCTTGTGCAGGCGTACAGATGCAGACTGCTCAGAGACACACATG | 486 | K | Fgf3/Fgf4 |
| IM000153 | CATGGGCTAGACCTACACTGAGTTGTGCTAAAGAAGTGAC | 487 | D | — |
| IM000154 | CATGTCCTCCACAGCTGAGCACCCTCAACTGTCTCCCAGGGCCTCTGTTCTATCCAGGGTCTGCAGGGTCTCTGCCCCACGCCTAGCCCCTGAGAAATCTTAAGCAGTCTGAAAACTACGCCACTGAACTGCTAAAACCCTGGAGTCACTGATGGAA | 488 | K | Fgf3/Fgf4 |
| IM000155 | TAGTGCTAGACTCTGCCTTTTCACCTGGCATAGATTCACCTTTTTCCAGATATCCAGGGCACTTGCAAAGAAGCCAGGCATCATCAGGGGTTTGGACTTCCAGCCAGAGTCTGAGTTGTCACTTGAATGTGCTGCATTTTGTTGGATTCAGCCCCAGTCTCCCGACTCTTTGTGAGTTTAGGATAATAATCACAACAGCACCCCTTCTTATTTGATGGCTAATAAGCTCTAGGCCAGTGTCTTAGCTCCATTCATG | 489 | D | — |
| IM000156 | CATGTATTCTGAGAGTAGAATTTATACCCAGAGAATACCTAAGAAGTGAACTGACGCCGGGCGTGGTGCCGCACGCCTTTAATCCCAGCAGTTGGGAGGCAGAGGCAGGTGAATTTCTGAGTTTG | 490 | D | — |

TABLE 2-continued

| SAGRES # | SEQUENCE | SEQ ID # | CLASS. | GENE |
|---|---|---|---|---|
| | AGGCCAGCCTGGTCTACAAAGTGAG TTCCAGGACAGCCAGG | | | |
| IM000157 | GCCTGGTGTGGTAGCTCACACCTTT AATCCCAGCACTCATCTCTGTGATTT GCTAGGCCAGCCTGGTATACACAGT GAGTTACACATCAGCCATG | 491 | K | Fgf3/Fgf4 |
| IM000158 | CGACATCCAACTTCTGGAAGGAGAG ATGGGAAGGGCATTTGGGGTGCTA GGAAGGGATGGGAGGTGTCCCTAGA GCAGTGCTCATG | 492 | K | Wnt3 |
| IM000159 | CATGAAATAATGCCTTCAGAACTGCA TTAGAAATCACAAATAGCCCTGAATG CCCTCTAGATGCTTTTCTTGAGAACA ATTATGTGTTAAAGTCCTAAGGCCCT TGTCAGCCCACCATATGGAAAGGGA GAACTAACTGAAATGGGAGTT | 493 | D | — |
| IM000160 | ACTGACAAGAATAGAGAGAAGTTCA GTCATG | 494 | D | — |
| IM000161 | GTGTCCTGCTCCTGTCTGGGTCAAG GTCATAAAAGATGAGCCAAGGCTGA CTTCAGTGCCCACCTGGGGAGACTG ATGTCTTCACAGGAATGCTCACCTG GAAGGTGTCCTCTGGGTGCATCTGT GTCACATTCGGTATAGAAGGAAGAAT GCCAACAATACTCTAAAAATATTAGA GGCCTTGAGAGTCCTCAGTGGTATT CCACCAACATCAAAGCTGCATCGTAA TATGCCAGCCTGGTCCTCACCTTTCC TGCCCTTCCCAGGAAAACATCAGCC TTTAACCTCAGCCCATAGGGGACATG | 495 | D | — |
| IM000162 | AGGATCTTATAAAAATAACAGTGACC CAAAACATAATTTTTGCCATCAAGAA TCTCAAAATCAAGTCTCATCCAAGTC TACTCTTCTTTATTGTATCTTAAACAC ACACACACGCACACATCACACAAGC ACACACACAAGAATTCACACACATAC ATG | 496 | K | Wnt1 |
| IM000163 | CATGGTATTCTGATGATAGTACCAAC ATACTGCTGCAGCTAGCTGTATCTG GAAATCCCAACCTCAGCCAAGTATTT GTGGTTGAAATAACCTATACTTCTCA CATCAAACAC | 497 | D | |
| IM000164 | ACTGTGACCTGAGCACTTCTTGTCTT ATCAATAGCTCACGTGCCCAGGCCG GGTGACCAGTCTCTAGGATGTTCTC CATG | 498 | K | Fgf3/Fgf4 |
| IM000165 | CATGCACACAAACTGGCCCTGAACT TTTGACTTCCAGGCCTCTGCCTCTCT GCGCGCACACACACACTCGCACTCC TGTATATGAAGCGTATATGTGTTTCT CTGGGAACTGTTTTTATCAGGTGAAG CACTTCCTTTGTTCTTGCTACCCACC TCCAGGGCTCCAGGATCTCCAGACA GCCAACCCTAAGACAGGCCCAGCTT CCTCTGTATCTCTGTGATGAGAACCT TGGCATAGAGCTGCCCTCACCCTCG GGATAGGGCTTATGTTCCCCGGAAC GAGCCAGGCACCTCAACAGCTCCTG GGGAGGAATAGGGGACT | 499 | K | Fgf3/Fgf4 |
| IM000166 | CATGGCACTATGAAGGAAATGAAGA TACAAAAGATTTCCCATACAAAGGGT CAACTGTTCAATTTGGCATTTATT | 500 | D | — |
| IM000167 | CATGATAGAAGACCACGTCTGGGAT GGGGTAAGGGTTTCTCAGAGTACCT TGCCCTGGGGCCACATCCTAAATCT ACAACAAAGCT | 501 | D | — |
| IM000168 | CATGCAAAAGAATTCCAAATGATTTT ACAGATCTTAGCCCTCTAAGAGATAG ATATAGCACAAGTCCTGACTCCTGAG GTAGGTACACACTGACTTCCTTCCAC AAGCACTGCCTCAGCCCGGAGATGA AGGTCACATCAATAGAGACAAGTCA GGTTAACCGTGAGCAACCTCAAGAC AAGGAGGAGCACAGCATAGGTCGGT GGAAGTGTTTGCATAAGCCTAAGGC CTGGGCCCAGTCACCAGCATTGCAG | 502 | C | — |

TABLE 2-continued

| SAGRES # | SEQUENCE | SEQ ID # | CLASS. | GENE |
|---|---|---|---|---|
| | AGGAAAAGGAAAAACAGATAGTAGG TGCCTTGGTGTGT | | | |
| IM000169 | CATGCAGTTTACCAATCTTTTTCCAC TCTTTAAAAAGACAAAAAATATTAGAA TACTGGGCTGAGGAATGGCTCATCA GTTAAGAGCGCTGCTCTTTTGAAGG ACTCCCGTTCTGTTCCAAATGCCCAC CTGGAGGCTATCCTGTAGCTAGAGG T | 503 | D | — |
| IM000170 | AGGAAGTGCTGAATAGAGAGGTTTG GGGAGAGCCCAACAATCTGACCTAT TTATACCCTGCCAGGCCCTGCCCAT G | 504 | K | S100a4 |
| IM000171 | CATGGTGCTGGAGGATCATCCATCC TGACATTCTGGGA | 505 | R | — |
| IM000172 | CTTTAACCCATTTATGGTGTGACCAG AAACCACAGATCTTACCTAGGCTTCA GACACATCACCCGAGGAAAGCTCCA TTAAAATCCTCATTCATG | 506 | D | — |
| IM000173 | CATGTATTCATAAGTGGATATTAGCA AGAAAGTACAGGCTAAT | 507 | D | — |
| IM000174 | CCTCTGGAAGTCAAGTGCAGCTTTG CTTATTTGTTTAAGCCATCCACCATC CAGTTATTAGATCTGAATTCATCTTTT AGGGTCAGCTTTGTTGTAGATTTAGG ATGTGGCCCCAGGGCAAGGTACTCT GAGAAACCCTTACCCCATCCCAGAC GTGGTCTTCTATCATG | 508 | D | — |
| IM000175 | GTTTTCTTTCTTTTTTTTTAAAAGAA ACAGTCTCAAGTAGCCCAGGCAGTC CCTAAACTTATTATATAGCCCAGGAC AGTCTTGAATTCCTGAACCTCCCTCC TCTACCTCGTAGTCCTGAGACCGATT GCATG | 509 | D | — |
| IM000176 | AGAGACCCAGAAATACCAAGGTGAT TTCCAACTGCCTGACCTGGGAGGCA AGCATG | 510 | D | — |
| IM000177 | CATGTAAGATCTTCACTTTTCCAGTG TCTGTTTGTGCTGCCTTCAAACTGTT GACCTGATGTAAAAATGTTTGCATCA GCTCAGGTGTATAGAATTGGACTGAT TCCAGGAGAGTCAAATATACAGAATA TCTAGTGTCCAAGAT | 511 | D | — |
| IM000178 | CATGCTAATGGAGTTTATTCTTAGGA CTGCCTCCTGCATCCATTGATTGACT TAAATATGTGCACACT | 512 | D | — |
| IM000179 | ACTAGGTGACTGTCTCAGGGTCTCA CTGTGTAGTCCTGGCCTAGAACTCT CTATGGAGACCAGCCAGACCTCACA CTCAGATCCAGATGCCTCAGCCTCC TAAGTGCTGGGATTAAAGGCCAGTC CCACCATACCCTGCCCCTGTTTCTGA CATTTGAACCCCTCCTTTAGACAGTA GGGAAACTGAGGCCCTGAGATATGA CACTTTTAGGGGCATG | 513 | R | — |
| IM000180 | AAACTTTCAGAAAGCGGGGGCTACCA AGGAGACTCAATTAAGATCTCTCCTC GATCTTGAAACCATCCCCAGCCCTTC GCAAAGCACATTTGACGGACAGGGT TCTCTTGTCTTGGGCAACACATCCCG GCTACGCTCTGCAGGGTGAAGCTGT TAAGAACGTTCCATG | 514 | D | — |
| IM000181 | GATAAGCCTCTACAAAGCTGGAGAG GGCAGTCCAAAGAAACTTGAAAAGA TTAAAAGACAGTGCCTAAGGACACAA ACGTTTTTCCATAAAGAGCCTATGAC ATATTTTACTGCTGCTAATGAAACTG ACCTTGAAGGAACAAGTGTTTAGGG TTAGCCTAAACTTTGGAATTGGTGAA GGCAATGTGTCAGCTAGACAAATTA GAGAAAGAACTCAACAGATGAGTCA ATGAATTGTTCTAAACTAGCTTGACT TAGGATTTTCAGCACAGGAACAAAAG CACATACTGTCCCTCTGGTTGGCAT G | 515 | D | — |
| IM000182 | CATGGAAAATGATAAAAACCACACTC TAGAACATATTAGAGGAGTGAGTTAC | 516 | R | — |

TABLE 2-continued

| SAGRES # | SEQUENCE | SEQ ID # | CLASS. | GENE |
|---|---|---|---|---|
| | CCTGAAGAACACATTCGTTGGAAAC GGATATTGTGTAA | | | |
| IM000183 | CATGCCCGGCTCTATTACTATTTCTT TCTTTCTTTTTTGTTTCAGGATCCAGT TTCCTTGATAAATTTTTCTTGAATGTT GTTGTTGTTTTTTCTTTTGCTGAGTTT TTCTTCAATACTGCTGCTTTTTCTCTC CAGGTTCAGGATGAGA | 517 | D | — |
| IM000184 | CATGCTGTCACTAAGCTGTGCTCTTC CAAGGAGATGAAGAGACTAGCTGGT ACCCTTGCTATGCCAGGCTTTCTTCT TGTTTATACACACCTAATG | 518 | D | — |
| IM000185 | CATGATCTAATCTGAACTTGTATCCC AACCCTTTATAAACAAGTGAATGTGT AATCTAAACTAGTATAAGCTCTTGAA TAATAGCTGAGTGAATTGCCTTTGAT ACACGTTTCCAAATTAGTAGCC | 519 | D | — |
| IM000186 | GTCAACCACAGCAGTACTGTTACTTT CTGTGGGGAGACGTCTCCCCTCCT CATG | 520 | D | — |
| IM000187 | GGCAGTGAGCTTGCCCACTCTGCTAC AGGACCTCGGTGACCCACTATATACAG CCCTCTTCACTACGGCTCACAATCGG AGTTTTGACCCAGTGAAGTAAACCCAG CAGGACCCTTTACAAAGCCAGGACATG | 521 | D | — |
| IM000188 | CTTGTCCAAACCAGCTTAGTCAACAG CCTCCTATCTGGGCTCCATCTTACCC TCCTCATCTAGCTGATGAATGTACCT GCCTTCTGTTCCCTTCCTCCTGGTCT GAGCTGAGCCTTCTTGGGACTGAGA GCCTTCATCCACCACAGGCAGACTA TCTTTAGATCATCATAGCCCCAGGTC TTCATTGCAGTGCAAAGTGCAGAC CTTACATTTCCATTTTTATGCTCCCTT TGTAACGGCTCCTTACCGGACTGCA GCATAAGTGGCTGAGTATCCAATCA CAATAGAACACTTAGTTGTTTGCTTG TCTAACTCTCTCAGTTACACCATTGA GTATGTTACACAGGGCTGCTTTGTAG CTGTCACTGAGGCCACAAGGCAAGG GGACTAAGGCAGGACTCAGATGAGC CTGTTTTTACTTCCCGTTGTCCCTTT CACTTTGGGTTGAGCATG | 522 | D | — |
| IM000189 | ATATAGACTCAATCAAGGTATTATTC TGGAACAAACAACTAGTAACAAAAAT AGTGCAATTGCAAGTATGATAACACA AGGCAGCCTTTACCAGCTTTGTCGG AAGGAAATTGTTCTTTGAAATCTGAA TTCCAGAGAAAAAGTCAAATGTAAAC TAGAAGTGTTTGCATG | 523 | D | — |
| IM000190 | CATGTATGTGCGTGTGTGAGTGCAT CAACACAAGTGCATAGATGCGTGTG TGTTTGTGTGTCTGACTGTTTAAGTA GGTGGCATCTGTCCTAGTCCTGACT TTTGATAAGTCTACACGTTTGATAAG AGGATCTCTCACCACTCAGGTTCC TCCCCCCACCTCCACCCCAGTACAC AGCCATAACTATAAACTCCCCACGCA GATGAAGCCCCTCTGATCCCATTTTA GGGACATAACACCCCCCTCCCAGAC TGAGCTAATGCCTTGGACCCTCCAA AACTGATCTGAACCCTCTCTGACCCT GCCCTCCTCCCAGCACAGGGCAA | 524 | B | BF1638 10 |
| IM000191 | CATGATTTTCAGTTTTCTTGCCATATT CCACGTCCTACAGTGGACATTTCTAA ATTTTCCACCTTTTTCAGTTTTCGTCG CCATATTTCACGTCCTAAAGTG | 525 | R | — |
| IM000192 | AAGTATGTCTGCTATGAGTCAAAAGT CTTATTTTTGCATCACATG | 526 | D | — |
| IM000193 | CATGCCGCAGTGGCCAGCAGCCCTG GTTCCAGCATTCTCAGAGATAACAAG GAGCCAGTGACCCTTTCTTCAAGCA CCAAAGAAAAGCTAACCGACCCCAC AAAGACCTGAGTATGAATGGTTTCTG CAGCTAAGGCACTTCCTTTGAGGTC AGCGCAGTTCGGGGCTGAGAAAAGA GCTTGCCCTGGCTTAGAGCCTTTCT | 527 | K | Fgf3/Fg f4 |

TABLE 2-continued

| SAGRES # | SEQUENCE | SEQ ID # | CLASS. | GENE |
|---|---|---|---|---|
| | CTGGCTCACTGTCCCAGCCAGGACC CATCCATCAGCCCACAGTGGGGTGG CATAGTGCAATCCTAGAGAGATGTTC AAAGGGACATATC | | | |
| IM000194 | ATTCTCTGGGTTTTCCTGTGGTGCTC TGGACCCCTCTCGCTCCTACAATCCT TCCTCCCCATCTTCCACTGCTCTGCC TAGTATTTGGCTGTGAGTCTCTGCAT CTGTTTCCATG | 528 | R | — |
| IM000195 | CATGCCCCTCTCGACCCTGGGAGCA TTCACCATCTTTATAAACTGATTCTTT CTGGGAAGATGATG | 529 | D | — |
| IM000196 | CATGAAACACACTTTTAACTTTCCAC ATACTTTTAAAAGTGTACCTTCCAT TTTTTCGCCCCTAGACCCAAATTGGA TGTTTCTGGCTCCCTCTCGTTCGTAG CTTTCCTGTGATGTAGAAACCTCTTA GAAACCACACC | 530 | D | — |
| IM000197 | GTTTCCCACGGTGGAAGAGGCAAAC AAGATCCCTTGGGCCTGCCTTCTTGT GGCACTAATCTTACTCATG | 531 | D | — |
| IM000198 | ATGTGGTGTTTAAATGAGAATGTGGC CCATAGGCTCATATGTTGAATACNTA TTTTCCAGTACTTGGAAGTATTTGGG GAGGACTAGAGGTGTGACTTTTTGA AGGGGGTGTATTATGTGGATGTACT AAGAACCTTTAAATCCCTCTGACCAT G | 532 | D | — |
| IM000199 | GCATCATAGTTGTACCATG CATGGGTTAACAGTGGGCCCTAAAC | 533 | D | — |
| IM000200 | TTGAACTAGAAAACTTAAAGATG CAAGTCTGTCTGTCTCCTTACTAGCC | 534 | K | Wnt1 |
| IM000201 | TTTTGCTGTTCTGACTCTCAAATGGT TCCTTAATTGGCCATTTGTCCCCTAA ATTAGGGGCGATTAGGATCAACACT CAAGCAATGTTCCAGATGGGGTCTG ACGTTCCTCACTGGGGTCCCAGGGC TCCTCTGACTTGGTCACAGAAAGGT CAGCCCTCTGACCTGGCATAGATGT CTGGATGACCTCTGACCTCAGCTCA TAAACCTGACTGTGGAGATTGAGACT GGAGGGACTCAGGGCAGTGGCTCA CTGGACAGTGCCAGGGTGTGCAGTG GTAGGCAGACTTCTATGTCAGGTCC TCCTGTGCCTCCATG | 535 | K | Fgf3/Fg f4 |
| IM000202 | GCACATATCTGAGCATCTCAAGAAG CTGAAGCAGCAGAATCATCCGCTCG AAGCAAGTGTAAGCCAATAAGAAGA CTCTGTCTCAGAAGAAACTGAAACGA AGAGAGACAAAAACAACTTCTGGGG CTGAAGAGATGGCTCAGCAATTAAAA GCCCATTCTGCTCACTCAGAGGCCC TCTGTGAGCTGTCTCCAGATGTTTAA CAAGCACAGCTAACATTTGGCATG | 536 | R | — |
| IM000203 | CACATTCATTAAAGAGACTTTATTAAA GCTCAAAGCACATATTGCACCTCACA CAATAATTGTGGGAGACTTCAACACA CCACTTTCATCAATGGACAGATCATG | 537 | R | — |
| IM000204 | GGGGAGAGGCTTCAATGAGCCCCCT CACATTTGCATTTAAATAGCAGCATC AAGCGCTTCGCGTGCCACACACCAG TGGGCTCCCAGATGTCAAGCGGAG TCAGTCAGATGGCCAGTGCCCAGCT GTCCTCCCTATGTCGTGCCGGAGCA GGCAGTGACCTTAAAGAGACAGCGC TCACCGCTCCTGGAGCCCGACTCTG GGTCCCTCATG | 538 | D | — |
| IM000205 | CTTGTCCGCCACCCCGCCTGCCTCA TTACCTGGCTCACTCACTAACGTGAA AGCCTTACAGAAATCTCCAGGTCCTC AGCGGGAAAGGAAGTCATCTTCTTC CTCATCCTCGGAGGACAGAAGTCGG ATGGTAAGCATCTGTGCTGTGCTCCT CTAACTGTGACGCCGGGTTCCCATC ACATG | 539 | K | Braf |
| IM000206 | ATATAGTATGACTGCCTCAAAACAAA ACAACAACAACAAAACCCCAAGATAT | 540 | C | — |

TABLE 2-continued

| SAGRES # | SEQUENCE | SEQ ID # | CLASS. | GENE |
|---|---|---|---|---|
| | CTAAAGGAGGAACATTCCAAAAGAC AGAAATGTCCATAGACCTTGACAAAG GAACATG | | | |
| IM000207 | GTCAAGTGGATGTTTCTCATTTTCAA TGATTTTCAGTTTTCTTGACATATTTC ACGTCCTACAGTGGACATTTCTAAAT ATTCCACATTTTTCAGTTTTCCTCGC CATATTTCACGTCCTAAAGTGTGTAT TTCTCATTTTCCGTGATTTTCAGTTTT CTCGCCATATTCCAGGTCCTTTAGTG TGCATTTCGCATTTTCACGTTTTTTA GTGATTTTGTCATTTTCAAGTTGTCA AGTGGATGTTTCTCATTTTCCATG | 541 | R | — |
| IM000208 | CATGAAGTTAGAATAATTGGGATAAA GCTTTTATCATTATCAATTGGTTTTGA AATTATTGTATTGATATCTTGTAAACT GAATATTTATTGGTACATAAGTCTGG TTATGGTTGACTACTTTAAGTTTTAAG AGTTTTGATTCTTCCAGGTAAATGGG TGTTGTAATG | 542 | R | — |
| IM000209 | CATGCAGCCGGGGTGGGATTTGAAG ATTATGCCTAGTGAATATTTAATATTA AACACGGTGTGATCGAATTGATAGCT GTTGAAAACTAGAGCGAAACC | 543 | D | — |
| IM000210 | GGACAGGGTCTCTCTCTCTTGTTGTT CATTGTTTCATATATCATCGTCGGCC TGCTTACAGACTGCATTGTGTTCCCC TGTCTCTGCCTCCCATCTCACTGTAG AAGTAATGGGATTACAGATAGATGCT ACTGTGTCTGAAAGTTAAATTCCTAG GCCCCATG | 544 | D | — |
| IM000211 | AGTGGGAGGGAGCGCCACTCTTGGA GCTAGGCAGGAACTGTTGTTACTTCA AAAACTAACAAGACAATCTCACATTC CTGAGCTGAAGACCAGATGCAGCCA GGGACAGGGTTCTGCCCTGGCCACT AGATGGGCTCTCTGGCCCTGCTAAA GCACTGCACAAAACTGGACGAGGTG CACCAAGAGTCCCGTGTTTGGCCCT CAGGGCAGACTAGAGAGCAGGACTT TCTCCTGGGAGCAGAAACTGAGCCT GGGGTCTTCATG | 545 | K | Fgf3/Fgf4 |
| IM000212 | CATGCTCATAATTCTGCAGTGCCTTC TCATAACACAGGATAAAACACTCTAA CCTTTTAACATTATACTTGAAAACTTAT GTGGTTTTTTCCTACCAGAGTCATAT CAAACCAGTCTCCCTCTCCACTCACA AGGATCCAGTCACAATGGCCTTTTA | 546 | D | — |
| IM000213 | CTGTAGGACCTGGAATATGGTGAGA AAACTGAAAATCACGGAAAATGAGAA ATACACACTTTAGGACGTGAAATATG GCGAGGAAAACTGAAAAAAGTGGAA AATATAGAAATGTTCACTGTAGGACA TG | 547 | R | — |
| IM000214 | CATGGCGAGATTCTGTGTCCAAGCT GCCTCTACTCGTGACATTCCAAGATG CCTCTGAGGTGGGAACTGTGAAATA GGACAGAGCCCCACAGTCCCTCTT | 548 | K | Wnt3 |
| IM000215 | CATGGGGGGGGTACCAAGAAGGG ACTGCTGTGATTGGGATGTAAATAAA TAAATAAATAGAATAAACAAAACCCA AAAACAAACAGAAACCTAAACTCAAT AACTGCAGAAATGACTCTTGCTCTTT TCTGGTAAGGTTAGAAGCAGGTTAC AAATCTATATTAGAGATGGAGGCATT TCACACCAGCATAGGTATAGGAAGT AGATGAAATGAGGACTACACTAGAG TCTGTTTGTCACAACCAATTCTGAGT GATTTCACTGAGATAT | 549 | D | — |
| IM000216 | CTCTGAGAAACCTACCCCATTCTCCC TCCTTTCTCCCATAAGCAACCACCTC CACAGCATTATCAAAAGACTGCTGAC AGATTGGTGGCTCAGCAGGGAGAGT CAGAGCTGTTTCTTAGGTCTAAGTTG TAGCTCCACAGTAGTATGTTCTCCAT G | 550 | D | — |

TABLE 2-continued

| SAGRES # | SEQUENCE | SEQ ID # | CLASS. | GENE |
|---|---|---|---|---|
| IM000217 | CATGGAACACTCAAAGCTGGCCAGG GCCCATTTACCAGGTATCCTTTGCCT TCTCAGCTGATGGGCATCAACACATT AATTCACATATGACTCGTTTGTGTCA TATCAATAGTAT | 551 | D | — |
| IM000218 | GTGGTTTTTGTGGTAGAGAGACACA GAAGAAACTGAAGTCCTTGGAACATA ATTATCACTGTGGTTAATGTTTGTG TTCCTATAACATCCTATGTAGGAACT GAACCTATAAAAGTAGTGGCTCCGA AGGTGGTGTCCTTAAATGTGAACTG GGCTACAAGATTTTGCCCTTGTGAAT GGCTTTATGGAAGAGGCTGTCACTTT TCTGTCTCTTCCTCCATTATCTTGGA AGACACAACAGTTCAAGGTCTCATCT GGGAAACAGAGACCTTTACCAGACC CTAAATCTGCCAGTGGTGTCTTGATC CTGGTCTTTCTGTCCTTAGGAGCTAT AATGCATG | 552 | D | — |
| IM000219 | GGCCACAGCCAGTCCACCTGTATGC AGCTGGGTGCTTGGAGTGGCCCTGG TAGACAAAGTCTCCATCTTGCCATG | 553 | K | Fgf3/Fg f4 |
| IM000220 | CCTTAGGGCCCAAAATCCTTCCTCC CATTCTTCCATAAGAGTCCCCAATCT CCATCCACTGTTCACCTGTGGGTGT GTGTATCTGTCTAAGTCAGCTGCTAG GTGGAGATGCTCAAAGGACAACATG | 554 | R | — |
| IM000221 | GACAGTAAAGAAGACAAAGAAGTGA GTAGAGCTGGATGAAAACTAGGAAG TTCAGACAAAGACTGCGGGAATGAN GTGTAGAGTCTAGAGCCCAAACAGT TAAACATG | 555 | D | — |
| IM000222 | CTGCTACATTCTTAGCTCTAGCTAAC TAGCATCAATTGTCCCAACCCCTTCT ATGTATGACTCCAAAGCCAGTGTCAC ATG | 556 | R | — |
| IM000223 | CATGGTCTCTAGAGCTAAGAGATAC CAATGCTGCGGCAGGCAGTTTTTATT ACAATCATTACAGTTTTGACAGTGTC TGGCCGTGTGCCAAGGCTGGCCTTC ATCCCTGAGCTCGGTGATGCTTCTG TCCTGGTCTTCTGGCTCGTCACAGC TTAAGAAAGTAGCTGCTTCTC | 557 | D | — |
| IM000224 | CATGGAAAATGATAAAAACCACACTG TAGAACATATTAGATGAGTGAGTTAC ACTGAAAAACACATTCGTTGGAAACG GGATTTGTATATCAATGAGTAGTT A | 558 | R | — |
| IM000225 | CATGGAAAGATAATGTGTAAATTTGG GTTTGCCGTGGAAAACTTTGGTTTCT CCATCAATGGTAATTGAGAGTTTGGC TGGGTATAGTAGCCTGGGCTGGCAT TTTTGTTCTCTTAAGGTCTGTATGAA GTCTGTCCAGGATCTTCTGACTCTCA TAATGTCTGGTGTAAAGTCTGGTGTA ATTCTGACAGGCCTGCCTTTATATGT TACTTGACCTTTTTCCCTTACTGCTTT TAATATTCTA | 559 | R | — |
| IM000226 | GGTAAGAGTGGGAGAAAATGGGGGT GGGGGGTGGGGACACTGCAGAAAC CTGGGAGAAAAAAAATCCAACTAAAA TCAGGAAACACATG | 560 | D | — |
| IM000227 | CACCCCCATCCCGCAGTTCCCAGAG GGAACAGTCCCAGCAAAAATACATG | 561 | D | — |
| IM000228 | CATGGAGATGCAATGAAAGCACACA ATATTGCTGAACCAAACAGAAAGCTC AAAACTAGGCACAGAAAAGAGATAC AAACACAAATCTGAACAAATTGACCT TCTCCCTATAGCATAACTAATATCTC AGAGATAAAAGTGGTCTTTATATACC AGGGCGAAAGAGGTCTAAAAAGAGA GGAATAAAAAATATGGCATATTTCCT GTCATATGCAGAACCTATATGAGTCT TTTTGTTTGTTTCTTTCAATACAGCCT ATGTAGCTCTAGCTGTCCTAGAACTT ACTTTGTAGACCAGGCT | 562 | R | — |

TABLE 2-continued

| SAGRES # | SEQUENCE | SEQ ID # | CLASS. | GENE |
|---|---|---|---|---|
| IM000229 | CTGTTCTACAATGCCGGTTTCCAACGTATGTGTTTTTCAGTGTAACTCACTCATCTAATATGTTCTACAGTGTGGTTTTTATCATTTTCCATG | 563 | R | — |
| IM000230 | GACAGGCTCCAATCAGATATACCAAGGGCAGGAAGCACGTGACAAAATCAGATGCCTGGAGACAAGTGTAATAAAAGAAGCAACAGAAAACAAGGTTACTTGGCATTGTCACAACCCAACTCTCCCACCATAGCAAGTGATGGATACACCATCACACCAGAAAAGCAAGATATGGATCTAAAGTCACTTCTCATG | 564 | R | — |
| IM000231 | CATGGGTCCCTGAAGGGTCTCTCCTTTAGCAAACCCTGTACAGTTGAAGTGANTTTTCAGGTACCCATTGGTCTTAGC | 565 | D | — |
| IM000232 | CCCCACTCCTCACAGGGCTCCCCACATCTGCCCTGGGACACCCCACTCCTCACAGGGCTCCCCACATCTGCCCTGGCACCCCTCCATTTTTCAGGCACCTGAAGTCCCTACTTTCTAAAGGCCATTCTTCTACCTCAGGTCTTGCTCTAGGACTGTCAACATG | 566 | K | Fgf3/Fgf4 |
| IM000233 | CAGGACAGCCAGGGCTACACAGAGAAACCCTGTCTCAAAAAACAAACAAACAAAAAAAGACCATTATGCATTCCTGCGGCTCTGACATG | 567 | R | — |
| IM000234 | CATGGGCAGCACCTCGTGGAACACTATTATAAGTGTCCTCCAGTCAGGTCAACAGCGTAAGAT | 568 | D | — |
| IM000235 | CCTGTACATTCTGTGTTAAGGACAGAGGGCCTCCTGCATG | 569 | K | Fgf3/Fgf4 |
| IM000236 | CATGGAGGCGCAGGAGTTATTGTCTAAAGTTGTGAAGATGAAGCCTAGATTGTATTGGAGATCCGGGTAT | 570 | D | — |
| IM000237 | GCAGATATTTCCACCTCTGCCTTCCACAGTCCTTCCTCCCATG | 571 | C | — |
| IM000238 | CATACGCTTACAATGTGTTGTTATTTCTGGTTCTCGTCTGCCTTCTTTATAAAAACAAATCCACTAAGGTGGAGTAGCCAGCCTTTACTCAGGGACTGTCACCATG | 572 | D | — |
| IM000239 | TTCTGTATATATTGTGTGGTCAGAAAACCGTGGTTTTCCTGGTGTCAAGAGTTAACACTTTCAGTAATCACTCATTCTAAACCAGACAAACCTTTAATCTTTCATCTGGAAAGGTACTCATTCAAACCAATGCTCTCTTAAAACCAGAGTATTTAAACAGCCAACTGCATCTTCAGGGTTTCATAGAAAATCAGCTTGATCTAAAATAGTCACTGAATTCTGATATCATAGACATG | 573 | D | — |
| IM000240 | TCCACCCACCCACCCACCTGCCCACCCAGACAAATGTTCACTGAGCATTCATATACTCCATTCACTTCTAAGTACAGAGCCTAAGAATATGAGAAAATCCTCATAGCAAAGAAATGCCTCTTGCAACTCGAGTAAAAACTCGAGTATGGGATGGAAGAGTTGAGAAACAGATGATAGTATGAGAGCCTATG | 574 | D | — |
| IM000241 | AGGAGCCTAGCAGAATTGCCCTCTGAGAAGCTCCACCCAGCAGAAACAAATGCAGAGACCCATCGATAAACACTGGACAGAGCACAGAGTCTTGTGGAAGAGTTGGGGGAAGAATTGAGGAACCCAAATGGGATAGGGACTCCACAAGAAGAAAAAGAGAGTCAACTAACATG | 575 | R | — |
| IM000242 | CATGTCCTACAGTGGATATTTCTAAATTTTCCTCCTTTTTCAGTTTTCCTCGCCATATTTGAAGTCCNAAAGTGTGTATTTCTCATATTCTGTGATTTTCAGTTTTCTCGCCATATTCCAGGTCCTACAGTGTGC | 576 | R | — |
| IM000243 | CATGTGGAGGCCAGAAGTCAACATATAGTCTCCTTCCCAATTACTTGTCACTGGAGAGC | 557 | D | — |

TABLE 2-continued

| SAGRES # | SEQUENCE | SEQ ID # | CLASS. | GENE |
|---|---|---|---|---|
| IM000244 | GTTCAGTAGCCAGCAGGGGGATAGGACCAGCCCAAATTCTCCCTTTGCTTGGCCTTGACTACTAGTCTGGGAAGGGATAAGTGGGCTAACCAGAAGTCTTCCACATCTCTAAGTGATTAAAAATGGAAGACGTGATCTCTGGTCATTCATAAACAGGCATTTCTCAAAGTTGGTCTGTGCAGTTTGTGGGAAAAAATGAAATGTACTCATG | 558 | D | — |
| IM000245 | CTACAGAGTGAGGTCAAGCTCGAGGATAGCCAGGCAGGGATGCACAGGGAAACCCTGTCTCAAAAATCAAAACCAACCCAACAAACAAAAACAAAAATGGAAGGATAGAAGAGAGATAATCCATG | 579 | D | — |
| IM000246 | CATGTACTGAATCCCTGAAGTTGATGCTGAGCACCATCTTGTGCTGTTCTACCGCATTTACTGGGG | 580 | D | — |
| IM000247 | CATGTGTCACTCAAAGGCTGCTGAGAATCAGGCTGTACCTGTATTCCTAAGCCATCCACAGCCATCCTGACCCACAGCAAATGCTGGCAGTCGCCCCACAGCTGGACTCCGTTCCTCCCTCCACTCCTATAGCCGAGGCTATCCACACAGGCTATTTCAGTGCCCTAAGCCTTGCTACCCTTATGTATACATTGAGGACAATGAT | 581 | D | — |
| IM000248 | AGAAACCACTGCCAAATCAATACATTTTAATTGGAAGTGTTTATGAAGCCCAGGAGAGATCCCTAAATGTATTAATTGCTTCCTGAGGAAATATAAAACTCACAGTTACTAAAGCCATG | 582 | C | — |
| IM000249 | ATCTTCTACACAGATGAAACTGACAAAGTACAAATAAAGATTATATACCAAAATGAAAAAAAGTAAACAGCACACATTTATAGATGCATCTAGCATCCCCCAAAGCTCAACACCATCCATACTTGAAGACTGCAGTGGTCCCTCTAGACAGTATGCTCCAGGTCAGCCCTCAGCACTTGAGAATAAACAGCTTCATTTACTCAGCCTGTTGTCAGGATCCATG | 583 | K | Fgf3/Fgf4 |
| IM000250 | ACTGCCTCAAAACAAAACAACAACAACAAAACCCCAAGATATCTAAAGGAGGAACATTCCAAAAGACAGAAATGTCCATG | 584 | C | — |
| IM000251 | CATGAGCTGTCGATAGTGACCTGCAGTCAAGGAAATCTGAGGGCTTCCTAATTAACAGAGGAGCTCTAAATGAGAGTAACGCGCTCCACAAACCCCCTCACACTCGGTAAGTGTCACGGTGCAGATAAT | 585 | C | — |
| IM000252 | GCCGCGTATGTGTTTCTTTTTCATAGAAGAATTAGCACATAATGGAATGTGCGTATCTGAAGTGCACTTCTGAGGAGTATTTATTATTACATACCTTTACAAGATATCTTTTCTCAGGGAGCAACCTGAAAACATAAGGAGAAAAACATAAGAACTGCCACTCTAAGGGTTGGTGAAATGGCACAGCCTGGCGGTAGGACACACACATG | 586 | D | — |
| IM000253 | CATGGAGAAACCTGGGCTTATTCAAGCAGTTTCCTTTGTTTACCCTGCCCAGGGTTGCCAGTGAAGGGGCTCCTCCATCACTAACTAAAGGTCTTATCCTATGCTGGTTCCTCTCCACCCCACCAT | 587 | D | — |
| IM000254 | TATAGGAATAGAAATTCAGAACTTATCAGTTTGTTTTGCTTCAAATGTCAACACATAATAAATTTACAAACCCCTTGCACATTTGCATG | 588 | C | — |
| IM000255 | GAAGACAAAAGATGTGTCAAATACCTGGGCAAAAGGGGTGGTGGTGCTCTCTTTCCAACTCCTGAAAGACACCTCTGCTCAGCACACTAGTTTCCAGGTTCCTGGGTTAGGATTTGGGTGAGATTGGTCGGCGATGGTTTGGTTCCTCCATTCTGCTGCTTCTCCCTGATACATTGAGTTACAGCAGCCCACGCGTACACACTCTCGCACATG | 589 | K | Wnt1 |

TABLE 2-continued

| SAGRES # | SEQUENCE | SEQ ID # | CLASS. | GENE |
|---|---|---|---|---|
| IM000256 | GAAGAGGAAATAAGGCAATAGCTAGACTGGAAAAACGAGCCAGCCTAAGAAGCTGCAGAGTAGTCTGTGGGGTTCTGCTTTGGTTAGCTGCCTTTAGTGCTCATG | 590 | D | — |
| IM000257 | CATGGATAGAGGATGGAAGTTGAAAACCTGCTATTAAGAACATAGCCCTGTCCATTAGTGAGAGTG | 591 | D | — |
| IM000258 | CATGTGGCCCAGGGGCACTTGGAGCCTTAGATAGCTGCCTTTATGGCTCCTGGTGGCCTTGGATGTGGGTGGGTGACAGGAAAGAGGAAGAGCTGGATAGTGGGGGGTCCCCAGGAGGAGCTAGCTGTGCTCTCTATCACTTTTGCTCTCCTGGGGCTACCCCCGTCTCAGGGGAAGGCCTGTGACTGGCTAAGCTACAAGTGTGGGCTGAGACCTTTCTCTGTGACACTCTGGTGCTACTCTGGCCATAGCACAGATCTCTAGGAACGCACTCT | 592 | K | Fgf3/Fgf4 |
| IM000259 | TATATGGATATGTTTATGTGAGGGTAGGCACTCCTGGAGGGTGGAGGCATTAATTAGATCCTCTGCAGGTGAGCCACCTGACATG | 593 | D | — |
| IM000260 | ATATGTGGACTGTAGTCATCTTGAACATCTGTAACAAAATATATAGATTAGGAGGTTTAGACAGCAGACATG | 594 | D | — |
| IM000261 | GTGCCTCTTGTCTGCCTAGCTGGTATTGTAGCATG | 595 | D | — |
| IM000262 | ATTTGTGACATCTTAGGAGCTTAGGTTGGTCTTCGAGACACAGGGCTGTCCCCTGTAAAGCAGGTTCCATCAGTGACTCCAGGGTTTTAGCAGTTCAGTGGCGTAGTTTTCAGACTGCTTAAGATTTCTCAGGGGCTAGGCGTGGGGCAGAGACCCTGCAGACCCTGGCTAGAACAGAGGCCCTGGGAGACAGTTGAGGGTGCTCAGCTGTGGAGGACATG | 596 | K | Fgf3/Fgf4 |
| IM000263 | CATGACGACTTGAAAAATGACGAAATCACTAAT | 597 | R | — |
| IM000264 | CCTAAGTCTGACCGTGCCACTTCCCAGTCTTCCCTACAGTTCAATGCTTTTAGGCACAACAAATTTGTACCCCTCATG | 598 | B | AATTT.102899 |
| IM000265 | CCCCCCAGCCTGCTCCCTCCCCGGAGGGAGTCCCCAGTGTGACATG | 599 | D | — |
| IM000266 | GTTTAGGTGATAGGGTACTTGCCCAGCAGTAGGTGGTGCCCAGGATTCTATCCTCAAAATTGCACAAACAGAACATG | 600 | D | — |
| IM000267 | CATGTTGTGTAGATACCTACATAATTATAATTCATAACTGTAATTTGCTAC | 601 | D | — |
| IM000268 | CATGGGTTTGAGCCTTGTCCTGAGCTGGAGGAAGAGAGTGACCCAAAGGGACCTTGGTAGCAGCCAGGGATGTGTTGGGGAGCAGAGAAACTTTTATGAACTTCAGTTTCAGTACTGAAACTTCCCTTTCCCTAGACTTCCTTTG | 602 | D | — |
| IM000269 | CATGGGACAACTCCTTTTTCCTTCTGGGTCAGGGGAGAGAGACCTCCTATCTAAACTGTATAGGCCATTGCTGTAGCCCTTAGCTCACTTCCGGGGCGGGGAGGAGGAGGTTAAGACCCTAT | 603 | D | — |
| IM000270 | CATGAAATGAAAGAACAGAGTAGCAATTTGGGAGAAAAGCCTGCCGAGCGGACTTAATCTTTCCCAAGTGCTATCAGT | 604 | D | — |
| IM000271 | ATGCTTGTCTTTCCCGCCCATTACCTGCTTTGTTTGAGATAATAGTTTTGTTACTTTATCAACTAGTAGCGACTAGTTTACATTTGGTTTCATAAATAAGATCCATTTTAATCTGAGTTTTCCATCCTTGATTTATTTTGATTCATATTTTAATTGTCTAGTTCCCATCCCTGGGCAGGACTTTTTGGGAAAGTCTTGCAGGTGACTATGTTGAGAATGATTTATGTTGTATTAGCACAGGTACATTCGACAGTGCTGGTTCCTTCTGGAGCGCCTCGGGTGTGGGTCCTTTTCCTCAGC | 605 | D | — |

TABLE 2-continued

| SAGRES # | SEQUENCE | SEQ ID # | CLASS. | GENE |
|---|---|---|---|---|
| IM000272 | CATGAGTTTGATTATTTCCTGAATTC TACCTCTCTTGGGTCTATTTTCTTCT TTTTGTTCTAGAG | 606 | R | — |
| IM000273 | GGGATAAGACTGGATAGTAAGCCGGG CGTGGTGGTGCATG | 607 | D | — |
| IM000274 | CAGAAGGTAGTGTTTCACAACAGTCC TCCCGATGATCAATTGTTTTACACTA AACCATATAGGAATTCACCCTGAGAG GAGTTCGAAAGCCTTTCAAAACCTGT ACTGATATAAAGCAAATCTCTTTTGG ATTCCCAATCAAAATGATTTGGCAGA ACTTTAAGGCCACAAAAATTGTGTCT GAACAACCCCTCTGAGCCCAGTTTTG TTAGCTTAAATTAAGGGCCATG | 608 | D | — |
| IM000275 | CCTCAAACTAAGAAGCATCCATTTCG AAGCTGCTGGGATTAAGGGAGTATGC CACCACCACCAGCTATGGCATTTTTT TTCTTTAATTTTACTATTTTTTTGCT TGTATATTATGGTTTCCAGTTTTGTG GGTTTTATAAGCTTTGAGTGTGTTTC | 609 | D | — |
| IM000276 | GTCCACTTTAGGACGTGGAATATGGT AAGAAAACTGAAAATCATG | 610 | R | — |
| IM000277 | CATGGTCAGCTCTCACTGCCCCATCC CCTGTCTCCAGTTCACGCACTGTATC CTGTGTCTTTCTCTGTGGCTAGACTC TTCTCTTGGGGAGGGGAGTCTTGTA TATCGATGTGTCTCACGCACATAGA GGCTAAAGATTAATCTAGGTGTATTC ATTCATCGTCTCATTGC | 611 | D | — |
| IM000278 | CATGTGTCCTGATTTTAGTTGGATTT TTTTTCTCCCAGGTTTCTGCAGTGTC CCCACCCCCCAC | 612 | D | — |
| IM000279 | ATGGTGTCTGTTCATAGCAGTAAAAC CTTAACTAAGACACTGATATAACTCA CCTTTCCCAGCCTCAAAGTCTCTACC ATGTCAGGATCCACTCACTCATTCAC CAAACTTCATCAAATGCCCACTGTGC TATCATCAGTACAGAATAAATCATG | 613 | R | — |
| IM000280 | CATGAGACTGTCACAAGCTCCTGGGA TGGGGACCTTACCAGAAAGCCACCAA ATCAGAGGCATCCCTGTTTGGTGAGG GTACATTTGTTTTCCCCAGGCCCTG AGTGCCAGGCAGGAGCAGGCAAAGTT CACCTGGGAGGATGCCCTGGAT | 614 | K | Fgf3/Fgf4 |
| IM000281 | GTTTTGGTTCTTTTCAAAGAAAAACA AAGGTCATTGCAGCTTTTTGTACCAT TGAGGTGATGGTAGGTTGAGATATAT AATCTACTTGAAGATATATATTATGG CATG | 615 | D | — |
| IM000282 | CCGCTGCTCTCTCACCAACCCAGTGT GTCTGCTTTTAGCCCAGACGGGGAG GGGGTAAGGGGGTGGTCTGTCTCATG | 616 | K | Wnt1 |
| IM000283 | GTGTCCCTCCTGTCGTTAGGCAGTAC TTCCAAATCAAACCATG | 617 | C | — |
| IM000284 | AGCTGGTACAATGCTTAGAGCAGAGC TGCAGAAGCAATACAAGAGATCCTGG CTCAGCTAGGTGCAAGCTGGAATAGA CTCCTGACAGTTGTCCTATGAACTCC ATACACAGGCATG | 618 | D | — |
| IM000285 | ATGGATCCCTGGGGGCAGTCTCTGG ATGGTCCTTCCTTCTGTCTCAGCACC AAACATTGTCTCTGTAACTCCTTCCA TG | 619 | R | — |
| IM000286 | CATGATGCACTTAGCAATTCCTCTAT TGAGACTCAAGTGAGCCTAGGCTGTG ACAAAATGACTGTTAAAACT | 620 | K | Fgf3/Fgf4 |
| IM000287 | CATGTAAAGCTAGTTCAAAACATACT AAATAATTCAGTTGTAGAAGAGGTGA GGTTATCTCACTGCCAGGATAAGCTA TTGAACAAGCAAGGGTTCTCACTTAC TGTTTAAGTGGAAGTGTTTTCTTACT TCAAAAGTCATTAATGAATTTTAAG CTGCATAAATATTTAGTTATT | 621 | C | — |
| IM000288 | TAAGCTTTTCTCTTACACAATCCCCC GGAAACCCACAGTAGGTCACAAAGAC CCAGGCACCTATTCCTAGGCCTGGTA | 622 | D | — |

TABLE 2-continued

| SAGRES # | SEQUENCE | SEQ ID # | CLASS. | GENE |
|---|---|---|---|---|
| | AGTGGGCACCCACCATTTACAAAGAG CTCAGCATTTGGCTCACACATG | | | |
| IM000289 | CATGAAGATGAACCGGGCTTGTTTCT CTGGCAACTAGGCTCAGAAAGGATAG GACCACCAGCCGAGTAGCTGTCAGAT GGAGCTGAAGACCTGAGGGAAAGAAT GCTTGTGGGAAGAAGCTGGCTCCTTT TGGTTTTGTTGTTGCTGGTTTTGTGA CCGGATCTTGCTGTGTGACCCTACCT AACAT | 623 | K | Wnt1 |
| IM000290 | CATGGACTTAATTTTACTGCATTTGA ATTATGGAAAATATATATGAAAAGTC TTTAGAAAAAGGCAGAGGACGAAATT AACCAAAGAACTTTAATTATCTGAGA CCAAGAPAACTCTTTAAGAAAAAGCA GTAGATTTAAACTACGTGTTGTTAAA ATAGTCCTGTATAGATATAAAGTCCC TCAGAGGGAAGAGATTTGTTGAATAA ATTCAGACACTCPAGAGAA | 624 | D | — |
| IM000291 | ATTAAACAGCCCAGTGCACTCAGAAG TGAATGTTGAGAAGTGGGTTATCTGG GGACAAACAGAGGGAAGAATAGTGCC CTTGGCACGTGCAAAGGAGTTTGGGA ACAAACATG | 625 | K | Fgf3/Fgf4 |
| IM000292 | CATGTATGACAGTGAGGTCAGGAGTG CCCAGGGAGCTTGCATTGGCAGAACA GCCTTTCCTGGCCAAGCCTAGTGTCA TCAAGTATATATTGGACCAGACCTTA TAAAACTTGGGTTCCACTCTGGCTGG ACCAGCCTCAAGGCGTCGCCTCTCCA GGCCTACCTCCCAGACGCAGAGGCAG CATTTGGAGGATTGAA | 626 | D | — |
| IM000293 | CATGGGAACTTGTTCCAAGCAAGGGA CTCTGCTACACCTTCAAGGGACGCTG CTAATACTGGGTTCAACCTTGGGCAG CGTGCACAGCAGGAGTGGGAGGGCTC TGATGAGGAGAGCCACCCACACTGTG AGATCTAGGAGATAAGGTCACATCCAC | 627 | D | — |
| IM000294 | CCCTCCAGCAAATTGAAATACGAAAG ACTCAAACACATTAGAACCATTCCAA TAAAAACTTGCATTGCCCCAGGCCCC TCCCACCACCATG | 628 | D | — |
| IM000295 | CAAGAGTATATATCCAAGAAAAATAC AGCTGAGTTGACTGTTAGTTCTGTTT TGGCCTTCATG | 629 | D | — |
| IM000296 | GGTAAAAACTCTACCAGTTAAACTAC ATTCCCAGCCTGCCTCCAATGAATTT AATTTGTTTTTAGGGTTTTCTGTTAT TGTTGTTTTTGAGACAGGGATTCACA AAGATCTGCCTGCCTCTGCTTCCTGA GTGCTAAAATTAAAGGTATGCATG | 630 | R | — |
| IM000297 | GTTTAGTTACTGTTTTCTGTATTACT TTTGTTGAAAATTAGATTGTTCCTGG TGACTTTGTGTGCTATATTCTCTGCATG | 631 | D | — |
| IM000298 | CATGTTTCTGCTTCTACTTTATCCAC CCTGCACACACTGACTGCTATGTTCC TGTACCTTTTCCATCTCTCCATTGAA TATTCACTCCTACAGTGGCATTGGAA ATTGCAGTGGAGATACC | 632 | D | — |
| IM000299 | ACGATGGTCTTGCCCTTTCTCACACC ATCAATAGTCACTCAGAGCTGTGGTT GTTATCTGAAGTGTGTTGCAGTCCAA CTTTGCCCGATG | 633 | D | — |
| IM000300 | GGAGTGTAAGCGTCGGTGTGTCACCC GTGAGATTAAGTCAAAGTGTACATG | 634 | K | Wnt1 |
| IM000301 | TAGACCCAGTCTTGCACTGGCCTGGG GACTCGCTTATTAGGTTTGACTGTTA TCTGGCCAACAAACACCAGGAAATG GGGTGACAGGTGGTTGTGAGCCCTC TGAAATGGGCATTGGGACCTGAACC TGGGTCCTCTGTAAGAGACATG | 635 | D | — |
| IM000302 | TCACCCCAGCTGGGGCTGTGCTGAAGA CTCTGAAGGGGAAGATAGGCCTATGG TNACATG | 636 | K | Fgf3/Fgf4 |
| IM000303 | GTTGGGCTGAGCCACTAGTACACCTC CACTCACTGAGCCATCTAGCAGGTCC CAAACAAGGTGACTTTTGTCATCCAG | 637 | K | Fgf3/Fgf4 |

TABLE 2-continued

| SAGRES # | SEQUENCE | SEQ ID # | CLASS. | GENE |
|---|---|---|---|---|
| | CAAGACATAGCCATCTATGCCAGTCA TCCTTGTCATG | | | |
| IM000304 | TAACATATTTGCTTGTTATGAAGGAA AATGTTGGATGTGTGCCTGTGGTT GAGTACTGCAAGTAGTGTCAGGGAAG AGAAACCTAGCTTGAACAGTCCCCTC ATCTCCTTCATATCCTCACTCCTTGT CAGGCCCTGTATTAGGTAGTGCTTCC CTACCTCCCTAATGCTGTGACCCTTT CTTTAATAGAGTTCCTCATG | 638 | C | — |
| IM000305 | CATGTGAGCACAGGTACCTATGGAA ACCAAAAGTGTAGGATCCCTTAGAAC TGGAATTATAGGCAGCTGTACGCTAT TGATGTGGGTGCTGGAAACTGAACT CCAGGCTTCTTGAAGAGCATCAACT GCTCTTAGCTGG | 639 | D | — |
| IM000306 | CATGTAGAGACTGCCATATCCAGGGA TCCACCCCATAATCAGCATCCAAACG CTGACACCATTGCATACACTAGCAAG ATTTTATTGAAAGGACCCAGATGTAG CTGTCTCTTGTGAGACTATGCCGGGG CCTAGCAAACACAGAAGTGGATGCTC ACAGTCAGCAAATGGATGGATCATAG GGCTCCCAATGGAGGAGCTAGAGAAA GTAGCCAAGGAGCTAAAGGGATCTGC AACCCTATAGGTGAAACAA | 640 | R | — |
| IM000307 | CATGTCCTAGAGTTGTTCCAGCACAG AAGCTTTTGGGAGAGACCACCATTAC TGAAACGCAGCAGATGCTGCAGCT | 641 | D | — |
| IM000308 | CTGCTTGTTGTGGGGACCAGCCAGAC ACCCTCCACAGGTGCAGTGGTGCAAC ATG | 642 | K | Fgf3/Fgf4 |
| IM000309 | CATGATGTTTGTGCAGGAATAGAAAC CCTGACTAAGACAGAGGATATTCAAG ATCCAAACTAGCAGGTTAGCTGTGGT TCC | 643 | R | — |
| IM000310 | CATGAAGCACACATTACCCTGTGACT TGCTTTTTTATTAAT | 644 | D | — |
| IM000311 | CATGTGTCCTCTTGTCTTGTAGTCTC TATTCTTTGTGATTCCGCAGCTCTCC ATAGAGTGCAGTTCTATGTCCTGCCT GCAAGGTCCATTGGCTTACTAGGGTC TGCCCCTCCCAGAAGAGTAGCTCATT TAGAATGCATTACTGGTGTGCTGTCT TGCATCTTTTTTACCCAT | 645 | D | — |
| IM000312 | ATCTATGTATGCACTACTAATTACTG TTTAGTTTATATATGCCCTAATAATT ACCCCATTGAAAACTTAAATTTTGTT TCAAAAGTGTGGTCTCATTGGAGGTG TTAATGTACPATGTCTTTCTCATG | 646 | D | — |
| IM000313 | CATGGCCAGCTGAGCGGGCTGGAACC TGCCCTTCTGCTTCCTGTCCCTGCAC CTCAGCACCGCTGTGCACTTGGTACT AGACCTCAATCACCGCAG | 647 | D | — |
| IM000314 | CATGTGCGTCCCCCCCAAACACGCAA GCGCACACCCACAAAGAGAAGAGACA GGG | 648 | D | — |
| IM000315 | CATGGCCACTTGGAGAGAAGGGGGAA GGGAATGCGGAGAGAGCGGGAGCAAG AG | 649 | C | — |
| IM000316 | CTTAAGCACTGATCAATGGCCAAGGT TTGCCGACTTGGGATCTGGGTATAG ACATCCACCCACTGAGACCCTCTAAC AAAACCAGATGTGGAGGTACGAAGCC TGGCTCAGGGGCCTGTCCTTTGTCAT CAGAATTCACCAGCTGCAGCTCCTGG GTCAGCTTTGTTTGGCATG | 650 | K | Fgf3/Fgf4 |
| IM000317 | GTGTATTGATATGCAAATGTGTTAAA ATATGATTTAAANTTCCCCATG | 651 | D | — |
| IM000318 | GCAAAGTGTCCACACTTTGGTCTTCG TTCTTCTTGAGTTTCATG | 652 | R | — |
| IM000319 | ATAGCAGGTCCTGGATACCCCAACAT ACCAGAAAAGCAAGATTCAGATCTAA AATCACTTCTCATG | 653 | C | — |
| IM000320 | CATGTCCTGGCTTTGTAAAGGGTCCT GCTGGGTTTACTTCACTGGGTCTTAA ACTCCGATTGTGAGCCGTAGTGAAGA | 654 | D | — |

TABLE 2-continued

| SAGRES # | SEQUENCE | SEQ ID # | CLASS. | GENE |
|---|---|---|---|---|
| | GGGCTGTATATAGTGGGTCACCGAGG TCCTGTAGCAGAGTGGGCAAGCTCAC TGCCTGCTACCAGCAGTTCACTATGT TTTATGGTCTGCTGCCTGCTGGTGGT TTATAGATGCTGTGTCGTAAGAGAAA AGTTGAGGGTAGCCTGGAGTGAATGG AGTTGGGGTATCAGGGAGGTCTTTGT ACACTGGGGTGAGCTAGGCCTCTGGA AAGCTTCTGGGGGTTCCCC | | | |
| IM000321 | CATGCTCCCAGGCACCAGGCTTGCTT TGCATAGGTGGGACAGGGTCCCAATA CTCAGCCTGGGGTGCCAATGAGGCTC AGGCCACACACCCTCTTGGTAGGAGT CACTGTAGTGGGGTCTGTGAGAGCCA GTAACTTGTGAGGGTGTGAACTTAGC TCAGGACAGAGGCCAGCAGGAAGCTT TCCCTACAGAGAGTGTTTTCGTCTTT TCCTTTTTCTGGTTTGTTTCTTGGGA AGGGAACAATTTTCGCTTTTAGTTGG CTTGTATTATTCGCTACTGAAACCTT AAG | 655 | D | — |
| IM000322 | CATGTATTAAGTCCCTCGTGAGGAA GGGT | 656 | D | — |
| IM000323 | CATGAGTCAGAGGCTTCTACTCCAGT TAAAACTGATCTGGGTATAGAATTGT GTTCTCAAGAAATAGTAAGTTATAAT CAACTAAGTCATCTCCTGTCTCATTT TTTTCTTCCAAATCGGGTCCTCGAAT TGTTATPAGAAGATTCAATCAATCAA CAGTATCCCTTTCCCAATTTGTGTGC TAAGTGGAAACAGGTCTTAGCACATC AATCACATAAAGTTCAATTAAGAAGG AATTTAAAGATCAG | 657 | D | — |
| IM000324 | GCTATGAGTCTCCACTTGTAAACAAT TATACTCAAACATATTCAGGACACAC TTGGGCTTCCTCCATCAAGCCAGGC AGGTTTGTTTCTTGTTTGTTTTGAG ATAGATGGATGGGCCAGCTTCATG | 658 | C | — |
| IM000325 | CCCACCCCTAGCAACCAGTTCCTCCT CTGAATGGAAGACATCTGATACCAAC TGAGCTTTCACATG | 659 | D | — |
| IM000326 | ATCNNCGAATCATTCTAGGCTTGTGG GACCATG | 660 | D | — |
| IM000327 | ACTATTCTCAACAATAAATGAACTTC TGGGGGAATCACCAATCCTGATTTCA AACGGTACTGTAGAGCAATCATG | 661 | R | — |
| IM000328 | CCTAGGCACCCACCACAATAGTTAAT CCATCTTTGAATTTTTGACCCAGTGT TGCCTAGTATTCATTGCAACAGCTTT TCAAATGTTTTATTCTTTCCCAAATA AATTCCATG | 662 | D | — |
| IM000329 | AGAGGCTACCCCTTCAAGTGGCTTGC CTAGTATAGCTATTACAGACAGAGAA CTTCCAGTAATTTCCTCAAGCCACATG | 663 | D | — |
| IM000330 | ACTCTGAACTTTGCTTTGCCTGGTAT TTTTGCCTCTCTTATCCCATTGACCC TGTACAGAAAAGCTGAGGAAGCAGGT GCAACCAGGCATCTCAGGCACCCAGT TAAGAAGTAGATGAAATACTGTAATG TACATG | 664 | D | — |
| IM000331 | CATGATTTTCAGTTTTCTTGCCATAT TCCACGTCCTACAGTGGACATTTCTA AATTTTCCACCTTTTTCAGTTTTCCT CGCCATATTTCACGTCCTAAAGTGTGT | 665 | R | — |
| IM000332 | CATGAGACAGTCCCAGATCCCTCACC ATAAAGAGCTACCATATAC | 666 | D | — |
| IM000333 | CATGCGACCATCCATCAGGAGTTGGA GGTGCCATCGGCTCTGCCTTACAGAA AAGGAATCTGAGATTTAGAAACCCCA GGTGACCCACTCAGGGCCACCGGGGC AGTAAAAAGAATCTAAGATCTAAAGT CAGTGGAAACTCCTCCCAACCAGCAG AGACTCCTCCCAGCCAGCTCTTGAT | 667 | K | Fgf3/Fgf4 |
| IM000334 | GGGAAGCAAGAGGCAGTAAGAAAGGG GAAACTGGGGAGGTAACCAAAGTCAC ATG | 668 | D | — |

TABLE 2-continued

| SAGRES # | SEQUENCE | SEQ ID # | CLASS. | GENE |
|---|---|---|---|---|
| IM000335 | CATGCTAACAAAGAATGGGGAAAGCTCTCTAGGCTTCCACCTTAAACPATGAGGAAGGGAAGAAGGAAAG | 669 | D | — |
| IM000336 | CATGTTGGTGGGACTTTATGGGTATTGCTTCTGATATTACTAGGAGGCACAATCTCACAGAAAACTCCCTGATCTTACAATCCTTCTGCCCCCTCTTTTGCAATGTTCCCTGAGCCTCAAGTATGGAGTTATTTTATAGCTGTATTCATTGAGACCAGAATCCACAGGTATGC | 670 | R | — |
| IM000337 | CTCACACAGATATGCATG | 671 | D | — |
| IM000338 | AGAAGTGATCTTTCTTCTGTGTGTCCCTGTCACCCTGGGAGGCAATCAGACGGTCCCTCATG | 672 | D | — |
| IM000339 | CTTTCCTTTTGTTTTGGACGAATATTATTGAAATATGTAGTGTGCATG | 673 | D | — |
| IM000340 | CATGAGATATGATTTTAGATCTGAATCTTGCTTTTCAGGTGTCTTGGCATATTCAGAACTCGCTGTGGTGGGTGAACTGGGTTCTGATGATGCCCATTGGTGCTGGTTTC | 674 | B | AT597062 |
| IM000341 | CATGGAAAGGTATTTGGAAATAGGCTGTTTTGTGTGTAACTC | 675 | D | — |
| IM000342 | CCCTAGGACTCACCTGGTAGGAAAGAAGTAATTCTTCCAAGTTGTCCCCTGACATCCACAAGCACATAGTGTCAGGCATG | 676 | D | — |
| IM000343 | CATGCCATTCATACATACTGGCAATGGATATATAGAAAATGAGACTCCTTCTAATATTGTGTGATGACAGAT | 677 | D | — |
| IM000344 | AGAAACCATTTACACTGCCAGGTTTGGGGCCTGCCTATGCATG | 678 | D | — |
| IM000345 | GATCCCTTTAACTTCTTGGATAGTTTCTCTAGCTCCTCCATTGGGGCCCTGTGATCCATCCAATAGCTGACTGTGAGCATCCACTTATGTGTTTGCTAGGCCCTGGCATAGTCTCATAAGAGACAGCTATATCAGGGTCCTTTCAGCAAACTCTTGCTAGTGAATGCAATGGTGTCATCATTTGGAGGCTGATTATGGGATGGATCCCTGGATATGGCAGTCTCTAGATGGTCCATCCTTTTGTCTCAGCTCCAAACTTTGTCTCTGTAACTCCTTCCATG | 679 | R | — |
| IM000346 | AGGGTGGTCTCTGCAACCCAGGCTGGAACCCAGCACAATAAATAGTTTTATACATAACCGAACGCGTGGCTCTGCGGCCACATTTCGGTGCAAATTATTTACACAGTGATGAGGAGGCAGGACAGGAAGGGGTGGGAGGAGGCTGAGGGAGGCATG | 680 | K | Wnt1 |
| IM000347 | CATGTGTGTTCTTTTGTGATTGGGTTACCTCACTCAGGATGATATTTTCT | 681 | R | — |
| IM000348 | CATGAGGCCAAGGGAGAGGCAAATTCCTGTGTGAATCAATTATCATCTCACAGAGAACATACC | 682 | D | — |
| IM000349 | AGTAGTATGCCACAGGGAGAAAGGGTATTTATCAAAGGGACAGGAGCTAGTTGTGGTGACCTTACCTATCTGCTTGCCTCTGCCTCCACGGTGCTGGGATTGAAGGTGTGCACCACCACACCCAGCTTCAGATTGTTTTTATTTATTGNGTATTCCTGTTTCACCTGCATG | 683 | R | — |
| IM000350 | CATGCATATACAGGATATAACCTTTGTAAGTAAGAATAAAGCACATAAAAAATACTTTCAGTAATATTGTCCAAACCACTT | 684 | D | — |
| IM000351 | CATGTGTGTGTTTGTGTTTGCGGAGTGTGGGGGCGGCAGGGAAAGGTGGCCAGGCTGTCACTCAGAGATCAGGATGACAGGCGCTCCCTCATCTAGGCGCGGGAGCTCTGATTGCAGATTCGAGGAAACAAAATAGCAATTG | 685 | K | — |
| IM000352 | CATGAAGATGAACCGGGCTTGTTTCTCTGGCAACTAGGCTCAGAAAGGATAGGTCCACCAGCCGAGTAGCTGTCGATGGAGCTGAAGACCTGAGGGAAAGTATGCTTGTGGGAAGA | 686 | K | Wnt1 |

TABLE 2-continued

| SAGRES # | SEQUENCE | SEQ ID # | CLASS. | GENE |
|---|---|---|---|---|
| IM000353 | TCAGTTCCAAGAGATGACACAGCCGCAGTCATG | 687 | R | – |
| IM000354 | CAGAGACTGAAGGAAAGACCATCCAGTGACTGGCCCAACTTGGGATCCATCCCATTTGAAAGCATCAAATCCAGACACTATTACTGATACCATG | 688 | R | – |
| IM000355 | CCCTACAGTGACACTTACTCCAATAAGGCCACACATCCTAGTAGTGCCAGTCCCCATG | 689 | R | – |
| IM000356 | GGCCTCTATTCTCGGTTCAGATTAAGTACCTGGCTTCACTGAGAGCGGCTCTATCATTCCTAAAATGGTTCTCATG | 690 | D | – |
| IM000357 | AGTAGATGGCAGAGAATAATCAAACTCAGGGCTGAAATTAACCATG | 691 | R | – |
| IM000358 | CCAACCCAACAGCTGGGAAGGGTTGGAAGTAGCCCCGAGGCTGGTTAGTCCCCTTCCAGATGGGGAGGTTAGACTGGGGCTAGCCAGGCTGCTCCACATAGACTTCCGATTCGCNTTAGAAATGAAAAGAGGAGAGGAAAGGGAAAAGGAAGAAAGGCTACAAGCATG | 692 | C | – |
| IM000359 | CATGGGGTCTGGAGCGAGCTATCAAACCCAGGATTGTCTTAACTGTGGTGGCTTGGATGAGAATGGCCGCCATAGGGGCATAGATTTGAATTCTTGGTCCCTAGTT | 693 | R | – |
| IM000360 | ACGGTGGGCTGATATTTTCTAGATCTCCTAGTGCCTATCCCTATTATCATG | 694 | C | – |
| IM000361 | CATGAATTTTGAGATATTCTCTGAACCAAACAATATT | 695 | D | – |
| IM000362 | GGAGAAATTATGCCTTAAATTAAAAAGCAAATATTGAAAAATTAAATATAATTTCCATTAAATCATAATGGACCAACAACAGAACACATCTATCTATGTATCTATCTATGTATCTATGTATATCTACCTATCTATCTGTAAAGCAAAAACTACATG | 696 | D | – |
| IM000363 | GCAAGGACAACTGAGAGTTTGAAGCAACTATTTTCATCTTGACTCTCACTCGGCTTTTAACGTCCATTCAGGAAACAGGCATG | 697 | D | – |
| IM000364 | CATGAGAAGTCACAATTCCACCACTTAAAATCAGTGCTTGGAAGGATACTGTAGGCCAAGAGGTAAGTAGAGGGGACAGCAGTGCACGTTTTTCAAAGTGTGGGTGTGTGTTTGTGGGTGTGTGTCTGTCTGCCTGTGCGTGTATGTGGGTCAGTACAGGAAAAGC | 698 | D | – |
| IM000365 | CAAGATAAACTCTTAATGGGATTCTAGGGAGTCATTCTGTAGAGAGCACTTGACTAGAAGGTTAAGTCTTAGATCCAGATCCCAGCACAAACATAATACATCCTATACTCACACACACACAGACACACACACACGCAGTCCTCATG | 699 | D | – |
| IM000366 | CATGTCTCAAAAAAAAAAAAGAATCACTTGGATTGTACATAGTAGTTAATAATATGTAATTAGTCTAACTGTGAAGGGGCACTTATTAGTTTCTACTATGTAGTGTAAATGAACTATGTTGCTATTAGAAATTC | 700 | D | – |
| IM000367 | GAAGGTTGAAATCTGTAATCTATCTTCTATGGCATCATTCACCTCTCTAATACAGCTGTAGAGAAAAATGTCTGAAGATTCGGTTCTACTCTCGTTCTTTGAGGTCTCCCAACCCATG | 701 | D | – |
| IM000368 | CATGGCTGGACTATAGAGCTCTAGCTTCAGTTGCTGGGATGTTCAGTGCATCACCACAGAGAGGGTTCTTAAGTGGTGATGGTGGTAGTGGAAAGGTGGACCCTCCAGACAAAGGAAGCACTCACCACGACCCTGCTCACCTGTGAACCTCCTTTCAGACTGATTCCTGAGATCAGCCAGGCAGGGCTACCAACCAGGGACTCGTAATGAAAATTTAGGCATATGG | 702 | D | – |
| IM000369 | CATGGTCTGGTGAGTATGGCACCAGATAGGATGTTATGCCCGTTTCTTATCTCAAGAAACAAGGAATCTTGTTTCTTATCATTAATAGGAAGAATAGAGCAGTC | 703 | D | – |

TABLE 2-continued

| SAGRES # | SEQUENCE | SEQ ID # | CLASS. | GENE |
|---|---|---|---|---|
| | CTGGCTAAATGAAAGGTGGNAAAGTTGGTTTGAGTATCTTTTCC | | | |
| IM000370 | AAAATCCAATACACATTCATG | 704 | D | — |
| IM000371 | CCCTTTGTTGTGCATTTCAGCTAATCTCATCCCTGTTTGGGTCCTGGAACCCTCTTGCTTCCCTGGCATCTAGGACTTGCTAGTGGCTACCCCCAGCTCCCCATTCCCCATTGCTACACACCTCTGTTCAAATTCCTGACCCTCTGTATATCATCCCAGTCTCTTCTAATACCTGACCTGAACCCCCCTTTTTCCCCTCCCTCTATTCTCTTCCTTGCAAGTCCCTCCCACCTTCTACCTTCCATG | 705 | R | — |
| IM000372 | CATGGGTCNTTTCTGATCTTTACCAAGCAACAGTGATGAATCTATAAATAGAACCATCAGTTCAAGAAACACAACTTTAGATTCCTTTCCATACCTTGCTTTTGTTTCTTACATCTTCCCCCTGCCCTGTGGTTTTTCTTTTAATCTTGTTTTTACAATCCAAATTGTATCCCCTTCTCTGTC | 706 | D | — |
| IM000373 | TTGGGCCTTTGCATACCCTGTTCTGGCTAAGACAATTGTCACCTGACTGGGCATG | 707 | D | — |
| TAA000374 | AAGTGGATGTTTCTCATTTTCCATG | 708 | R | — |
| IM000375 | TATAAGCAATCCCAAAAATTCTACCTGGGAACTCCTAGAGCTGATAACACCTTCAGTGAGCCAAGTATCTGGGTATAGGATTAATTTTAAAAAAATAGAAAATCAGTATCTCTCTTACATACAAATAACAAAAGGGCTGAAAAAGAAATTAAGGAAATAAAACCCTTCACAATAGCCATAAATAATATAAACTATCTTGGGATAACTCTAACCAGGCAAGCAAAAGACCTGTATGATCAAATCTTTGAAGAAGAAAATTGAAAAAGGTATCAGAGGAGGTAAAGATCTCCCATG | 709 | R | — |
| IM000376 | CATGGGCTCTGCTTAAGAAACCCCGGAG | 710 | C | — |
| IM000377 | CATGCTTTTAGGCCTTTTCACGATCTTANNGGGGACCGNGAGAGAGNTNGCTGCTGGATGATCTCTGAGAGAGCTTATCGTCCTCAAACTGCTGATATTCAAGCTGTTTCGCAGCTGCAGCAGCAAAGTCCCGGTCTTTGTCACCGATCTGTGAACAGCAACAATGAGCACCTTTCATAACAGACAGGAAATGGATGCT | 711 | A | TTTDal1 |
| IM000378 | GGCGTACCTGTGTATATGCATGCATG | 712 | D | — |
| IM000379 | GTGCTAGGCTCACTCAAGATAAAATTTGCTATTTCAGCTCCCTGGATAATAAAATCTATCCTCTCACAGCTGTGACTCTCACAGGGGTGCAGGCAGGACGACATCAAGAGAGTGATGGCCTCTAACAAGTGTTCTGCCCACTTCCTCTTCCGGGTCAAAGACTAGATCTAGACTGGTGGGGCTGTTGATTCACTATGAATGTGCCTGACACCATCCCACACTTAGCATCATAGACACTTGGGGGACTGGTGATACACTATGATGCCTGACACCATCCCACACTTAACATCATG | 713 | D | — |
| IM000380 | CTATCCCGAGGGTGAGGGCAGTTCTATGCCAAGGTTCTCATCACAGAGATACAGAGGAAGCTGGGCCTGTCTTAGGGTTGGCTGTCTGGAGATCCTGGAGCCCTGGAGGTGGGTAGCAAGAACAAAGGAAGTACTTCACCTGATAAAAACAGTTCCCAGAGAAACACATATACGCTTCATATACAGGAGTGCGAGTGTGTGTGTGCGCGCAGAGAGGCAGAGGCCTGGAAGTCAAAAGTTCAGGGCCAGTTTGTGTGCATG | 714 | K | Fgf3/Fgf4 |
| IM000381 | GGGGTTGACTAGAAGAAGGAGGCGATTAGGGTGTATCATATGAGAGAAGAATAAATAAAGGAAAAAATAAAAAACAAGGATTAAAAAGTAATTACATACATACATACATACATACATCATACATACATACATACTAGTTAAACTGTTATGGTAGCATG | 715 | D | — |

TABLE 2-continued

| SAGRES # | SEQUENCE | SEQ ID # | CLASS. | GENE |
|---|---|---|---|---|
| IM000382 | AGGATGATATTTTCTAGTTCCATCCA TTTGCCTAAGAATTTCTTGAATTCAT TGCTTTTAATAGCTGAGTAGTACTCC ATTTTGTTAGTATACCATATTGTCTG TATCCATTCCTCTGTTGAAGGACATC TGGGTTCTTTCCAGCTTCTGGCTATT ATAAATGAAGTTGCTATGAACATAGT GAAGCATG | 716 | R | — |
| IM000383 | CATGCCTGCAGGTCACAGCCTTGCGC GCCTCCAGTGCCCAGCGTTCAAAGTG ACACAGACTCTGTCAGGATGGTTCAA ATGCAAATCTCTGCAACTGCGTTAGC CGCTTCTAACCAAGACAGAAAGCTGC CGTCCTGTCCTTCGTGTCTGTCCCCA TACCCCATATCGGGTAGCTTTTCTTT CAGCATTGTCCAGACACCATCATATG CCTACATCGCACAAGTTCTCTGAGGC CAGATAATTGGCAGCACTCCTGTTGT GTGCCGAGAGTGCAGAAAAGGGCTAT CCCGAAAAGGTGTGATCTGGAAAGAA GGAAAAAAC | 717 | D | — |
| IM000384 | ATCTTTTGGCCAGAGCAAGCAGGGAC TGAGTGAGCAGAGGTGACAGGAGCGA GCAAGGCTGACAAAGTCTTCCATATT CCTACTAGGATGACCCATTAAGCCCC ATAAAGCATTCCATTGCTTTCCAAAT ACAAAGTCCCAAAATCCACATTCTTT CAAATAAAAGCATG | 718 | C | — |
| IM000385 | TTAACATATGGTTTTTAAAAATCCAT AATGAGCATATGATAGAGAAGTCATC AGAGCTCTTCAGCTCCACATCATCTG TCCCCAGAAGTATTACTACTCCTAAC TTGCTGAGCCAAGGCACAGATATTCT TTGTGTAAGCATCTCTTCTATCCTGT GTTGCCACGCAGGAGCACGCACACTG CTTCCTGTCTGAGGTTGTTCCATATC AGCATG | 719 | D | — |
| IM000386 | CATGCCAGGGCTTGAATTAACACAAG TGCCCCAGAT | 720 | D | — |
| IM000387 | CCTGTCTGTATATGCACATG | 721 | D | — |
| IM000388 | CATGGAAAATGAGAAACATCCACTTG ACGACTTGAAGAATGACGTAATCACT GGAAATCGTGAAAAATGAGAAATGCA CACTGTAGGACCTGGAATATGGCGAG AAAACTGAAAATCACGGAAAATGAGA AATACACACTAGTACGTGAAATATGG CGAGGAAAACTGAAAAAGGTGG | 722 | R | — |
| IM000389 | CATGAAGGTAAATTATGACCATCAGG GTTCAGACCTCAGCTCGACCGGAGAC CAGCCTGCAANTCCCCACAGCCCTCC CTTAAGTGGGTTAAAAGACAGAAAAG AATTAAATATCTGA | 723 | R | — |
| IM000390 | CATGCACTAGCAAGATTTTGCTGAAA GGACCCAGAT | 724 | R | — |
| IM000391 | GACACATACACACACATG | 725 | D | — |
| IM000392 | GTAAATGTATTAGGTTCAGAACTGGC ACTGCTCACTTATGTTCACAGTTGTT TGGGTAAAACTAGAACCAAACACAAA AGCAAAAGAGCCAAGCAGCAGAGCAG GGAGCAAGGGGCTTGGGGAAAACACT CACCTCTGTTGTGTCTTCTTCTAGCT GTCAGGGCATTGAGTGGCAAGGAGTG GAAAGGAACTTTGGGCATTCCGAGTC AGGAAAAGTGTACCAAAATAACACTA TGGAGGTTAGCAAGTGTTCTAGAGGG CAGAATAAATACATG | 726 | D | — |
| IM000393 | GTTTAGGTCATTGGTGGTACACTCTC CAAGGACAGTATAAATTGATTTTTTT CTGTATCCTTCTTTGTTCTTGGCCAT AAGGCACTTGGAGTGCATTAATATGT ACTTATTATTACTATGTCTTTTCTTG TCTTTGGCTTAAAAGAAACAGGGTCA AGTGACCATG | 727 | C | — |
| IM000394 | AGTTTCTTTTAAAAAAATAAAGTAG GAATGAAACTGGAACAAAAATGCAAT AAATTTTAAACCATCACCGCTAAAAC ATG | 728 | D | — |

TABLE 2-continued

| SAGRES # | SEQUENCE | SEQ ID # | CLASS. | GENE |
|---|---|---|---|---|
| IM000395 | CATGATTTTCAGTTTTCTTGCCATAT TCCAC | 729 | R | — |
| IM000396 | GAGAGGAGCCTGGGGAAATGAAGGT CCAGCAACAGGCCCAAAGTGGGATC CAGCTTAAGGGGAGGCCCCAAGGC CTGACACTATTACTGAGGCTATGGA GCACTCATAAAAATGGACCCAGCATG | 730 | R | — |
| IM000397 | CATGGCAGCCTTGGAGTATCAGGCT GCTGTTCCCAATGTGGGATGCAGAG GGCACTGCCAGCCTGGTTATCACGC ACCACTGTCACACAGGGAAGCGCCC CCTTCCC | 731 | D | — |
| IM000398 | GGAGTTCTTCTCTTCAATAACAGAGT AAATTCTCCCTCAGCAGTTCTCCCAG GAAACCCATAACCTAGCCATG | 732 | D | — |
| IM000399 | CCTTAGATGTTTGTCTAATCGACAAA ATACTTTATATGTGAAAAGGAAAGCATG | 733 | D | — |
| IM000400 | AATAATCAGATTTCCAGAGCTCCCAG GAACTAAACCAACAACCAACGAATAC ACATG | 734 | R | — |
| IM000401 | ATCCAGTAATCATTCATCTTATTGTT TCCACACAGGAAAACCTGTAATAGAT GGTTCATCAGCTTTATTTATAACTTT CTATCTTGAAAGCAACTGGAATGCCC TTCAGTAGGTAAGCAGATACACTAGG CTCACCTCAACTATAGGCACAATGAA AGGAATGAAATGTCAACTCACGAAAG GTAAGTACACATG | 735 | D | — |
| IM000402 | CCTCGCCATATTTCACGTGCTAAAGT GTGTATTACTCATTTTCCGTGATTTT CAGTTTTCTCGCCATATTCCAGGTCC TTCAGTGTTCATTTCTCATTTTTCAA GTTTTTTAGTGATTTCGTCGTTTTTC AAGTCGTCAAGTGGATGTTTCTCATT TTCCATG | 736 | R | — |
| IM000403 | CATGCAAGAACAGGACTAATGTCTGT GAAGAAAATGAGTGAGCGTGAACAGG AGGTCAAGGATCCGGTCCCAGGCAGC TCTCAGTCTGGGCAAGCATTTCTAAA CTTTGCCTTCCTTCCTGTTGGGGGTG AAGGTCTG | 737 | K | Fgf3/Fg f4 |
| IM000404 | AATAGGAGTAGATGAGAATGAAGATT TTTCAATTTAAAGGACCAGCAAATAG CTTCAGCAAAATTATAGAAGAAAACT TCCCATACCTAAAGAAAGATGCCCATG | 738 | R | — |
| IM000405 | CATGCAGCCCCATTAGTGATTGATCC TGTTCCATATAA | 739 | D | — |
| IM000406 | CATGGGCTCTCTGCTGATAATGCTG AGGCTGTTTGTGCTGTAGTCTGCGC TTTTTGCCCCCTCTCAGAAAAACTGT ATGTCATAGGAGTTGCTGGCTATTG GGTACATAAGCAAAGCCACCCTATT GTGCCAGTGCCTTAGACAGTGAGAC AAGAAAGGCCCCTGGTTAGAAATCTT ATCAGGACTGGGAATGTAACTCAGTT GATAAGAGTGCTTGCTTAGCGTGCA CACAGCCCTGGGTTCAACCGCCTAG TACTACAGAAACTGAGTGTGGCTTCA CACACCTGTAATCCCAGCACTTGGA GAGATAGATGCAGGAGGATTAGAAG TTCAAGGTTATCTTTAGTCACATAGT ATTGGTAGCCAGCCAGCCTGGAATA CTTGAGATACTTACAGGAAGGAAGG AAGGAAGGAAAGAAGGAGGGAGAG AGGACAGGAGGAAGGAGATAGATAT ACACAGAAAGAGACAGAGAAACAGA GATTCAGGAGACACAAAGACATACG GAGACACAGTGAGA | 740 | R | — |
| IM000407 | CATGTGGTTGCTGGGGATTGAACTC AGGACCTCTGGAAGAGCAGTCAATG CTCTTAACCGCTGAGCCATCTCTCC AGCTCCCTTTTAGACTTCTTAGTAG CAGCATTAATTCTTGCTTGGTTTCA GTTCTGACAACCACAGCAGTCAGGA GTTTGAGTAAGAGG | 741 | R | — |
| IM000408 | CCTCATAATGTTTGTTTGAGCATTTTT TTAAAACCTAACTTTGTCTTTTGCTTA | 742 | D | — |

TABLE 2-continued

| SAGRES # | SEQUENCE | SEQ ID # | CLASS. | GENE |
|---|---|---|---|---|
| | TCTATTGTGGTTTTTAGTGTGTGT GTGTGTGTGTATGCGCGCGTGTG CTCTGGTCTTCGTGCACATG | | | |
| IM000409 | ATTTGTGACATCTTAGGAGCTTAGGTT GGTCTTCGAGACACAGGGCTGTCCCTG TAAAGCAGGTTCCATCAGTGACTCCAG GGTTTTAGCAGTTCAGTGGCGTAGTTT TCAGACTGCTTAAGATTTCTCAAGGGC TAGGCGTGGGGCAGAGACCCTGCAGAC CCTGGCTAGAACAGANGCCCTGGGAGA CAGTTGAGGGTGCTCAACTGTGGAGGA CATG | 743 | K | Fgf3/Fg f4 |
| IM000410 | CATGTATGCACAACCAAAACTTATAA ATATGAGAATTCACTTATAGTCCTAG TCCTTTAATACAGAATTTAGCATTCC GATATAAAACAACAGATTAAACCCCA ACAGTTAGAATAGAGCAG | 744 | D | — |
| IM000411 | AATAGGAGTAGATGAGAATGAAGATT TTCAACTTAAAGGGCCAGCAAATATC TTCAACAAAATAATAGAAGAAACTT CCCCAACCTAAAGAAAGAGATGCCCA TG | 745 | R | — |
| IM000412 | CATGCACACCCTACTCCTGGGTGATC GTACCAGCTCCAGCCTCTGTTCTGCA CGCTGTGCCTTCAACCTGGCAACCTCC | 746 | K | Wnt1 |
| IM000413 | CATGAAAACCTGTCTCAGAAAACAAA AAACACGTTGAGAGCCAGCATAGAAG CCATAGGAGGTAATGTGTGTGTGTCT GTATATATGACAAGAGCAGACCTGTG CTGAACCAGTTAACTACTTTTG | 747 | D | — |
| IM000414 | CATGCTACTAACCAGTTGAGGCAGTA CCAGTTGTTGAAGATGCTGTCTTTTA TCCAATGGATGGTTTTAGCTCCTTTG TCTAAGATCAGGTGATCATAGGGTGT GAGTTTATTTCTGGGTCTTCAGTTAT ATTCCATTGATCTACTGGCCTGTAAT TGTACCAATAC | 748 | R | — |
| IM000415 | GGTTAGGAATTCTGGACAGTTGGTAC TTGGTTTGAATATAGTAGGTGACAAG CTGTGCCTTGTAGTGGGGTGGCAAGC AGGGTTCTCTGCAGCAGGATGCAGTG TACATG | 749 | C | — |
| IM000416 | CATGAAAATGTTAAGTCCTGACAGAC AGGGTGCCATCTGCCAAGAATTTGAG TAATCTAGAAACAGAAAT | 750 | D | — |
| IM000417 | CATGGGGTTTTGTGGATCTG | 751 | D | — |
| IM000418 | CAGAACAAATAAGCTGGAAAGGATGA AGCAGCCACAACATAACTGCTGTTGG CTTCTATGTGTACATTTTAAACCTTC CTCTGAAAGAGTGACCAATGCTTTTA ACTGCTGAGTTATCTCACCCGACTTA CTTTCTCTCTCTCTCTCTTTTCCT TCTTCCTAAAATTAATTGTGTGTGTA TGTGTGTGTGTGTATGATTCAGAA ACCTTTTATGTGGTGGTAGAAGACCA TCTGCAGGATTCATG | 752 | D | — |
| IM000419 | CATGGTCCCACAAGCCTAGAATGATT CGTGGAT | 753 | D | — |
| IM000420 | GGGGTCCAGGAGAGAAACTTGAGTC ATG | 754 | D | — |
| IM000421 | GGAAAGAGATACTCAAGACCAACTTT ACCACCTTTCATTTAGCCAGGACTGC TCTATTCTTCCTATTACTGCTAAGAA ACAAGATTCCTTGTTTCTTGAGATAA GAAACGGGCATAAACATCCTATCTGGT GCCATACTCACCAGACCATG | 755 | D | — |
| IM000422 | GTCCTTCCCAAAGAATAGTGTTAACT GAGCTCTTTGGGTGGCAATAAATGAA TTGCTCTGGTGGGACAGGCAGTGCAC ATATGGGGAGGGGGAGACACATG | 756 | D | — |
| IM000423 | CATGTTCTTACTTCTTGTTG | 757 | D | — |
| IM000424 | GGGTATATGAATTATATATATGTG TGTATATATGTATACAGGCATG | 758 | D | — |
| IM000425 | CATGCGCCCTAAGACTCATCTCCACG AATGACGTGACGACCTAATTGCATTC CTTCTAACCCACTGATTAGGCAAACC ACCCTCCAAAGGGCTCGCTGAGTTCC | 759 | R | — |

TABLE 2-continued

| SAGRES # | SEQUENCE | SEQ ID # | CLASS. | GENE |
|---|---|---|---|---|
| | TCTTCGGGAAGAGGTGTGTTGAGTAC GCTGGAATGGATATTCGAGGGCTGAGG | | | |
| IM000426 | CATCTCTCGAGCCCTTGCCCAGCCTT TTTTCTTAAAATTGTATTTTTAAAAT TTATTTTCTGTACACAGGTGTGTGAG TGTGAACATG | 760 | D | — |
| IM000427 | CATGTGGACCTGGGGGCTAAGTCAGG GTGAAGCTTCCACAGCTAAGTGGCTG GAGGCTGCCCTAAAAGCTCAGGAGGC ACCGCAAGCAAGCCTTGAAAAACCTT ACCCACCAGCTTGACCTTAGACTTCT GGCCTTCAGGCTGTGACAATACATTC CTGCTGTTTAAAGAACCATATGGTTG GTGATGTTTTGTTTGTTTCTGGTTCT TTTGTGTTGGTGTTTTTTGTTTGCGG GGTGTGTGTGTGTGTGTGTGTGTGTG TGTGTGTGTGTGTGTTGCAGTGCTAG AGATAAGATCTGA | 761 | K | Fgf3/Fg f4 |
| IM000428 | GTCTAAAGTTTTCAAATGATGGATAA GTTGTTAAACCTCCTTTAAGATCTCA AGCACAAAAGAAAGACATCAAATAC GAATAGTAGAAAGGAAAGGAGATTTG GAACTAGAGGCCCCAAGAGTCATAAA GAGAAGAATTTAAACAACTGTACCCA CAAATTCATTAGCATAGATCAAGTAG TCCATTTCTTCATG | 762 | C | — |
| IM000429 | CATGTATGTTCTCGATGCCTTGGCCT G | 763 | D | — |
| IM000430 | AAAGACATTAACTCTTGAGAACCAAG GGGTAGGACAGTATAGACTGAATTTT GCCTCCCCTCTTCATAAGTTGTCACT GCTAACCTCATTTCAGAACTTAAGCA TATAACCTTCATG | 764 | D | — |
| IM000431 | CATGGAGAACTAGCAAGAGCAGGATG GCGTTTCTCTAGAATGCCGTATAG | 765 | D | — |
| IM000432 | CATGGTGACTTTCCATCTTTAGAACC ATAATCANGTTTAAT | 766 | D | — |
| IM000433 | CATGCTTATATCCCTCAAAAATTTTA CAGTTAAACTGAAAATGCTTACTTAC TTTTTTTCTTACTTATATCTAGTATC GATAAGAACTGTCCCAAAGGACAC | 767 | D | — |
| IM000434 | CTGGGTCTTAGTCCTCTGAGGTCCCT AGCACATCAGAGGTTCATCAGTTCCA AGAGATGACACAGCCGCAGTCATG | 768 | K | Fgf3/Fg f4 |
| IM000435 | CATGGAGAATGCACAGTCAAAACGCT TGCATCCT | 769 | D | — |
| IM000436 | CACCCCCTCCCGCCTTACATCAATC CTGGGTGCACAATGGGACTGTGGAT GACTGATGTCTGCGCAAACAACTTG CGGGGAAGTCTAGCTGACAAACGCT CATG | 770 | K | Fgf3/Fg f4 |
| IM000437 | ATGTATCCAATGGCAAAGCACGGGG GAGGCTTCATCTTGAAGAGAAGAGT GCTCTTGGTAGGCTATCCTTTTTTT GAGACAACTAGAAATAGGAGCATTT CAACAATCTGGACATATGTCCTCCC ACAAGAACTTGTTGAGAATGGGTCT GAATTAACTGGAAATAAAAGTGAAC ACATTCTCCTATACACATG | 771 | D | — |
| IM000438 | TCACTCCATTTTAGTTCAAATGCTAC AACTCCTTTGAGCACCACTGTCATTT CAAGACCTTATTCTGTGAATACCATG | 772 | C | — |
| IM000439 | CATGCTTAGCCCAGGGAATGACACTA TTCGAGGTGTGGCCTTATTGGAGCAG GTGTGGCCTTGTTGGAAGAAGTGTGT CACTCACTGTTGGGTGGGATTTGAG AGCTTCCTCCTAGCTGCTTGAGGATG CCGGTCTT | 773 | R | — |
| IM000440 | CATGAGCTGGGTGAACGACAGCAAAG GTTTGTTTCTCTTTTAAGGAAGACAA TGGTGTGAAATTGGTTGATCCTTTGG GGGAAATGTTGGCCCCTT | 774 | B | AATTT.202 45 |
| IM000441 | CATGATCTCACTGTGAGGGCTGGCTA CCTTGGGAGCTCACTGTACTGAATATT CTGGCCGATTGCCTCTTCGCTGGGTT TATGGGCACACACAGTACTTGTCTAT GAGTCTTTGTTAGGCTGAGCCTAGTG | 775 | D | — |

TABLE 2-continued

| SAGRES # | SEQUENCE | SEQ ID # | CLASS. | GENE |
|---|---|---|---|---|
| | GTGCAGGCCTGTCATCTCCCCTACTT TACTTTAGGCTCTGAGGCAGGAGGAT | | | |
| IM000442 | TCTGGTAACTTGGGGGTCTGATAAAA CAGTTGGGGGATTCTTTTCTTTTCG CGTCTGAAGCCAATGTTATTACAGGT GTGTGCTTGTCTCTCCCACACCCTGC CCCTGTTGCCTAACACACGCGGCACA CACATG | 776 | D | — |
| IM000443 | CATGACTCTTCCTCCAGAGTTAGAGG TGGAGCCAGGACAAACTCTAAAGAAA AGAAACCCCAATCAAAAAGGGAAGCT GGTATCATCCAACCTTTAAATTACTC CACATCCCTCCAGAG | 777 | D | — |
| IM000444 | CATGTCTGTCCCAAAAGGAAGTTCCT TCCTCTGTCCTCCACATCTGACCAGC ACCATCATTCAATCTGCAACCCAAAC CAGACATTTACATCATCTATGCCTCC TTTCCTGCTTGTCTCCCCTCAACCAG CACCCAGCAAGCTTTCAGGTATCCCC TTAGTGTTGTCAGGATCTCTCCAGTT CTCCAGACCCCAATTCTGTTCTCACT CTACACTGCTAGC | 778 | D | — |
| IM000445 | AAAGCTAACTTCTCATCACCTACCTA ATAGCCTGAGAGCCCTGTGTAGAAAA ATTAAGGAGTTTAGTTCCTTCATG | 779 | C | — |
| IM000446 | CATGCAGACAAAGTAAATAAGAAAAC AAAATTAAATGTAGGCTGGACGGATAG ATGGT | 780 | D | — |
| IM000447 | CTCAGCTCCTAGGCAACACTTGTAGA CCCACAGCCCCTTCACACACACACAC ACACACACACACACACACACACACAC GGCTGGGGATCCAACCCATCTCGTCC TTACACGTGCTCTACCATCACACCAC ACATTTCCAGCACTTTTATCTGAAGT GTTTCCTTTTATTTGTGCATG | 781 | K | Wnt1 |
| IM000448 | CATAACCACTATAACCAGCCTGCTTA CTTGGCTTTGTTTCGAGGGCTTTTGT TTTAGAGCTCTTTGTTTTTACCCTTC TCCGTGTGTGTGTGTGTGTGTGTGTG TGTGTGTGTGTGTGTCTGTCTGTC TGTCTGTCTGTCTGTCTTAGTGTTTG TACATG | 782 | C | — |
| IM000449 | CATGTGGTCCACGGTTTTACTTTACT AGGGAGCTACCTGTACCACAGGGAGA GAGGCCTAAGGACAGGAAAGGAGCTG ACCCAGAACTGAAAAGGCACACACCA TTCTGCCAGCACTTCCC | 783 | C | — |
| IM000450 | CATGTCCTACAGTGGACATTTCTAAA TTTCCCTTCTTTTTCAGTTTTCCTCG CCATATTTCACGTCCTAAAGTGTGTA TCTCTCATTTTCCGTTATTTTCAGGT ATCTCGCCATATTCCAGTTCCTACAG TGTGCATTTCTCATTCTTCACGTTTT TCAGTGATTTCGTCATTTATCAAGTC GTCAAGTGAATTTTTTCATTTTCTCT GATTTTCAGTTTTCTCGCC | 784 | R | — |
| IM000451 | CATGTTGCCTCAAGACAGATCTCCAC TAAAGACATACCTAAAGGCCTGGAAG CTTAGTCAATTAAGCTTTCCTGCCCA GACACTCCTCCCTGAAAAAGGTATTT AACCTCAGGCCCACCCTGAGAAGTGG GGTATGATTTTACTCATCCACTTTC | 785 | R | — |
| IM000452 | CATGGTTTCTATTACTGTGTTGAAGC ACCCTGACCAAAGCCAATTGGGGGAC GAAAGGGTATTTGGCTTAAACTTCCA AATCAGTGTTTATCATTAAAGGAAGT CAGGGTAG | 786 | R | — |
| IM000453 | GCAAGTGTCAGACGGCTCTCAGGGAG ATACACATAGCTTTATTGGATAACTG CAGCTTGAAGACATG | 787 | D | — |
| IM000454 | CATGTACCTATGTGTGTGTAACATTT GCCTATTTTCACACAGTTAAGAAAGC ATCGTTATGAAAATCATTACAACTTT CCAGATAAACAGATCCACTCAGCCAC AGAT | 788 | D | — |
| IM000455 | GCCCTTCTCTCTGAACTTTTCAGTTC CTGGATAAAGTCAGTGTTCCACCTCT | 789 | D | — |

TABLE 2-continued

| SAGRES # | SEQUENCE | SEQ ID # | CLASS. | GENE |
|---|---|---|---|---|
| | ATACCTGACTAGTTTTCCTAAATTCT GAGTCAAGCATATTTCATG | | | |
| IM000456 | GACCTCGTGGGCGGGCCTGAGGAGAC AGTGCAGATGAGGTGTCAGTAAGGAG GATGCAAGCAAGAAAGATGCAGGAGA TGATGGAGAAGCTGAAGAAGGCACTG AAGAAGGCACAGGGAAGAAGAGTGCA TG | 790 | D | — |
| IM000457 | CTTGCCGTTGAGAGCGTCCAGATCCC CTGACTTGAGTGGGTCCACCTTGTTT GGTTTGGTTCGCAGTGTCGGCTGTGG AGCCCCAGGCCTTGCATG | 791 | C | — |
| IM000458 | TTCTTATCCACTGAGCCACACTGCTA ATACTGTGATGTCTTTTTTAAGACTC ACCATG | 792 | D | — |
| IM000459 | GGGTTCAACACATTTTTGGAGATTGA TCAAAATTAAAACATG | 793 | D | — |
| IM000460 | CATGAAGGAGAGTCTGAGGCTACATC CACCAGGCTCTATGATCTCCCTCTGC TGCATCCAGGACATTCTCCTTCTGGA TGAAGATGATGCTGGCGCTGGCGCTG GCGCTGACGCTGATGCTGCTCGCTTC TGCGTCCT | 794 | C | — |
| IM000461 | CCTTGTCCTCAAATTACAAAACTCCC TAGGGTCTTTTCTCTGGGCTACAAAA TTCTGCAAATGGACTCAGGAGGAAT CAATGTGGAAATTTCACTTTGCCTTC CCAATCAGCAAAATAATGTTTGCCAA AATCGTTAGATTTCTTTCCCCTAAGT AGGCTACTGCCGACTTGAAAGCAGT GGTTCCAGAACCCGAGCCCAGGGG CTGCCACTTCCTATGCATG | 795 | B | AT4269 08 |
| IM000462 | CCCTTGTCCTCAAATTACAAACTTCC TTAGGGTTTTTTTTTGGCTNCAAAAT TTTNCAAAGGGCTTCAGGAGGAATA ATGGTGGGAAATTTACTTTTGCTTTC CAATCAACAAAAAATGGTTGGCCAA ATCGGTAGAATTCTTTCCCTAAATAA GCTACTGCCGACTTGAAAGCAGTGG GTTCAGAACCCGACCCAAGGGCTGC CCTTTCTATGCATG | 796 | D | — |
| IM000463 | CATGTATCTTAAGAACAGAGCCAGTG CTCTCCCTCTCCCACTTGAT | 797 | D | — |
| IM000464 | CATGCAGANTAAAGTACATATATGTA AAAAATTAAAATAAATCTTT | 798 | D | — |
| IM000465 | GTGCTCTCCCTTGCCTCTCCTCTCCT GAGTTTCTCTGTAGGTGTAAGGGCT GGAGGTGGGCCCAAGAACCAGAGAT CAGAGGAGGGAACTTCCGGAGCAGA GGCCCTGGGAGCAGTGTTAAGCAGG CTTTGGCCAGGTCTGGAGGTGTCCA GGCAGGGAGGTGGAGCTGGAAGAG ACCAATTAGTCAAACGGCTGCAATTG GCCATTTGGAAGCAATTAACAGGGT CTCCATTACCATATTATGCCCCTCCA CCCCCTCCACACTCTACTAGGCTCT GCTCTGTATGGAAGGGGGAAGGTGG AGGCTCANCTCAAGCCAGGGAGACT ACAATGGAGGCCCAGTGCTCGCCAG GATGCACACACTCAGGCACCCTCCG TGTGAGGAGGGGAGGGCAGGGCAG CATCTGAAGCAACCTGTCATTCACAG CCTGANAGANGGTGGGAACAANGGC TTNCAAAGCCAAGAANGCANGTGGN TAGAAATGCANGAAAACCTCTCTGGT AAGAAAGGCTGAANGAAGCAGCTAG GGTTGTAAAACAAGANCAT | 799 | K | Fgf3/Fg f4 |
| IM000466 | CTCCCTCTCCCTCTAGCTGGCCTAGC AGGGGCCAATACAACTGCAGGGAATC AAGGAAGAGCCTTTTCCTGAACTGTC CTGGATGCCCCAGTCCAACAGCAACT CCCACTTGCCCTGGCTTGGTTTGCTC CACTGTCCTGAAGGCACAGTGTGATA TCCCAGACCTCCAGCGAGACAGCCCA ACCTGCAAGCCCTGATGGGAGGGGTG GCCTGAGACAACAGTACCTACATG | 800 | B | A15500 |

TABLE 2-continued

| SAGRES # | SEQUENCE | SEQ ID # | CLASS. | GENE |
|---|---|---|---|---|
| IM000467 | CATGGACTCCAGGGTCAGGGTGTAAG AAAAAGGTGGAGCCTGCTAGGTGTGG TGACACACACCTTTAACCCCAGAACT CAGAAAGCTGAGGCAGGTGACTAGCC AGGAGTTCAAGGTCATCTAGTTCATC AGATCTATAGAGTGAAACAGCCAGGC TACATTTGAGATC | 801 | K | Fgf3/Fg f4 |
| IM000468 | GCTCAACACTTAAAAGCGCCTGCAGA GGGGTGGGGGTTTAATTCCCAGCACA CACATAGTGGCTCAGGGAATCTGAAG CCCTCTTCTGGCCACTGCGTGAACTG CATG | 802 | D | — |
| IM000469 | GTGGGAAGCTATACGAAAGTAAAACA CACTCTAAGAAAGAGAACAGGCTGCC TGGGAGAGGGAGGTGCCAGGGGCTTA GACAGGAAGGTAGTTTTCAAAAACTG AAAACTTAAGCTATCTGAATGAATGA TACAAAATAAAAGAAGACACAAGAAT TTCCAGTCACCTGAGATATCTCACAC TCCTGTTCTTTCAACCTTCTAGCTGA AAGGAGAAAGAGCCATG | 803 | D | — |
| IM000470 | CATGGAAGGAGTTACAGAGACAATGT TTGGAGCTGAGACGAAAGGATGGACC ATCTAGAGACTGCCATATCCAGGGAT CCATCTTATAATCAGCCTCCAAACCC TGACACCATTGCATACACCAGCAAGA TTTTGCTGAAAGGACCCTGATATAGC TGTCTCTTGTGAGGCTATGCTGGGGC CTAGCATACACAGT | 804 | R | — |
| IM000471 | CATGCTTAGATTGACCGCAATATGTG TGGTACTCTTCAGACTTTTAAAGATT TGCTGAATATCCTATTCCCCTTAAAT TGTGATCACCCTAGCTAGATCTAATC TTAGATCTCGAAAGTTCTACAATTTG CCTCAATTTGATTACTGTTTTCCTCC TTGAAGAC | 805 | D | — |
| IM000472 | CTTGCCTTGGGAAGTGAGGGGTTCTA ATGAAGGTTGCAAGCCTGTCCACCCA GGGCCCTGCTAAAGAAGGAATGGTCC CCAGCCTGTTTTGTCCCCTCTGTGGC TTCTTAGTTCTGGACACTGAGCCAGT CTGGGCAGCAGGCAATTCACACTGTG AATTTCTGTGGAAAGCATTTTGGGGG TTCTGAAAGCCCTGTACATTCTGTGT TAAGGACAGAGGGCCTCCTGCATG | 806 | K | Fgf3/Fg f4 |
| IM000473 | CATGGGGGCTATGTCCTAGGGTAGAC ACCCCCTTTATCCCTCAGCTCCTTCC CTGTCTTAGCAGTGGTGTCCCCCACT GTGACTCTACTGCATCTGGGAGCTGT CTCCCGGGGGACTTCCTCCTGCTGGA GTGAGTAGGTGGCTAGGGCGAAGCCT GTGTTAGAGGCAGGAGGTGTTTTGCA CAACTCCAAAGGGTGCAGATCCTGCT GGCTCCAGCTTCCCAGGGCCAGACCC CGAAATACCCTTCACCCAGC | 807 | K | Fgf3/Fg f4 |
| IM000474 | GTGTATGTTCTCTGGTGAAAGTGTTA ACCAGCTCACTCCGTGAAGAGCACGC TGCTTTCAGATCAGTGTTCAGAGTCT TGAATAATTGGTTTTTAGAATCATAA AATTGCAGTCCTTTACAAAGGACTGG AAGTGACTCATG | 808 | D | — |
| IM000475 | CATGTGAATTCTCTATTTGCAATGTG CTTGGTTCATACTTCCATACTCTACC CAGAGCCTGTTAGAAAAATCACTCTT CCCCACCCTATTCTTCACCAGTCAAT ATGTATCTAGTATTCTAAACTTCCTC CCTCCTAAGGCAGTGGGGAAG | 809 | D | — |
| IM000476 | CATGTGTACTCTCACCATCAGAATTA TGAGCAACCCACAATTTCTTCACATT TATAACTGACCCAGTCTGAGGTATTG TGCCTTTAGCAACAGAAACTGAACTC AAAACAATCGGCACAC | 810 | C | — |
| IM000477 | CCATATCAGACCAACCTTCCCACACA ACAGTAGGCCACCAGGTGGGGCAAA GTCCTGGGTAAGGTTCTTGGCACTGT AATTTTGAATCCCAATAATAATGACT GTGTTATTTGCTCATG | 811 | D | — |

TABLE 2-continued

| SAGRES # | SEQUENCE | SEQ ID # | CLASS. | GENE |
|---|---|---|---|---|
| IM000478 | TAAAACCTTTAGGGAGCTGATAAAAA TCTATCAAAACAACACTCTGTCTCTC GTATCCAGCCATCCATG | 812 | C | — |
| IM000479 | TCTGCCCAGCCTTTGCTTCCTCCCTG GTAACAGGATGCTAATTAGAATTCATG | 813 | B | AAT117784 |
| IM000480 | CATGTAAAAAAAAACTTCATTAACAA CTACAACAAAGCAGAGACCTTGGCC CTTGGATTGGGGCCCCTCTGAGAGC TATAGGCTGGGATACTGG | 814 | D | — |
| IM000481 | GTGCGTGATAACCAGGCTGGCAGTGC CCTCTGCATCCCACATTGGGAACAGC AGCCTGATACTCCAAGGCTGCCATG | 815 | D | — |
| IM000482 | ATGTCAACATTGAGTCCAGTAAGGAC ATCGTATATGCTGGTCATTATTATAG CTCTTTAGGGTTCATACATGAGACAG ACCACCCCCTTACCCCCTCCCCCGTC TGGGCTAAAAGCAGACACACTGGGTT GGTGAGAGAGCAGCAG | 816 | K | Wnt1 |
| IM000483 | CATGAGACAGACCACCCCCTTACCCC CTCCCCCGTCTGGGCTAAAAGCAGAC ACACTGGGTTGGTGAGAGAGCAGCAG | 817 | K | Wnt1 |
| IM000484 | CATGAGAAAAATTTGTCTCTAATTCT CTTTGTTGAATTTTTGTGTGGTTTTG ATATCAGGTGATTGTGGCCTCATACA ATGAATGTGG | 818 | R | — |
| IM000485 | CCAGTGAAGTAAACCCAGCAGGAGCC TTTACAAAGCCAGGACATG | 819 | D | — |
| IM000486 | TCGGGGGAAAGTTATTTTTATACCTT CCCGCTCTGGATTAAGGGAGGGTAGG AAAGGATTGGATGAAGCTAGAGACAG AGTGGCAGGAAGGTGGTAGACCTGAA ATTGTCAGACAACCACTTATCGTTGG GAAGGGTATAAGGTGACCACAGCACT AGCAGACTGTTCTGGACGTAGTAAGG AGTTCCTGCAGGGGAGGAGTGGGTCA GCCETTGAATCCCATATGGTGGTTCA CAAGTCAGCCTACATG | 820 | D | — |
| IM000487 | CATGTGTTTTAGCAACTGTGCTCAT TTTCTGCTGCTGCTAGGAATAAAATC AAATCTAGTANAATTGCTTTAATACA AAGTTATTGTCATCCATCTCTGAAGA TCTGAAGTATTGCTGGGGGTCTCCA ACTCACCCACC | 821 | D | — |
| IM000488 | CAAGGGCCTCTCCTCCCACTGATGGT CGACCAGGCCATCCTCTGCTACATAT GCAGCTAGAGACACAGCTCTGGGGGG GGGGTACTGGTTAGTTCATATTGTTG TCCCTCCTATAGGGTTGCAGACCACT AGGTCCCTGGGTACTTTCTCTAGCTC CTTCNTTAGGGGCCCTGTGTTCCATC CTATAGATGACTGTGAGCTTCTTATA AGCATAAACTTTCACTTACCACATG | 822 | R | — |
| IM000489 | CATGGTGTTAGCCTCCAGGCAGGAAG CATACCAGAGGAGAACTCCACAGGGA AGCCTTTGTTTTCTGCTGTTAAAAAC AAAGTATGATGGGCTTAGAAGAGGC TTTAAGAGGTCCTCTGGAGAAAAGAA TCTATTTTCCATT | 823 | D | — |
| IM000490 | CATGAGAGGTTTTTAAGTCCTGAAAG ACCATCATACCTAGAGTCTATACAAC AAATAAACTTGGTATACAGTGAAGCT AGTAAAAATAACTTCCTGAGCTTATGG | 824 | D | — |
| IM000491 | CACAGTCAGGAAGCAGTTGATGAACG TTGACTCTCAGCTCTCCTTCTCCCTT TAGTTCTATGGAGGTCTCCAGCCCATG | 825 | K | Fgf3/Fgf4 |
| IM000492 | CATGATAAAAGTCTTGGAAAGATCAA GAATTCAAGGCCCATAAATAAACATA GTACAAGCAATATACAGCAAACACAG TAGCCAACATCAAACTAAATAGAGAG AAACTTGAAACAATCCCACTAAAATC AGGGACTAGACAAAGTTGCCCACTCT CTCTTTAACTGTTCAATGAGTACTC AAAATCCTAGC | 826 | R | — |
| IM000493 | CATGGTAGCTTTCTAGTGAGGTCTCT TCC | 827 | D | — |

TABLE 2-continued

| SAGRES # | SEQUENCE | SEQ ID # | CLASS. | GENE |
|---|---|---|---|---|
| IM000494 | AGTACCCTTAGCCTATAAACCATCCC TCTAGTCCCTGTTTGTTTTGTTTTTT TTTTAAAGACAGGGTCTCACCATG | 828 | K | Fgf3/Fgf4 |
| IM000495 | CATGAGCTAGGCCATCTGCAAGCTGG TCTCGTCTTGACCAGGAGTACACAGA AGCCTGGCTCAGGACTTGGTAAC | 829 | D | — |
| IM000496 | GTTGTTTATGCAGATCTCTCAGCGTT AGCATTCTATGGGATTCTTTGGAAAG ACCTTTTCAGTTATCTTCCATTTCTG AGGCTGTTTCTAGGCAACGGAGTGGT ACCTTCCTTTAATCTTCCCCTGACCT TTTCTGCCTATGAAGATGTTGACTAG TGAGCCCGTGGGGATGTGTATTATCT GTTACATTTATTTATGGCTTGGTAGC GACTCCTTGGTTGTTGTTCAGCTTTT CATG | 830 | D | — |
| IM000497 | CATGCCTCCCTCAGCCTCCTCCCAC CCCTTCCTGTCCTGCCTCCTCATCAC TGTGTAAATAATTTGCACCGAAATGT GGCCGCAGAGCCACGCGTTCGGTTA TGTAAATAAAACTATTTATTGTGCTG GGTTC | 831 | K | Wnt1 |
| IM000498 | TCTAAGTCCAGTCTTTCACACACACT GACTTTGGTCATCTGTAATCACAACA TG | 832 | D | — |
| IM000499 | CATGCACACAAACTGGCCCTGAACTT TTGACTTCCAGGCCTCTGCCTCTCTG CGCGCACACACACACTCGCACTCCTG TATATGAAGCGTATATGTGTTTCTCT GGGAACTGTTTTTATCAGGTGAAG | 833 | K | Fgf3/Fgf4 |
| IM000500 | GGGCTGAAGGAAAATGTTGTGTCAT CTTTTGTGGCATG | 834 | D | — |
| IM000501 | CATGTACCACTTTTGCTAATCCCCTA ACCGCCCCTTGGTAAGCATCTAAAG TGATATATCTCTTGGTCTACTGAAGT TCTGCCCTGTCTCCATCGGGGATTC TCGGGAGGCTAAAATTATAGACTATT TGTGAAAG | 835 | D | — |
| IM000502 | CATGTCCTTATGATATGGAAAAA | 836 | D | — |
| IM000503 | CATGTGCCAAGAGCCATTACAGGCT CAGACTAACATCTGCCTGTAAACAAC GGTTGCTAAGTTTCCAGGGAAGCGT AAG | 837 | D | — |
| IM000504 | CCAGATGACCTTGAACTCAGAGATCT CCTTGCCTTAGCCTCCTGGGATTCAT AGCCGCTATGCCTCAAGATCTCCATG | 838 | R | — |
| IM000505 | CATGTAGTTTGCAAACAAGACATCCC TGGTATATCCAGAACCTGAGCTATGC | 839 | D | — |
| IM000506 | GGATATAGTGTCAAACAGTCTGATGT ATTCATAGGTTTGTATCCATAGTTAT CAAATCTCTCATG | 840 | D | — |
| IM000507 | CATGTACCACACACAGACTTGGTAAT AAGTTAGATGATAATTACAAAAGCAA CAAATAAAACCAACAAAACAAAACAA AGCTTGGTAATA | 841 | D | — |
| IM000508 | GTTAGGAGCACGAACTGCTGTTTCAG AGGACCTGGGTTTAATTCCCAACACT CACATG | 842 | R | — |
| IM000509 | CATGGTCAATGATAAACATTCCAAAA CACCAAAACCATCCTCTCTGTACAGG CTATGATGATTCAACTGCTGCCCTTC CTCATTTCTTGTTCCCAACTCCTACT GAATATTTCCTGCAT | 843 | D | — |
| IM000510 | CATGATAGAAGACCACGTCTGGGATG GGGTAAGGGTTTCTCAGAGTACCTTG CCCTGGGGCCACATCCTAAATCTACA ACAAAGCTGACCCTA | 844 | D | — |
| IM000511 | CAAGTTTTTGTAAGGGAGCTAAGAAA GGCATTGTTGGTTAGGTTGGAAAGAG GGGGCAGGACCTGGCTCTCGCTTCAG CCCACTCCCCTCTGCCCCCCAGCCTC AAACACTTTTACCCTAGCATAGCAGA AACATG | 845 | D | — |
| IM000512 | CATGAACTCAGTGGGCAGATGAAGAG TTTTTGTGTGAACTGGGGCTTGCCC TTATCATCCTGTGTGTTCTCCTGGTG | 846 | K | Fgf3/Fgf4 |

TABLE 2-continued

| SAGRES # | SEQUENCE | SEQ ID # | CLASS. | GENE |
|---|---|---|---|---|
| | ACCCTCAAGCTTGGCTGCAATGATCC CCACTTACAGAT | | | |
| IM000513 | GTTTATTACTCCAATGATTCGCACAG CCGGGTTGCAAGTCTAAGGCAGGCTG TCTGCCTTCCTGGAGGTACTTACCCC ACCTCCCCCTCTGGGGAGCTCCACT TGGCCATG | 847 | R | — |
| IM000514 | CATGATTTTCAGTTTTCTTGCCATAT TCCACGTTCTACAGTAGACATTTCTA AATTTTCCAACTTTTTCAGTTTTCCT CGCCATATTTCACGTCCTAAAGTGTG AATTTCTCATTTTCCGTGATTTTCAG TTTTCTCGCCATATTCCAGGTC | 848 | R | — |
| IM000515 | GTAACCACTCATTTACCTGCCCCAAT GATGTCTGGGCCAAGGCACTTTTAAA TTCATATCTACTGTGACTATAGGTGC CCATG | 849 | D | — |
| IM000516 | CATGACACTGCTCACTGTTGCTCTCT AACCTTGGTCCAG | 850 | D | — |
| IM000517 | GNGCTTGGCAGAGTAGAGAAACTCTT TGGGAAACTTGGTTCAGATCCAGACA TG | 851 | C | — |
| IM000518 | CACCTCTGCCTCAGTTTCCCTGATTA TCAACAAGTGCTCATG | 852 | D | — |
| IM000519 | CATGTAACTCAAGAAAGTCTAGTAGG CGTAGTGGTAAATGCCTGATCCCAGC ACTTGGGAGGTAGAGGCAGGTGGGAT CTCTACAAATTCAAGACTGGTCTGGT CTATATAGTGAGTTCCAGGCCAAGCT TCACATTGAAATTCATCTCAAAACAA TAAAAATAGAGGAAGATATAGTCAGG CAC | 853 | R | — |
| IM000520 | GAAGACATTCATTTTTTTCTTGGGAG GGGATAGAATCCAAGGCTCCAAAGCA GAGTTCATG | 854 | D | — |
| IM000521 | GACCACGCTGGCCTCGAACTCAGAAA TCTGCCTGCCTCTGCCTCCCAAGTGC TGGGATTAAAGGCTGTGCCACCACTG TGCTTACTGATCTCTTTGATGTCCCA GTTATAGCTCTTGGGTTCCCCACCCA TTTGTAGGGGGACCCAGGACACCTCA GAGCTCTCCCAAGTCTAAAAAGGGCA GGGTTCCTGGCTCCCTTAATGCCTTA TCAAGCACAACAGAACTCAGGGGCAG AAAATGTTCCCAGGAAGAACTTAGCT GTGGGAGAGTCATG | 855 | R | — |
| IM000522 | CATTTTTCTTTATAGCTGAGTGTTAT TCCACTGCAAAAATTTGAATATTCCA CTATTCTGTTGATGAATGTCTAGGCT GGTCACGTTCTCTTGCCTTTGTGAAT GGAGCAGCAATAAACATAAGTGGGCA TG | 856 | D | — |
| IM000523 | CTCCATTGGGCCGAGTGAAGCTGTGG TTCAGAGAAACTCTATGGACAAGCTT GACTTCCAGAACATTGACCTGGTCTC TGAGATCAACAAGCGTAGGAAAGCCA TG | 857 | D | — |
| IM000524 | CATGGGAAAGTAATCCGTGGCTAACA CAAAGGGGAAATAAAGTAATATT | 858 | D | — |
| IM000525 | CATGTAGGACCCTGAATGCCAGCAAT GAACAATACCAGCTTGGTTTTCCGAC TCTTGCTTTCTCCTCCCTCCACTACT AACTAGCCTCACCGTTGCATCTTGTG ACTCAGAGGTCTTGTTTCCAGGGCTT CCTTCCTTCCAGTGTTCTTCTAATGC ATCTAAAGTGAAGGGGTGG | 859 | D | — |
| IM000526 | CATGCAAAGCCTCTGCAGGGCCGACA GCAAGGAAGGCCCTTCTAGATCTCCA GCACTCTGTCAAAAGCCATCACTCGG CAGGCAGGCAACCACAATGTAGGGAA GACCTGTAAAGCCTTCAGAGAGGAAC AGCTGGCAGCCCCTGGGTCACTCAGA GTGGCCAACAGCTACTCTTGTGGAGA CAGCAGGAGGAGGCCTAGACTATAGA AGGATGGAGGAC | 860 | D | — |
| IM000527 | CATGCACACAAACTGGCCCTGAACTT TTGACTTCCAGGCCTCTGCCTCTCTG | 861 | K | Fgf3/Fg f4 |

TABLE 2-continued

| SAGRES # | SEQUENCE | SEQ ID # | CLASS. | GENE |
|---|---|---|---|---|
| | CGCTCACACACACACTCGCACTCCTG TATATGAAGCGTATATGTGTTTCTCT GGG | | | |
| IM000528 | CATGAAACATTATTTNTTTTGGAAGT CTGCAGGTAAACTTAAATAGGTTAA | 862 | R | — |
| IM000529 | AGCAAGAACAAAGGAAGTACTTCAGC TGATAAAAACAGTTCCCAGAGAAACA CATATACGCTTCATATACAGGAGTGC GAGTGTGTGTGAGCGCAGAGAGGC AGAGGCCTGGAAGTCAAAAGTTCAGG GCCAGTTTGTGTGCATG | 863 | K | Fgf3/Fg f4 |
| IM000530 | GATTTTTATTTCCTTAGCATCCTGAT TGGAGATGGCTGGGTGCACATG | 864 | K | Fgf3/Fg f4 |
| IM000531 | CATGTAGAGACTGCCATATCCAGGGA TCCACCCCATAATCAGCATCCAAACA CTGACACGATTGCATACACTAGCAAG ATTTTATTGAAAGGACGCAGATGTAG | 865 | R | — |
| IM000532 | GACCTGTACCCTACCCTCTGATGGAG GCCATCTATTTGCCTGTCCCCAGGAG TCCCCAAACTGCTCAAAGAACAGACT GTGGGCTCTGGAAAGCTAGCAGGTGA CCCCGGGGATGTTCTGAGCAGTGCC TTACTGAAGTTTATCCAGGCCCTAGG GTCCCCTCAACTGCTCACACAGCCTA GGGTGGGTCTCTTGAGGAGTCACTTG TCACTTCTGTTGCTTCCCAAGAGACC CAGGGAAAAAAGGAAGGAAGGCCATG | 866 | D | — |
| IM000533 | ATCTCACTCGTAAAATGAACAAAGGG ACTGCAGAGATGGCTCTGAGCTTTTA AGACCATAGCCTGCTTTTCCAGAGAG CCCAGGCTTCATTTCCCAGCCCACAT ATGGCAGTTCACAACCATCTACAACT CTAGTTCCTGGGGATCTCACACTTTT GTCTTCTGTGGGCACTGCGCAAATGT GCACAGAAATACACGCAAGGAAAACA CCCATG | 867 | K | Fgf3/Fg f4 |
| IM000534 | AAGAAACACTCTTAGCTGGGCCTGGA AGTGCACATG | 868 | D | — |
| IM000535 | CTAAAGCAGATTATTATACTTATTCT ACTGACCATAATGCAACCACTATTAT ATAAACAGAACATACTATAAAGTGAA TAACATTAGGATACAAAATGTATAAA AGGGGAGAGAGGATAACCATTGTGAA GTATGTTTAAATAAAATGTTTGGGAT TTGAGGAAATTAATAAATTAGTTACC CTTTTTGCTTTGGGGAAAGAAAGGCA GCATG | 869 | D | — |
| IM000536 | CAGCCCCAAACCCATCAGCCTGAGAC TGATGCACAGGAGGCAGGCCAGTTAG TTATTCTCTGGGCCCCTCTATTTTGC CTTCTGTAGGTTAATCCCACCGCTCC CAGTGCTGGAAAGTGCAAGCATTGTG GGAAGTTAAAAACGTGCCACCATG | 870 | D | — |
| IM000537 | CATGGACAATGCACCCCTCAAGCAGT GTCTTCCATACAGACAAGCATATTTA TTTTCTATACAGACAGCAACTTTGCT GAGGTGTAAGG | 871 | K | Fgf3/Fg f4 |
| IM000538 | GGATGAAGAAGCCCAAGGTATTAGGT CAGTCTTGCTCTGACTTCTCACAGTA AAAATACAACTCCCAGGGACTAAAAT GACACAGAACAGCTTAGCCTCTGGAC ATTGCTTTTGGATTGCAAAGTGATAA GTGAAAAAGTAATAAGTCTATCTACA TTGGAAAACATTTGGTAACTTCATTT AAACACACTTCCCCATG | 872 | D | — |
| IM000539 | CATGTCCTACATTGGACATTTCTAAA TTTTCCATCTTTTTCAGTTTTCCTCAC CATATTTCACGTCCTAAAGTGTGTAT TTCTCACGTGTATTCGTTGGTTGTTG GTTTAGTTCCTGGGAGCTCTGGAAAT CTGATTATT | 873 | R | — |
| IM000540 | TGGAAAATGAGAAACATCCACTTGAC GACTTGAAAAATGACGAAATCACTAA AAAACGTGAAAAATGAGAAATGCACA CTGAGGGACCTGGAATATGGCGAGAA AACTGAAAATCACGGAAAATGAGAAA TACACACTTTAGGACGTGTAATATGT | 874 | R | — |

TABLE 2-continued

| SAGRES # | SEQUENCE | SEQ ID # | CLASS. | GENE |
|---|---|---|---|---|
| | CGAGGAAAACTGAAAAGGGTGGAGAA TAGAAATGTCCACTGTAGGACGTGGA ATATGGCAAGAAAACTGAAAATCATG | | | |
| IM000541 | TGACATACAGAAAGAACACAAATACC TGTAGCTGCTGTGACAGGACCAACCA TTCTAAATATCAAAGCAGCTGTTGAC ACCTAAGGACTGGTCTGACTGCTAGA TCTAGGAGTTTCTTACTTGCAAAAGC TGGCTTGATGCTCATG | 875 | C | — |
| IM000542 | TTATATATATATATCGTTTTCTCTTA CTCCTGAATCAGTGACATG | 876 | D | — |
| IM000543 | CATGTCAGCCCTCAGCTTTACACAGG TGTCAAAAAAAAAAAAAAACACTGAC TGAGATCTTCCGTCTGCCATTAGCTG TTATTGTGTACATTAAGTAGAATCCA CTGCTTAACCCAGGCTACTGGGCTCA CCCCAGTATTCAAGGAGGTGCCACAG GAACTCAAAGGATACAGAAGTTACAT ATTAAAACCCAATCTCGTAGAGGATTC AGAGGAACTAAGTTTGGTAGGGGCAC AGATTGTAGTACCATTAAGCCCCTCT GTTCCTCGTGGAGAACCACTACTGTC CAGCTAGGCGGGAAGGACCCAAATCA AGCAAATGAGACTTGTTCTGG | 877 | D | — |
| IM000544 | CATGATANATCCCTTTTTGTGAGCAT TCCATAGCCTCAGTAATAGTGTCTGA CCTTGGGACCACGCTGTATCCCACT NTGGGACCTTCTTTTCNTCAGGCTAC TCTCCATTTCCATTNCTGTAATTCTTT CAACAGAAACATTTATGGGTCANAG GTGTGACTGTGGGAGGACAACCCCA TCCCTCACTTGATGTCCTGTCTTCCT GCTGGAGGTGGGCTTTATAAGTTCC CTNCCCCTACTGNCCAGCATTTCATC AAAGATCCCTCCCTAGGAATCCTGG GAACCTCTC | 878 | D | — |
| IM000545 | GATAAGCTTATCTTGAACTTGAATGT ATATGGAGAAGCAGAAACCTTGAAAC AGCCCACAGAAACTGAAGAAGGATGA AGGTGGAACTCTCAGCTGGAATATTC ATG | 879 | D | — |
| IM000546 | CATGTTCCCAGCTGGGCAAGGCCTCG GGTTCCTCGGTGAAGAGTGTGGACCA GCCGATGAGCCCTCCGACGTGTGGAT GAAACGGGTGGCTTTTGTTTAGTTTT GTTTTAACCTCCCCAACGAGACTTTG ATCAGCTCCACCTCGAAAATGTTCGC GAAAGATGCGGAGAGCCTGAGGGACT GCGGGGCAGCAACGGGCTCCGGCCTA GCCCGGCCCGCCGGCCCCAGA | 880 | B | A14132 88 |
| IM000547 | ACCAAGTGTTAATAATGTACTGATGG CTTCTGCCTGTGGCAGTACACTTGTC CTCTACACATG | 881 | C | — |
| IM000548 | CCTTACTGCAGAGATGACTCGGCCAA CGGCTTCGAGCCCCTGACCACTTCCT CAGGTTTGGTTTTGTTAGTTTTTTCT CACAGCAATGGGAAGCATTTATCAAT ACAACTTCCCAGAATGCGACCTGTGA CAAGGCCAATGAGCAGACTCAAGGCT GGGCACATAAAAGCACCAAAAAAAAA AACTCCCTTGCAGTTATTGTTCATG | 882 | D | — |
| IM000549 | GACTGAGCCTGCCTGGGGCCGTAG GGAAGGGGGGTTGGACCCTCTGG TATTTGCAGTTACCACTGACAGGGTT TTTCCGAGATGCCAGTGTCAGGGTG TTCGGTGCTGACCCCCAGGGACCG TGCAGCCCCGATGGCTGTCTCGGTC CTCTCANCTTTTCCGCCACCCCTGG GATATTTCAGGACTCANTCCCCGCAA CAGCTCTGACTGAGGTCAGCTCTGT GACCAGGGNCCCTGTCCCCGGTGT GNNGTGTATTTGCATG | 883 | K | Wnt1 |
| IM000550 | CATGTAGAAGGCAGAGGACAACCTTC AGGGATTATTCTGCCCTTTCAC | 884 | C | — |
| IM000551 | GTTCCTCCATTCTGCTGCTTCTCCCT GATACATTGAGTTACAGCAGCCCACG CGTACACACTCTCGCACATG | 885 | K | Wnt1 |

TABLE 2-continued

| SAGRES # | SEQUENCE | SEQ ID # | CLASS. | GENE |
|---|---|---|---|---|
| IM000552 | CATGCCACCAACAAATAAGTAAGTAA AAAAGAAGGAAGGAAGGAAGGAAGGA AAGAAAGAAAACATTTTAAATCTGTA AT | 886 | D | — |
| IM000553 | CGGAGCTTAGGTCTATCATTTAAAGA TACAACCAAATAGGCAGAATCATTTC CTGAGGAGCCCATTTTCTTTATCTCA GGTCCTGCAGATTTCTCCCTGGTATT ATCAGGGAGGAGCAGCAGCTGAGCTA TCCTATCTCCTTTACTAATAGAAAAA ACGCCTTTAGGGCTTGAGCACAGGAC CTGTATTTCAGGGGAATGTTGACAAT CCATAACTCCAGGGTGGACTACTAAG CCCTGCAAGGTGAGTGAACCCCGGCC GAGAATAAGGGCCATG | 887 | R | — |
| IM000554 | CATGGCCTGAGAGTTGGAAAGAGTAT TGTAAGCAGGGGTTGTTCCAGAAAGT TTAGAATATAGAGACACTATACTCTA TCCAGACTTCTTGGCAGAGGGAGTTC AAATGTAGACTCTGAGCCCCGTCCTG GGGCAGCTTCTTCCACCTGCTTTGGG TAGAAGCAGGCAGACTCTGGGTAGAC TCTGATTCCAAGGCTAAGTAACCCCT GAACCCAGAACAGTGTTTTC | 888 | D | — |
| IM000555 | CCAGATATCATACTGAGTTCGTAGGT GGTTTTAATTAATCACGGGCCCCTGG GATG | 889 | D | — |
| IM000556 | TTGGTGATCCAAACCCAAAGAGACAA ATGCTGAATGTTCACTCTCATTTTCT GTTCTTAGCTCCAAATCTTCAGATAT GAGTAAGCAACACATAAATTATGAAG GGACCATACTGGGATGTAGGGGGCTT GCATG | 890 | D | — |
| IM000557 | CATGAGCACTGCTCTAGGGACACCT CCCATCCCTTCCTAGCACCCCAAAT GCCCCTTCCCATCTCTCCTTCCAGAA GTTGGA | 891 | K | Wnt-3 |
| IM000558 | ATATAGCTGTCTCCTGAGGGCCTATG CCAGTGCCTGGCAAATACAGAAGTGG ATGCTCACAATCATCCATTGGACAGA GCACAGAGTCCCCAATGAAGGAGCTA GAGAAAGTACCCAAGGAGCTGAAGGG GTCTGAAGCCCCATAGGAGGAACATC AATATGAACTAACCAGTGCCCCCAGA GTTCCTTAGAACTAAACCACCAATCA AAGAAAACACATG | 892 | R | — |
| IM000559 | CATGATAAGGTTAGAGTTTTGTGAGC CTCCTTAACCTTGCTCAGCAAGCGTT GGGCTCTTGGCAGCCGAGCTGCCATC TTTCTCATCCCCGATAGAGCCAGCCG CCCTTGTCGTGTCTTGAATAAGTTAG AGGAGGCATTATAGAGCGGACCTAAA CATTTGCCTTGGAGCCTGAGGGATGG GGATTGGCTGAATGTGAAT | 893 | D | — |
| IM000560 | CAGAACTGTGCTCTTTAGGAAGCCAG ACGCTATGCCTTAGGCCCTGTTCCCT CCAGACCTTGCTCTGTGCTACAGTGT AAAAGCGAAGATCATG | 894 | D | — |
| IM000561 | GAGAATTAGTAAAGAGATAACAAAGG CGAGAAAGAGAGGCGTGTGAGAGCATG | 895 | D | — |
| IM000562 | GTTTCCAGATTGTCCTAGTAGCTGGG CTGCAGGAACAGCCAGCATG | 896 | C | — |
| IM000563 | GGGGGTGGGGGTGGTAAGAGAAGATT AATTAGCCTAGCATATATAAGGTTTT GGATTCAATCTTCAACTCCACCCCTT AAAGAATAAATAAACAAGTAGATAGA TTATAGACAGACAGCTAGATGGATAG ACAGATAGCTACATAGATACATAGAT AGATGATAGATAATAGACAGACAGAC AGATAAATGATAGATAGATGATAGGA AGTCCCAGTTAACAAATGGAAATAAA AAGACAAAGTCCCCTTTGTCCATG | 897 | D | — |
| IM000564 | GTATATGGAATATGGCAAGAAAACTG AAAATCATG | 898 | R | — |
| IM000565 | CATGGTAAAGGTCAGGAGTACACCTG TGCTTCTGTGTTCTTCTGTGTTGGCT GACAGCTGGGCAGAAGTGAGTTCAGG | 899 | B | AA111354 |

TABLE 2-continued

| SAGRES # | SEQUENCE | SEQ ID # | CLASS. | GENE |
|---|---|---|---|---|
| | AGGNCAACCCATACGATGAGACAAGC CGGGGCAAAGTGGGATATGTGGACCG CAGCACATCAGAAGGGTGTGCCCGAC ATAAAC | | | |
| IM000566 | CATGAAGTATATTATTAGAGGGGAAC TAGTCTTACTGCTGAGCAGCGTGTTG TCTTCTACAGAGGATGTTTGTGTTCT GGAATTTAAAATTACTTAAAGTAATA GTGTCAATGAAACGTTGTCCGGTGAC TTGCTTCTTTTAAATGATCACTGTTA GACAGGGA | 900 | R | — |
| IM000567 | AATAATCAGATTTCCAGAGCTCCCAG GAACTAAACCAACAACCAACGAATAC ACATG | 901 | R | — |
| IM000568 | CATGATTTGATAGGGTTATGGTTCTC TGGAATCTAACTTCTTGAGTTCTTTG TGTATATTGGATATTAGCCCTCT | 902 | R | — |
| IM000569 | GCAAATAGTCCTTTGTACCGAACTTC CACACACTAATGTAGTGAATTATTTA AAATTTATTCCTTAATCTTTTTTTAA AGTCCAGACTCTATCCCCCTCCTTGT CCACCCTCTGATTGTTCCACATCCCA TACCTCCTTGCCTCATG | 903 | R | — |
| IM000570 | TTCCATCTCTTGTATTCTGTTGCTGA TGCTCACATCTATGTTTCCAGATTTC TTTCCTAGTGTTTCTATCTCCACTGT TGCCTCACTGGGTTTTCTTTATTGTG TCCACTTTCCTTTTTAGGTCTTGGAT GGTTTTATTGAATTCCATCACCTGTT TGGTTGTGTTTTCCTGCAATTCTTTA AGGGATTTTTGTGTTTCCTCTTTAAT GTCTTCTACCTGTTTGGTTATGTTTT CCTGTAATTCTTTAAGGGATTTTTGT GTTTCCTCTTTAATGTCTTCTACTTG TTTAGCAGTGTTCTCCTGCATTTCTT TAAGTGAGTTATTTAAGTCCTTCTTG ATGTCCTCTACCATCATCATG | 904 | C | — |
| IM000571 | GATGAGTTTTCTACTTTTTATAAAA TTATATAAAGTCATTTAGTAGAACCT AGCTTTATTTAATTTTACCAATTAAT ATAAGGCCACTGATATTATTGACTTT TGTCACTACAAAATACAGCAATGAAA TAATCTTTCTTCTAGGCTCCTTCCTC ATCAAACTAGTTCTTCAGCTCACATT AATACTTTTTTCAAGTTGTAAGGGAC CTCAGGGACAGGGGGC | 905 | D | — |
| IM000572 | CATGAGCTTATAGTTTCAGTAAGAGA GCATAGATAGAATATAGGTGCCTGTG CGCTGGCTCTTTTGGTTGTATTTAAA TCCTTTATCTCTGAGAAGTCGGAACT GTTGGCAACAGACAATATGGTAGCC | 906 | D | — |
| IM000573 | CTGACACAGGTATGCCCAGTCCATAG TGTGCAGAGCACAGATGGCCAAGGAT AACTAGGAATGAGACCTACTTAACCC AAACTCCAAACATTATGAAACTTTAA AAAAATGACTTCAGTTGAACTTTGCA GGTAACCACATCATG | 907 | D | — |
| IM000574 | ATTGTGTCCTTTTAACATTCTTGCTT TAGTAGAACATCCTCTGACCCGTATC TGATTCAGTGAAAAATTCCTTCACGA GTCTGCCTTAGCAAAACATCCTTTCA CCTGTGTCTGCTTCAGGAAAACACCC CTTCACATG | 908 | R | — |
| IM000575 | CATGTTGGTAACAGATACAACAAGCA GACTTAAACTAATAAGAAAACAGCTA TGATTAATATGTTATAACTTAGCTG AAGAGAATGTATGGAGCTTTGAAGTT AATCTTTTCATATACACAGGAATGCC TTCAAAAAGCATTGCAGCAGATTTCA AAGGATTAAACTCAT | 909 | D | — |
| IM000576 | CATGTGGCGAACCAGCATCACTTTTG CTCTTTCCTTACTAACCCAGGACATC CATCATTATTTTTATAGCATCCACCC TAGTAGATATAAGGTGATACCTTATT GTGATTTCATTTGCCTTTCTCTGAAG ATCACTAACAATCAAAATCTGGTTCA TTTTATTTATGAATTCTCATTTGTCT | 910 | D | — |

TABLE 2-continued

| SAGRES # | SEQUENCE | SEQ ID # | CLASS. | GENE |
|---|---|---|---|---|
| | TTTGCTAAATATATGTTCACAATTCT TTTCAATTTAAAAGCAAATTGTTTTG TTAATAATGAGCTAACTTTTCATACA TTGAAG | | | |
| IM000577 | TTGCTGTGGGCCTAATTCAAGGCTG ATAGATCACCACAGAAGGACACTGTT TTCCTCCGGGCAGCAGGAAGTACAG GGTAGGGACTCTAGAATCACTGCCC TAGGGCATG | 911 | B | A166396 9 |
| IM000578 | GTACTTGAAGTTTTAGCTAGAGCAAA AAGACAATGGAAGGAGATCAAGGGAA TACAAAGTGGGAAAGAAGTCAGAGTA TCATTATGTCCAGGTGATATGATAGT ATACATAAATGACCCTATAGATTACA CCTAAGACCTCTACAGTGGATAAATA CTAAAATATTTACTACACAGAAATCA CCCCATG | 912 | R | — |
| IM000579 | CATGCAAGGTATGAACTCACTAATAA GGGGATA | 913 | D | — |
| IM000580 | CATGGTTCACACTCCATAATATCTTG TTCTCACTAATTCCTCTAATCCCATA ATATACACCAATAATTTAACAAGGGA ATTTCTACATTGATTTGTAATAAGGG AGATACTGTGTGAACTTACCCAACAA AAGTCTCCAATAGAAGTGTGGATACC ACAGGAAGTGTTGTGACAACCATTAA AATTTGGGTCTGATAAGAAGATAACC CTTTAAATATATAGATTTATGTAAAG | 914 | D | — |
| IM000581 | CATGGGCTGGGGAAAGGCAGAGAGAA GAACATCTGGATTGTTCGTAACTTTG GCTTTAAAATGAGACTTCAATAATAC TTAGACGTACCAGCTTCTCACAGTCA GTTAAAATGTGACACACACACCTCTC AGCAGACTGAATGGGTGAG | 915 | D | — |
| IM000582 | AGAGATGGTTGGGATTTAAGTTACCA GGGTAGGGTCACCACAATCAACCCT TGATGCCTTTATAGGAAGAAACATG | 916 | D | — |
| IM000583 | CATGGAAGTCTAAAAGACATTAGGTT CTGGATGGAAGAAGAGAAAATTATCT TTAAGTTTTAGAAAAGGGATGATAAA ACAAGTCTTAAATCTTCTCAATTTTG CCATAATTCATTTGAATTAATATTGG TAAATGCTTTGTGTGGTCCCATAAAG TTCAATGTGTTATATCACTAAGTAGT TATGTAAAATTATAAATAGCCTCTAT | 917 | C | — |
| IM000584 | CTTGTGAATTGTTTAACTGTTTTGAA AAAGTAGATGTTTTCTCTATTTATTT TTGGGACAATTATCAGAATTTGAAAC AAACTGTGTATCTCTTATTTACTTTC TGCTTAACCCCCATG | 918 | D | — |
| IM000585 | CATGGTTGCTATATTCATTAACACAA ATCATTTAAAATCCTTAATGTAAAAT GGGCACATTTTCAAAATTAAAATATA TGAAAACCAATAAAGATAGAAAATTT AGGAAAAAAAATAATCCAAGCAAGAT GTTAACATCCAACCACAGCAGCATAT TAGCAGCAGGACAAAAATAAGGACAA CAACCAAGAAAGGGATTGTGGTTAAT GTATGCCTCATTGGAAGGGATAATAG GATGTAAAGTGTGACAATAAAGAGA AAAAAATCTCTTTTTTAAATGTAAGT TAAAATAATAAAAATAATTTAAAAAT TGGTGTTCTCAGGGCTGGATAATATT ACTAACAAAACCAGGGAATTATTAAT AAAAAATCTCTTATCAGTTAT | 919 | D | — |
| IM000586 | AACAAGTTTTAAATGGGGCATAGTGG ATCACATTTGTGATCCCAGCACTTGG AAGGTAGAAATAGGTAAATTAAGAGT TCAAGGTCATTTCTCAGTTATGTAGT TGTACATTTCTAGCGATGTAGTTGAG TTCAAGGCCATG | 920 | D | — |
| IM000587 | GTCCTCCAATGTGCATTTCTCATTTT TCACGTTTTTCAGGGTTTCTCGCCAT ATTCCATG | 921 | R | — |
| IM000588 | AATTGCATTGAATCTGTGGATTTCTA TTAACAAGATGGCCATTTTTTTCCTA TGTTAATCGTACTGATCCATCAGGAT | 922 | R | — |

TABLE 2-continued

| SAGRES # | SEQUENCE | SEQ ID # | CLASS. | GENE |
|---|---|---|---|---|
| | GGCAGTCTTTCCATCTTCTGATATCG GCCTCAATTTCTTTCTTCAGGGGCTT GAAGTTATCGCCATG | | | |
| IM000589 | GGCTAGGTACTCCTAAACCTTCCTCT GCTATCCTAGGCCCAATAGAAAAAAA GTGGCCCATG | 923 | D | — |
| IM000590 | AATAATACTCACTGTACTTTAAAATA TTATCTCCTATCTCACTCTAATACTT CTGTGAAAGAAGCAATATCGTCTCTT TGTAGATAAAAATGGCTGAGAAGGGC ACCTTCAAGACACTAAGTGACTAACT CAGACTCAGAAGTTCAGAGACCATG | 924 | D | — |
| IM000591 | CATGCTCTACTATGTTCACAGCAGTC TTATTTATAACTTCCAGATACTGGAA GCAACTCAGATGTTCCTCAATGTAAG AATGGATACAGAAAAAATATGGTACA TTTACACAATGGGGTACAACTCAGCT ATTAAGAACAATGAC | 925 | R | — |
| IM000592 | AAAACCCAAGAACAATTAAGCTGTAG TTCCCAAGTGTAATTATATTATGGTT GTTTCTGCTTGCTTTATATCCCTATAT ACAATTTATGATTCAAGTATTAGTGG GAATAGACTAATGGCATG | 926 | C | — |
| IM000593 | CATGCCAAGCCTTCTGGTATCACCCT AAAGGC | 927 | C | — |
| IM000594 | CATGCTCTTCTCTGCTGTTCTTACTG AATTTTTAATAAGAACTATTCCACAC AGCTCGAAAGCACTGCTCAATTAAGA GATATTCCTACCAGGCATCTTTGGAA TCCTGCAAGCACCTCTTCTCTGTTTC CTGATGACCCTCAATTTGGTTGTGTC CAGAGGTTGGTGGGAGGAGGGGAGG GGAAACGAAGCTTATTTTTTTTTAAT TGCAAGTTCAATTTTACAATGTTCTC GAT | 928 | D | — |
| IM000595 | CATGCTAGGCAAATGCTCCACTGAAT GAATTACATTTCCAATCCTTTAGATG CATTTTAAAGAGAAAAGATTGAGTAC TGAAGTTTTGAATAGAATACAGGAAT AAGGGACTAAACATATATATAGCCTT ATATAGAGAAATATTAAGTAAGTAGT AACTTTGCTTGTGTGTGTGTGTGT TGCACAC | 929 | D | — |
| IM000596 | CATGCCATTAGTCTATTCCCACTAAT ACTTGAATCATAAATTGTATATAGGG ATATAAAGCTAAGCAGAAACAACCAT AATATAATTACACTTGGGAACTACAG CTTAATTGTTCTTGGGTTTT | 930 | C | — |
| IM000597 | CATGCACAGCTGGTGAGTGAGTTGTC TTCTGGTACAAAAATCTCCTCACAGG CACATTTACAAGTGCCTATATCTTTG CTAGCTTCAAGAACACAAAGAAGGGA CACACAAAAGCTCTTCTGAGTCTCCT TCTCCTGCTGTTATTTTG | 931 | D | — |
| IM000598 | ATCGTCAAAGTTAGCAAAATTATAAA TGTGAAAGTCATG | 932 | D | — |
| IM000599 | CATGAATTATGTTTGTTTTATTTCTTT TGTACATCATTCAATGCAGTAATCTA AAGTTTGGGGTCTTGGTCTTATATCT TGGAACTTCAGTGACTTATTGGTTCT AACG | 933 | D | — |
| IM000600 | AGAGACAGTCACAAAAGGGGCCCATT CTTGTTAAGAATGGGCCAGTGGAGAA GTTCGGGTTAGTGGAGTAGCCTGCCT CAGTTTCCTCCTGTCTTCTGTAGTTA AATGTGTTAATGGTTAACATG | 934 | K | Fgf3/Fgf4 |
| IM000601 | CATGTAGCATATCTTAGCCAGCAC | 935 | D | — |
| IM000602 | CATGTACAGACTATGAACAGGAAATG TTTTTGCAATTACTCTGTGCATTAGA ATTTTCTTCAGAAATATAACCATTTT GACAGTTGTAGGTTACACTTTTAAAA TTACAAAATCAATAAAATTGATCTAC AAACCGAGGCCTACAAAACCCTTGCT GGATATTGAAGACGGCATAATATTAAG | 936 | D | — |
| IM000603 | AATTCCCACCACCCACAGGGTGGCTC CATAACCATCTGTTTACTCCAGTCTG AGGGACTCCAAGGCCCTCTTTTGGCT | 937 | K | Fgf3/Fgf4 |

TABLE 2-continued

| SAGRES # | SEQUENCE | SEQ ID # | CLASS. | GENE |
|---|---|---|---|---|
| | TGCAAGGGCTTGCACACACACAGCGC ACACATG | | | |
| IM000604 | CATGGTGAATGATTGTTTTGATGTGT TCTTGGATTTGGTCGAGAATTTTATT GACTATTTTGGCATTAATACTCATAA GGGAAATTGGTCTGAAGTTCTTTCCT TGTTGAGTCTTTATGAGGGTATCAAT ATAATTGTGGATTCATAGAGCAAGTT AGATTGTGTTCCTTCTGTTTATATTT TGTGGAATATTTTGAAGAGTATTGGT ATTAGATGTTCCTTGAAGGTATGATA GAATTCTGAACTAAACCCATATGGTT CTGGATTTTTTTGGTTGGAAGACCT ATGACTGCTTCTATTTCTTTAGGTGT TATGGGACTGTATAGATGGTTTATCT GAACCAGATTAACTTTGGTATTTGT TATCTGTTTAGAAAATTGCCCATTTC ATCCATATTTCCCAGTTGTGTTGAGT ATAGGCTTTTGTAGTAGGATATAATG ATTTTTGAATTTCCTCAGTATGTTTT CTTATATCTCCCTTTCCATTTCTGAT TTTGTTAATGTGGATACTATCTCTGT GTCCTCTGTTTAGTCTGGCTAAGGGT TTTTCTATCTTGTTGATTTTCTG | 938 | R | — |
| IM000605 | CATGGGTTAACAGTGGGCCCTAAACT TGAACTAGAAAACTTAAAGATGCTCA TAGGGAAGAAGAAAAGAGCAGAAAGC TTAGCTTCTAGACAGGGGTAAGGCTT AGAGCTCAATAAAAAGGAACCCC | 939 | K | Wnt1 |
| IM000606 | CATGGCCTGTCTCAGTTTACTTCACA GCTGAACAAGAGGCAGAGAGTGACAG GTAG | 940 | K | Wnt1 |
| IM000607 | CATGCTCGCCAGTCCCAGAACCTGG AAGGCTGAGGCAGGAGGATTAAAAA GCCTTGGGGACACCAGGCTTGGTGG CACCGGTCGTAAATCCAGCACTGGG GAGTTAAGAAGCAAGTGAGTCACAT CTGTGAGTCTGAGGCTATCTTGGTCT ACGTAACCAGCTCTAGTATAGCCAG CCTGGGATACATAGTAACCAGTTCTA GTATAGCCAGCCTGGGATACACAGT AACCAGTTCTAGTATAGCCAGCCTG GGATACACC | 941 | D | — |
| IM000608 | CATATGCGTATTCACATTTGTGTGGG AACGTCCTTGGAGAAAGCAGGAGCAG GAGTTACAGACAGTTATAAGCTGCCT GACCTGGGTGCTGGGAAACACCTCAG GTCCTCTGGAAGAGCAGTAAGTCCCC TTAACCAATGAACCATCTATCCGTCC AGCCTACATTTAATTTGTTTTCTTAT TTACTTTGTCTGCATG | 942 | R | — |
| IM000609 | CACACACACACACACACGGCTGGGGA TCCAACCCATCTCGTCCTTACACGTG CTCTACCATCACGCCACACATTTCCA GCACNTTTATCTGAAGTGTTTCCTTT TATTTGTGCATG | 943 | K | Wnt1 |
| IM000610 | CATGCCTGGTGCCTGCAGAGGTCAGA AAGTGTTGGATGCCCTGGAATTAGAG TAACACATAGTTATAAGATGCTGCGT GGGTGCTGGGATTTGAACCCTTGTCC TCTGCAAGAGCAGCCAGTGCTCTTTA CCACCGAGCCATCCCTCCAGCCCCTG ATTACTCACTCTTCACGGCCTCAATC TTGTAAGGAATATTGAGGCTGCCAAG TGACGCAAGAGCACCTAGGAAGGCAG CCACATCGGTGGCACTCTGGTAGCAC TGCGAGGATGACTGCACACATTGCCG GTTGTC | 944 | K | Notch1 |
| IM000611 | CATGCTGGCCATTTATTTTGATTTAA GTTATACTCTAGACCTTTGTAAATAT TAGCCATTGCATATTACAGAAATTTC TTAGCAGAGATAGTCTCTCACTCTTA GTGATGAGCAAGCTGGAGCTCAGCAT TATTCTCCCAGCTAAGATACAGAATT ACAGACGTTTATGACGGACACATCTT GGATGTAGTTACTTAGTCCAC | 945 | D | — |

TABLE 2-continued

| SAGRES # | SEQUENCE | SEQ ID # | CLASS. | GENE |
|---|---|---|---|---|
| IM000612 | CCCCCCCCGCCCCTGCCAGACCGCAG CCCCAAGCACAGCATG | 946 | D | — |
| IM000613 | CATGCCTCCCTCAGCCTCCTCCACCC CTTCCTGTCCTGCCTCCTCATCACTG TGTAAATAATTTGCACCGAAATGTGG CCGCAGAGCCACGCGTTCGGTTATGT AAATAAAACTATTTATTGTGCTGGGT TCCAGCCTGGGTTGCAGAGACCACCCT | 947 | K | Fgf3/Fg f4 |
| IM000614 | CATGAATTCAATGGTGTGCTTGCTAT AAATGCAAATAAACCATATATATCAT ATTACACTCAATTTTAAATATTTTTC CTAATATTAATAAAGGTGATGGGGAA CTT | 948 | D | — |
| IM000615 | CATGTCTACTTTATTGCATATTAGGA TGTCAGGTCCTGCTCGTTTCCTGGG ACCATTTGCCTGGAAGACATTTTTCC ATTCTT1TACTCTGAGATAGTTCCTG TCTTTGTTGTTGAGGTGTGTTTCnG TATTCAGCAAAATGCTGGATCTTGTT TGCGAATCCAGTCTGTTAGCTTATGT CTTTTTACAGGTGAATTGAGTCCATT AATATTGAGAGATATTAAAGAGAAAT GACTTTTGGTTCCTGATATATTTGTTT TTTCTAGTTAGTTTTGTGTGCTTGGGA CTCTCTCCCTTTGACTGTGTTGTGAG ATGCTAATATCTTGTCCTATCTTTG GTGCAGGTGTCTTCCTTGTGTTAGA GTTTTCATTCCAGGTTTCTCTGTAGT GTTATGTTAGAAGACATATACTGCTT GAATTTAGTTTTGCCTGGAATATTTT GTTTTCTCCATCTATGTTGATTGAGA GTTTTTCTGGGTAAAATAGCCTANCC TGGCATTTGTGTTCTCTTAAAAGTCT GTATGACCTCTGACTANGCTTTTCTG GCC | 949 | D | — |
| IM000616 | CATGGTGAATGATTGTTTTGATGTGT TCTTGGATTTTGGTTTCGAGAATTTTA TTGACTATTTTGGCATTAATACTCATA AGGGAAATTGGTCTGAAGTTCTTTCC TTGTTGAGTCTTTATGAGGGTATCAA TATAATTGTGGATTCATAGAGCAAGT TGGATTGTGTTCCTTCTGTTTATATTT TGTGGAATATTTTGAAGAGTATTGGT ATTAGATTTTCTTTGAAGGTATGATA GAATTCTGAACTAAACCCATATGGTT CTGGATTTTTTTGGTTGGAAGACCA ATGACTGCTTCTATTTCTTTAGGTGT TATGGGACTGTATAGATGGTTTATCT GAACCAGATTAACTTTGGTATTTGT TATCTGTTTAGAAAATTGCCCATTTC ATCCATATTTCCCAGTTGTGTTGAGT ATAGGCTTTTGTAGTAGGATATAATG ATTTTTTGAATTTCCTCAGTATGTTTT CTTATATCTCCCTTTCCATTTCTGATT TTGTTAATGTGGATACTATCTCCGTG TCCCC | 950 | R | — |
| IM000617 | CCATGTCAGGTGGTTAACCTGTGAGT CTAACTTCCAGGAATGCAATGCCTCT GGCATCTACAGGCATAAACATACTTG TGGCTTACACTCAAACTGACACACCA ACACATATGTGCACGCGCACACACAC ACACACCAAATTAAAAATAAAATAAC CCTTTTTAAAAAAATATAGAATCTAT AGATAATTGCTTTACTGCACTCACAA ACATTTTAGGATC | 951 | D | — |
| IM000618 | ACACTAACACAAAGAAGGGGATC | 952 | D | — |

| 221 | 222 |
|---|---|
| Lengthy table referenced here<br>US07820447-20101026-T00001<br>Please refer to the end of the specification for access instructions. | Lengthy table referenced here<br>US07820447-20101026-T00009<br>Please refer to the end of the specification for access instructions. |
| Lengthy table referenced here<br>US07820447-20101026-T00002<br>Please refer to the end of the specification for access instructions. | Lengthy table referenced here<br>US07820447-20101026-T00010<br>Please refer to the end of the specification for access instructions. |
| Lengthy table referenced here<br>US07820447-20101026-T00003<br>Please refer to the end of the specification for access instructions. | Lengthy table referenced here<br>US07820447-20101026-T00011<br>Please refer to the end of the specification for access instructions. |
| Lengthy table referenced here<br>US07820447-20101026-T00004<br>Please refer to the end of the specification for access instructions. | Lengthy table referenced here<br>US07820447-20101026-T00012<br>Please refer to the end of the specification for access instructions. |
| Lengthy table referenced here<br>US07820447-20101026-T00005<br>Please refer to the end of the specification for access instructions. | Lengthy table referenced here<br>US07820447-20101026-T00013<br>Please refer to the end of the specification for access instructions. |
| Lengthy table referenced here<br>US07820447-20101026-T00006<br>Please refer to the end of the specification for access instructions. | Lengthy table referenced here<br>US07820447-20101026-T00014<br>Please refer to the end of the specification for access instructions. |
| Lengthy table referenced here<br>US07820447-20101026-T00007<br>Please refer to the end of the specification for access instructions. | Lengthy table referenced here<br>US07820447-20101026-T00015<br>Please refer to the end of the specification for access instructions. |
| Lengthy table referenced here<br>US07820447-20101026-T00008<br>Please refer to the end of the specification for access instructions. | Lengthy table referenced here<br>US07820447-20101026-T00016<br>Please refer to the end of the specification for access instructions. |

Lengthy table referenced here
US07820447-20101026-T00017
Please refer to the end of the specification for access instructions.

Lengthy table referenced here
US07820447-20101026-T00018
Please refer to the end of the specification for access instructions.

Lengthy table referenced here
US07820447-20101026-T00019
Please refer to the end of the specification for access instructions.

Lengthy table referenced here
US07820447-20101026-T00020
Please refer to the end of the specification for access instructions.

Lengthy table referenced here
US07820447-20101026-T00021
Please refer to the end of the specification for access instructions.

Lengthy table referenced here
US07820447-20101026-T00022
Please refer to the end of the specification for access instructions.

Lengthy table referenced here
US07820447-20101026-T00023
Please refer to the end of the specification for access instructions.

Lengthy table referenced here
US07820447-20101026-T00024
Please refer to the end of the specification for access instructions.

Lengthy table referenced here
US07820447-20101026-T00025
Please refer to the end of the specification for access instructions.

Lengthy table referenced here
US07820447-20101026-T00026
Please refer to the end of the specification for access instructions.

Lengthy table referenced here
US07820447-20101026-T00027
Please refer to the end of the specification for access instructions.

Lengthy table referenced here
US07820447-20101026-T00028
Please refer to the end of the specification for access instructions.

Lengthy table referenced here
US07820447-20101026-T00029
Please refer to the end of the specification for access instructions.

Lengthy table referenced here
US07820447-20101026-T00030
Please refer to the end of the specification for access instructions.

Lengthy table referenced here
US07820447-20101026-T00031
Please refer to the end of the specification for access instructions.

Lengthy table referenced here
US07820447-20101026-T00032
Please refer to the end of the specification for access instructions.

| Lengthy table referenced here |
| US07820447-20101026-T00033 |
| Please refer to the end of the specification for access instructions. |

| Lengthy table referenced here |
| US07820447-20101026-T00034 |
| Please refer to the end of the specification for access instructions. |

| Lengthy table referenced here |
| US07820447-20101026-T00035 |
| Please refer to the end of the specification for access instructions. |

| Lengthy table referenced here |
| US07820447-20101026-T00036 |
| Please refer to the end of the specification for access instructions. |

| Lengthy table referenced here |
| US07820447-20101026-T00037 |
| Please refer to the end of the specification for access instructions. |

| Lengthy table referenced here |
| US07820447-20101026-T00038 |
| Please refer to the end of the specification for access instructions. |

| Lengthy table referenced here |
| US07820447-20101026-T00039 |
| Please refer to the end of the specification for access instructions. |

| Lengthy table referenced here |
| US07820447-20101026-T00040 |
| Please refer to the end of the specification for access instructions. |

| Lengthy table referenced here |
| US07820447-20101026-T00041 |
| Please refer to the end of the specification for access instructions. |

| Lengthy table referenced here |
| US07820447-20101026-T00042 |
| Please refer to the end of the specification for access instructions. |

| Lengthy table referenced here |
| US07820447-20101026-T00043 |
| Please refer to the end of the specification for access instructions. |

| Lengthy table referenced here |
| US07820447-20101026-T00044 |
| Please refer to the end of the specification for access instructions. |

| Lengthy table referenced here |
| US07820447-20101026-T00045 |
| Please refer to the end of the specification for access instructions. |

| Lengthy table referenced here |
| US07820447-20101026-T00046 |
| Please refer to the end of the specification for access instructions. |

| Lengthy table referenced here |
| US07820447-20101026-T00047 |
| Please refer to the end of the specification for access instructions. |

| Lengthy table referenced here |
| US07820447-20101026-T00048 |
| Please refer to the end of the specification for access instructions. |

Lengthy table referenced here
US07820447-20101026-T00049
Please refer to the end of the specification for access instructions.

Lengthy table referenced here
US07820447-20101026-T00050
Please refer to the end of the specification for access instructions.

Lengthy table referenced here
US07820447-20101026-T00051
Please refer to the end of the specification for access instructions.

Lengthy table referenced here
US07820447-20101026-T00052
Please refer to the end of the specification for access instructions.

Lengthy table referenced here
US07820447-20101026-T00053
Please refer to the end of the specification for access instructions.

Lengthy table referenced here
US07820447-20101026-T00054
Please refer to the end of the specification for access instructions.

Lengthy table referenced here
US07820447-20101026-T00055
Please refer to the end of the specification for access instructions.

Lengthy table referenced here
US07820447-20101026-T00056
Please refer to the end of the specification for access instructions.

Lengthy table referenced here
US07820447-20101026-T00057
Please refer to the end of the specification for access instructions.

Lengthy table referenced here
US07820447-20101026-T00058
Please refer to the end of the specification for access instructions.

Lengthy table referenced here
US07820447-20101026-T00059
Please refer to the end of the specification for access instructions.

Lengthy table referenced here
US07820447-20101026-T00060
Please refer to the end of the specification for access instructions.

Lengthy table referenced here
US07820447-20101026-T00061
Please refer to the end of the specification for access instructions.

Lengthy table referenced here
US07820447-20101026-T00062
Please refer to the end of the specification for access instructions.

Lengthy table referenced here
US07820447-20101026-T00063
Please refer to the end of the specification for access instructions.

Lengthy table referenced here
US07820447-20101026-T00064
Please refer to the end of the specification for access instructions.

Lengthy table referenced here
US07820447-20101026-T00065
Please refer to the end of the specification for access instructions.

Lengthy table referenced here
US07820447-20101026-T00066
Please refer to the end of the specification for access instructions.

Lengthy table referenced here
US07820447-20101026-T00067
Please refer to the end of the specification for access instructions.

Lengthy table referenced here
US07820447-20101026-T00068
Please refer to the end of the specification for access instructions.

Lengthy table referenced here
US07820447-20101026-T00069
Please refer to the end of the specification for access instructions.

Lengthy table referenced here
US07820447-20101026-T00070
Please refer to the end of the specification for access instructions.

Lengthy table referenced here
US07820447-20101026-T00071
Please refer to the end of the specification for access instructions.

Lengthy table referenced here
US07820447-20101026-T00072
Please refer to the end of the specification for access instructions.

Lengthy table referenced here
US07820447-20101026-T00073
Please refer to the end of the specification for access instructions.

Lengthy table referenced here
US07820447-20101026-T00074
Please refer to the end of the specification for access instructions.

Lengthy table referenced here
US07820447-20101026-T00075
Please refer to the end of the specification for access instructions.

Lengthy table referenced here
US07820447-20101026-T00076
Please refer to the end of the specification for access instructions.

Lengthy table referenced here
US07820447-20101026-T00077
Please refer to the end of the specification for access instructions.

Lengthy table referenced here
US07820447-20101026-T00078
Please refer to the end of the specification for access instructions.

Lengthy table referenced here
US07820447-20101026-T00079
Please refer to the end of the specification for access instructions.

Lengthy table referenced here
US07820447-20101026-T00080
Please refer to the end of the specification for access instructions.

Lengthy table referenced here
US07820447-20101026-T00081
Please refer to the end of the specification for access instructions.

Lengthy table referenced here
US07820447-20101026-T00082
Please refer to the end of the specification for access instructions.

Lengthy table referenced here
US07820447-20101026-T00083
Please refer to the end of the specification for access instructions.

Lengthy table referenced here
US07820447-20101026-T00084
Please refer to the end of the specification for access instructions.

Lengthy table referenced here
US07820447-20101026-T00085
Please refer to the end of the specification for access instructions.

Lengthy table referenced here
US07820447-20101026-T00086
Please refer to the end of the specification for access instructions.

Lengthy table referenced here
US07820447-20101026-T00087
Please refer to the end of the specification for access instructions.

Lengthy table referenced here
US07820447-20101026-T00088
Please refer to the end of the specification for access instructions.

Lengthy table referenced here
US07820447-20101026-T00089
Please refer to the end of the specification for access instructions.

Lengthy table referenced here
US07820447-20101026-T00090
Please refer to the end of the specification for access instructions.

Lengthy table referenced here
US07820447-20101026-T00091
Please refer to the end of the specification for access instructions.

Lengthy table referenced here
US07820447-20101026-T00092
Please refer to the end of the specification for access instructions.

Lengthy table referenced here
US07820447-20101026-T00093
Please refer to the end of the specification for access instructions.

Lengthy table referenced here
US07820447-20101026-T00094
Please refer to the end of the specification for access instructions.

Lengthy table referenced here
US07820447-20101026-T00095
Please refer to the end of the specification for access instructions.

Lengthy table referenced here
US07820447-20101026-T00096
Please refer to the end of the specification for access instructions.

Lengthy table referenced here
US07820447-20101026-T00097
Please refer to the end of the specification for access instructions.

Lengthy table referenced here
US07820447-20101026-T00098
Please refer to the end of the specification for access instructions.

Lengthy table referenced here
US07820447-20101026-T00099
Please refer to the end of the specification for access instructions.

Lengthy table referenced here
US07820447-20101026-T00100
Please refer to the end of the specification for access instructions.

Lengthy table referenced here
US07820447-20101026-T00101
Please refer to the end of the specification for access instructions.

Lengthy table referenced here
US07820447-20101026-T00102
Please refer to the end of the specification for access instructions.

Lengthy table referenced here
US07820447-20101026-T00103
Please refer to the end of the specification for access instructions.

Lengthy table referenced here
US07820447-20101026-T00104
Please refer to the end of the specification for access instructions.

Lengthy table referenced here
US07820447-20101026-T00105
Please refer to the end of the specification for access instructions.

Lengthy table referenced here
US07820447-20101026-T00106
Please refer to the end of the specification for access instructions.

Lengthy table referenced here
US07820447-20101026-T00107
Please refer to the end of the specification for access instructions.

Lengthy table referenced here
US07820447-20101026-T00108
Please refer to the end of the specification for access instructions.

Lengthy table referenced here
US07820447-20101026-T00109
Please refer to the end of the specification for access instructions.

Lengthy table referenced here
US07820447-20101026-T00110
Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07820447B2). An electronic copy of the table will also be available from the USPTO upon request and payment of the fee set forth in 37 CFR 1.19(b)(3).

SEQUENCE LISTING (1613 sequences)

SEQ ID NO: 1 - DNA, 282 bp, Mus musculus
gatcaaagcaatctctatgtctttctctgctgtcctcctcagacatctccagagagctgggatatttttctttcccatttgagattatgaagttgtttctagagtgcatgacgcaggttgaaggataagtacacaggtcccaaggaaccaagcgttttcactgacggtgatgagtcttgttcgtgagattgttgtgattctcagcctttctcttcccctgtgtgtgctcttcattttctggttctgtctgcctagcacctcctggggaagctgctgtgcttt

SEQ ID NO: 2 - DNA, 90 bp, Mus musculus
gatctttggagcccagttgttaatcataagagctgatattttgaaagagtgtgtcaacctagatgcacagggaagccaaagcattcagcc

SEQ ID NO: 3 - DNA, 59 bp, Mus musculus
atatgaccacaaggaaataagataaagtgttcatactgaatttataatgaaaagtgatc

SEQ ID NO: 4 - DNA, 197 bp, Mus musculus
gaacaggcatggctttacttgtacaatgaggaaaccaaggcagagattgcaaagcgggtcctacacgtttgctccatgccctgcttctctgaccacagtgtactgagaatatgctgagccctagttcctggggaggaggcagaagagagcagcatcctgcccacttgaaggcgtgcacacatagttcctgtctgatc

SEQ ID NO: 5 - DNA, 190 bp, Mus musculus
gatcaggagaccacacccagctagccttctctgactgggtatccttggtcagccagcctttcttcacctcatgttctcatttgcaaactcacatgaacactatttgacctacacacttcataaagctgtttttagaaagacgagataatacaggaggaacgctacaatattaaatgatatgtatttatat

SEQ ID NO: 6 - DNA, 113 bp, Mus musculus
agtgtttaggtcagctggtgcaggagaagcttcttgaggaagacgaccatctggcaaggcctgatggtagaaaataatggacttctctccaactgagtaggaacttgatgatc

SEQ ID NO: 7 - DNA, 284 bp, Mus musculus
atcagtaagttaatcctaagaattactatgcatttttcccctcttttttaacaacattcctccttagcttatatgaggctctagtgcccggagactttaatactgccctaacatgatggtggctctttgtccctctttctcagccactgaaatctgacagtttggggaagaataataagaatttaagaaactagatggttttaaatatagatataaaaacagttcttcgactattctcaataaagaaattcagtcaaaagaatttcagtcctaacacaatgatc

SEQ ID NO: 8 - DNA, 313 bp, Mus musculus
gatcatcagagtcctgcatcttatgtgtgcagtgttttcagcaatacaggcttaccttcaacctctaacaggcaaccagatgctacaatagcttatattgttttagaaatcacttggactactctaaacaacaacttgagtgaaggctctttgtatctgatactggagtttgttagtctatgacacttgtggggagacatgtctgcacaagtagcatatgtgtgtacatgtatattgtatacatatatagttttgctctatgtatgtatgtgtatatgtatgtatgtatatgtatatgtatgtatatatatag

SEQ ID NO: 9 - DNA, 219 bp, Mus musculus
aagggacctgataatcgtgttggcaactgggctacaattagttatcaattgcttgcttgccacctgccctgctccatagagaatcatagtctggggagtgtggaggaatagcggagtcatctaaacacatcactgctgcccccaccatttgcctgccaccaggcccctgcctttcattttgcatttctccctcttacaagcaaatggcgctcactgatc

SEQ ID NO: 10 - DNA, 135 bp, Mus musculus
gtttggggattgtacagaatgcacagcgtagtattcaggaaaaaggaaactgggaaattaatgtataaattaaaatcagcttttaattagcttaacacacacatacgaaggcaaaaatgtaacgttactttgatc

SEQ ID NO: 11 - DNA, 35 bp, Mus musculus
gatctcattacagatggttgtgagctaccatgtgg

SEQ ID NO: 12 - DNA, 171 bp, Mus musculus
gatctcaggaggcaccgagagactcagcatggactcaaatgagtaccctggcagcccgcaacaccagctgtgtaacactaccgtgagggatgtcttccctgcctccctccagccccttctcaggccctgagtccagtgtgcaaagctcatcatggttagtccccttcacct

SEQ ID NO: 13 - DNA, 83 bp, Mus musculus
agagcacccgactgctcttccgaaggtccagagttcaaatcccagcaaccacatggtggctcacaaccatccgtaacaagatc

SEQ ID NO: 14 - DNA, 271 bp, Mus musculus
gatcaaatcctgtcagggagaggggctcctcccagtagtgccatcccataataataagaaggactcctgggcctcagtgaagtcaggctgaccactactgcaggttagtcatgaccagtagccagaatggaacgaagggtgacccagtgtgaggacacagccccaggcaactgcttctgctttgagccaagttgttaccccaaagctcgtcattccgcttggtttctcatgtgtgtgagctgcacatatggaggtccccctttgttccctt

SEQ ID NO: 15 - DNA, 270 bp, Mus musculus
gtgaggaaggtccctctgcattctaaccttcctcaactccaccagcctcggcgtttaagggagaaatattaccgttccctttgggccaagttggagccagtgaagtagtcggaaatgtacagtcacaggaaattgctgctaccaaggctggaggaacaaagagaagacttgtcacaagaggccagagaggaagtcacccagtacaaactgaagcgcgcgcgcacacacacacacacacacacacacacgcacacacacacacacacgatc

SEQ ID NO: 16 - DNA, 136 bp, Mus musculus
tggccgcctagacaagctgaccatcacctcccagaacctgcaactggagagccttcgcatgaagcttccgaaatgtgcgtgctccacctgtccctcacctcacagacatcatttctccatttagcccctcccgatc

SEQ ID NO: 17 - DNA, 43 bp, Mus musculus
gatcccctggaatttacagtcggttccaacaatcatgtagatg

SEQ ID NO: 18 - DNA, 380 bp, Mus musculus
gatcggctatagcatttgtcaatgtttacccagaagaatagcacagatatatttgcacatcaatgcttattgcagtattattcacagtggctatgtaatggaaccaacctacatggccagcaactgaatagattaagaaaatatatatacacaatggtgcttttttcggctataaagaagaatgaagttatgttgtttgttagaagatggatgaaagtggagatgataatatcaagtgcacagtcaacctctctctctcacctcccccgccccgctctttctctctcatatacatttgagagtagcagtaaactgtctgagaacaaaggggattaatgggaggggagaagattaaggagcggaagggtagtaggtagtat

SEQ ID NO: 19 - DNA, 37 bp, Mus musculus
gatcggcttctatggactgagtgtgtaagaaaacatt

SEQ ID NO: 20 - DNA, 312 bp, Mus musculus
ttaggagggtagagaacattcaggaatcaagaacaagcattttaacacccactgagctatcctgtggatggtggtggttttgtttgtttgttggttttgttttaggaagtcagggatggggtgggaatctcactctgtggcttagacttgcaacaatcccaaattctggaatgataagcaagagagctgtctagtcccagtctcagatacatgctgttaattttctactactgctataacacataggctcaaatgcggtggcttacctaacacaccctgtgcagttctgaaagtcgtaactctggcacgatc

SEQ ID NO: 21 - DNA, 56 bp, Mus musculus
atgctaagctgtgactcctctcgatacgagaccctggctgccctcctttcccgatc

SEQ ID NO: 22 - DNA, 251 bp, Mus musculus
gatcgtctggaagagcagtcagtattcttaactgctgagccatctttgcagcccccagttctttggggttttttgtttgtttgtttggttggttggttggtttggtttagtttggtttggttcaagacagggtttctctgtgttgccctggatgtcctggaactctctttgtagaccagggtggcctttaactcacagaaatgcgcctgctaggattaaagctgtgtcccaccactatatatatatgtgtg

SEQ ID NO: 23 - DNA, 98 bp, Mus musculus
gtcacagtgttagagccacagacgggggaacctactggctgtcctgggttcctgtaaactaggggacaaagctgccacagccagacttagctgcgatc

SEQ ID NO: 24 - DNA, 149 bp, Mus musculus
gatcgctgcttctgtaaatccgcaacgacaattgttatcttctccttttctttcttttatttgttttattctattttatttttcagatgaactctcatgtagcccaggctggtctcaaactccctctgtagctgacggcaaccttgaac

SEQ ID NO: 25 - DNA, 39 bp, Mus musculus
ttcctacaccatagcatttagttgtaggcagaagcgatc

SEQ ID NO: 26 - DNA, 296 bp, Mus musculus
gatcggctcaagggctctaatttagtctaggaagtccttaggaaacatgaaaatctccgagataagacccggggtaaaaagcttgagccacggagttagacatgcccagggtggagtcatgttcagaggttcaagacccgaatcagctacgtaaataaagcatttgaggcctacctgggctacaagagagtatctttaaataaataagatgatttaaaaaaaactgttttccccttagatggattaaaaaaacaagacaaaacaaaacaaaacaaaaacccgtctttccttcttaa

SEQ ID NO: 27 - DNA, 44 bp, Mus musculus
ctgtccgtgtgggaaacgtttagcaagtccgagcgtgttcgatc

SEQ ID NO: 28 - DNA, 211 bp, Mus musculus
atgcgttcgtatgacagttctccaaatgactgtcccaaagtcccagattcctggaaacagtaaagactgcctcaaactgtagtcactagtctattatcttaatcatagtaaccatttgggtttgacttgaaaacctgtgacagggagataaatttctgccactgtaggtgaagcttggaagggctaacccaatgaatatgctcagtcgatc

SEQ ID NO: 29 - DNA, 313 bp, Mus musculus
agatgaagctatccccagtccctaagctgagttctgcctgagactatttgaaacagggtacccctgggtcccagttcagttgacaggtagtggacgcatgagaacgccatacctggtggccgtgcccgagagtgctgtccctgacctgccactgtgttctccagagcagctttccaatctgcctgctcctgtctcccctgcctgttggcaccaggcagccagaattccatttgtttgtttgcttcgcgataggctcttgccatgtagtccttcctggcctagaacttgatatgtagacttccccccttggatc

SEQ ID NO: 30 - DNA, 153 bp, Mus musculus
ccgtgtccgtgggcatgtgcgtgtacagacagacatacatgcccccgcatgagtgtgaacaccagaggtcaacctcaggtgtccttttgatgttatctaccttgttttttgaagcaaggtctaggattgaccaatgagccccaagtagggatc

SEQ ID NO: 31 - DNA, 106 bp, Mus musculus
gatccataggcagagaaggcagtaataggacattggtcattgtacctcatttgtgaggggtcaccttggaaatgtgctgagactaggttctaggagaagctcgcca

SEQ ID NO: 32 - DNA, 299 bp, Mus musculus
ctggcactgtgtggcagaaacagtgaacagtgtagcggtgcagaatgtgtgtgctgtgggttttagcaccagggctgcatgagactgcagacatgcttatgacgcaggaaggctcaggacacagcacacatgtgtgctaacatacatgtttcacctcagactcagctcccatttgacttttaattaatttttggccattccacaacagaaccttttcttgctcccttttttcaatcttatgtatatatctcctacatttagttacaggactgtgacctacagtttaaaactcggggatc

SEQ ID NO: 33 - DNA, 149 bp, Mus musculus
gatccctcccctcccttctttttcccgccaagcgtcggcgaagccctgcccttcaggaggcaggaggggagctgagtgaggcgagtcggacccagcagctgagagcagcgcagcccaggggtcctcggccgcgcagacccccggaataa

SEQ ID NO: 34 - DNA, 189 bp, Mus musculus
ctaccacagccccagtgctctggagggactctagtagccagggctggcagcttggtttgggccagcatctcactatgtagcctagttgtcctggaatttgctatgtaaatgtggctaccctcaaactcatagagagcctcccacctctcctgagattataggcacatgctaccatgccctaagtggatc

SEQ ID NO: 35 - DNA, 395 bp, Mus musculus
ggagcaggcccttctgaatcaacttggcagagtgaaggaggcactctccacacaaacaggaaaagggcagtggtgactttctaggcagggaactggttacattttgtttatttgaaggtgaagagtcgtgacattctgggaaataggcaagatggccgtttcccctcagctacaaccagccatgcagacctccttgcagggacctggctatctacactggaaccagaaaggcacgccctgctttagcctcaggcagaacgataataacagcgtgctagctcagtagtctgtgtgctggaagggtttatgaggaggaagtccgcaattacatatttctgggcaaacattaaccaagattgaaacctagatttgaagagaagtagcaggctgggatc

SEQ ID NO: 36 - DNA, 314 bp, Mus musculus
agatgaacttataaatgcatctgcagtcctcaaataaagatgaatagtaacccagaggcgtggtagtgcgctcttcaaacccagtgctcagaaggtgcaaacaaaaggaccgggagtccaaggctagccttgactagaaggggccatgtctcaaagaacaacaaccaagagctgcttatggaggtcagtctgtgttcccagggggacagcatcagtctaagttggcggttgttgttggctgagcatgcacaaatccctaacagcacataaagcaagttgtgtcacacactcacagtgcccagattcactggatc

SEQ ID NO: 37 - DNA, 101 bp, Mus musculus
gtccattgtgtactgagagaggagttaggtttagaaagccttcctcagatgtccctcaaagaagctgctacaactgccctcatcccacgttgccaaggatc

SEQ ID NO: 38 - DNA, 279 bp, Mus musculus
agctgtagggaagcccaaagcacagacgactgctgctgctgctgcggttcccactctgggttgaccttagaaacgggggttcatctcctccagcagctccgggaaggaaggtgaaggggactaaccatgatgagctttgcacactggactcagggcctgagaaggggctggagggaggcagggaagacatccctcacggtagtgttacacagctggcgttgcgggctgccagggtactcatttgagtccatgctgagtctctcggtgcctcctgagatc

SEQ ID NO: 39 - DNA, 356 bp, Mus musculus
gatcgccccagttacctcaaattgtgtgagtgtgtgtgtgtgtgtgtatgcatatatgcatacaagcatatacatgcatgcatatatataatacacatagacatatatacacacatatagacgcatacatgcatttgtatgcatgcatctatgtatgtacatatccacaaccaaatataccaaacacgcagacacagcacacataggacaatagtaattgtgaatctaactggtggggtttatgggtcaagagccagggtagaggaaactggctaaggctctaaccatcctagagcaggcacatctaccaggaaaagaaacaaggaaaagagcagagttgagggttacttaacatg

SEQ ID NO: 40 - DNA, 137 bp, Mus musculus
acagaatctgtgggtcattattacgtttataggaacaggattttctttcctttctgactctaccttctagaaaggccgacttttaaatcctcatgctcttgtctattgacaggaaaagatgggcttccacactgatc

SEQ ID NO: 41 - DNA, 501 bp, Mus musculus
gatcaggctggccttgaactcacagagacccacctgcctctgcctcctgcatgctgggattaaaggtgtgtgccaccactgcccagctcacaaagtagtagtaggactagtactagtactaataataacaaacattacaacaatcttaattatttttgtttctacctttaaaatctcccaactgtctttttatattgcctcaagtcttccctcagtccctggccttcatagcttgacttttttgctagaggttatcagtggctcatctctctcctgagattgagctggctaagaccactattcagagggagaatgtaatgtctcagacatcatagccagtcctcagttctccttttgctgactgaccactttgccaaactagttttcctaagccataccttttctttttaaaaaatagtctttcttatagtgggtgctggctttgaacttctgtcctcttgcctcaccttgcactggtagtagaggcttgcaatttcaccg

SEQ ID NO: 42 - DNA, 390 bp, Mus musculus
gatcaagaacgaaacccctgaaaacataaaacagtaagataacaatagcgtgcctgattttgtccaaaccttcttgtcacctgtcactgagattgtcaactccttttcaccaccctacatacgttagttagctcagtttacgagagtttgcaaaggcccccaccagtaccctgcaactttacccacccctgcatgggactgtgagaaaatgggactggagagtaaccctcttcaggctcacaatctgagctagtcagagcatctcacgggtcccgggactttcagtgtgctttcctcttgggtattggactttaaacaatgtgtaccgatatgggtgaataatacaacatccatggagaaataagccaaatcaagacacttcttcagagg

SEQ ID NO: 43 - DNA, 282 bp, Mus musculus
gatcaaaaacatcaacgtaaggagcccttaatgacgctttgtgacggtttagaatggtctacccaaacctagccaagtctaactatgttatggaggtggtaaaagcagttaacctaaacatctgggacactcacagaatgataggtaggtaggtagatagatagatagatagatagatagatagatagacagacagacagacagatgttgaataaaaagtgacgtttacagtgatgttagctcaaggcagggcttttcaggccatttcccctggtctcaccc

SEQ ID NO: 44 - DNA, 108 bp, Mus musculus
ctactaagtccagagcagagaaggaggcgccgcctgtgtgcacagcggagtctgggagagaccaccggcccaaaccagtaaacacagggcacccaccgtgctccgatc

SEQ ID NO: 45 - DNA, 400 bp, Mus musculus
acagtaatctgattatcttgcagtagataatttgtctacctgttaatgactctgcttcttgaactacgtcccagtagatgccatgctttcagcctggtaagtgacactaatactacctccaaactgtcacttggattgtcagggttttggtgtggtgatgatacaggagaaatgtaaaacacggagttgatgatagaaaggagtcactaatacattttcttaggaaaagtcaagtgacacacagcagaatctagctgaaggagctccgccaatagggctggaagataactctcgcactaacctgctttattaggaactgtaggaaaggcaggtctgcagcacagttgaagtttaggttgctgagaaagtttctgctcatatttattcaccagtgatgatc

SEQ ID NO: 46 - DNA, 27 bp, Mus musculus
gtttagcaagtccgagcgtgttcgatc

SEQ ID NO: 47 - DNA, 240 bp, Mus musculus
aggcaaacccatgtgaggccttctcacatctttccttggatgcctgcacacacctgacttgacagacttcaaatcagacttatcaactcacctcttcagtcctgggcctcttcctgtatttcaatcttagatagaaaattggttccactgtctaccagccttgaaccaggaatgcagagccaaccacccctggggtgtcccaggcagctgggctggatgctacctgtcatgctcttgatc

SEQ ID NO: 48 - DNA, 484 bp, Mus musculus
atgtatgagtgtggggctgggtttgaacctgtgtcaccttaggactctctgaacctcggtttcctattagacggaggggctattcggagtcctcatctaatggagacactttgtgggtatcagagggcaacactgtggtattgggggtggggggttgctgcttagagctcagagaagaggagtttggcttgctctacagaacatgcaggctgaggtgtgggtgcagggtttccctgaggccccggctctgaccctctccccactccatttcctgcgcaggtgagcgacaaacgttccaacagcttccgccaggccatccttcagggaaaccgcaggctgagcagcaaggccctgctggaggagaaggggctgagcctctctcagcggctcatccgccacgtggcctacgagactctgccccgggagattgaccgcaagtggtactatgacagctacacctgctgcctccgcccggttcatgatc

SEQ ID NO: 49 - DNA, 246 bp, Mus musculus
gatcatttttctctcgagatggattaaagctatgctgcagaaggacccgtgtgtgtcctgtgtgtgtgtgtcctcgccggcgagactccttatcacacatgacagcttcaaagcccccagattcaataggttccaggagttcacatttaacactcatggggtcaaagtgcaggcagatggtggagcctgtggaaggtcatcagacaaacaacctggtggttgcagcagaaatcaccaggcaagtag

SEQ ID NO: 50 - DNA, 49 bp, Mus musculus
gatctggctagcagggagccatttacagctcagacatctatcatcctta

SEQ ID NO: 51 - DNA, 344 bp, Mus musculus
gatcattgtacctcacctgtcagtttgacaggtgggaggtgatatctcttttcattcatgtattctttgaaagtttgttcatgcatataatacattctggttcaattcaccactccacccttttgtatcccctgcgtaccgagcccccattttctcaccaagtcttactgttatctcagttttggggcttagttttttgtttgtcttgttttgttgtttttgaaacagggtcccgttatgcagccctggccctgaacttgctaaataaaccaggttggctttgaattcagagttctgcacacctctgttacccaagtgctcagattaaaggcgtatactaccac

SEQ ID NO: 52 - DNA, 270 bp, Mus musculus
gatcaattcaatctattgcaataacctggttttttttttccgcaactccaagatgggggggggggggcccagtcaggagaggtttcaacacaaacgcactagtatttacacacagaatctcctccactgttcttcttctttgctttaaaagtctttgttccggaatctatagatagggagacagatggctagctccccaaggctgagagcagaggagagtataaacagggaagtcaaggggtctgggagggcaaggtaaggaagccacag

SEQ ID NO: 53 - DNA, 137 bp, Mus musculus
caatgccttccccgcgagatggagtggctgtttatccctaagtggctctccaagtatacgtggcagtgagttgccgagcaattttaataaaattccagacatcgtttttcctgcatagacctcatctgcggttgatc

SEQ ID NO: 54 - DNA, 107 bp, Mus musculus
tagtattcaggaaaaaggaaactgggaaattaatgtataaattaaaatcagcttttaattagcttaacacacacatacgaaggcaaaaatgtaacgttactttgatc

SEQ ID NO: 55 - DNA, 35 bp, Mus musculus
gatcagaaaaacagcccattattcaagattcaggt

SEQ ID NO: 56 - DNA, 579 bp, Mus musculus
taacttcaatttaataattatcacatgctaggaactaaagaggtgcacaaaacaaaccaacagtggttcctatcctgtctaacagaagaaactacaattgtggtttgggatgccacataaatgacagcaacgggacctacagaaaattaagtcacagagagaatggaccatttctgcagagacctggaaaacagacaagggaagaaacatggtgtgtctaagtgatggggcaggtggtgcaaacgctagaggcaagcagaggggatatgaaactgtgctgcacagctggacagaagggaggctggaagggaagagaggaccctctgttttgactcaatggctagatgccatgtgccaaataagaaagcacttggggggttctgtgggaaatcggaacagagggactggaatcaaacctcaacgttccttgcatactccagataagaaccaggctttgagccagggcctgggaagagggctggcctacatatctcattttagagatgagcaaacaggactgggagctctaggtcttcagtgacacgcttgcttggcccgcaggagaccctgggtttgatc

SEQ ID NO: 57 - DNA, 165 bp, Mus musculus
gatcatgtcatgggtcaacagaaataattctgaaaggctaagtcatttcttctacccccaagaaaaatcaagaacaccccacattacaaaccttccgtagtaaactgagaatggagccatggccagagcccctctgctctcccatcccccaaccaagaaccaaac

SEQ ID NO: 58 - DNA, 95 bp, Mus musculus
atataacttctttttttttaaaaaagaattatttattttatgtatataagttccttatagctgtattcagagacgccagaagagagcatctgatc

SEQ ID NO: 59 - DNA, 249 bp, Mus musculus
  misc_feature (54)..(54): "n" at position 54 can be any base.
gatcatagcacactggggtgccatctgtcacccctagacaaacatctttaaccngcatctcttcctgaagcccacttggaccaccctttggaaaaccatcaccaaggccagtaaggtacccgtggtgactcacctcagcctagcccaccatagacgcttagcagagcaggtgtgtgtaagtcagagccagacaatcagaacactctccctgctccaaagtagcaatgtaaaaaattgaacccaaagttg

SEQ ID NO: 60 - DNA, 264 bp, Mus musculus
gatcaaagtaacgttacatttttgccttcgtatgtgtgtgctaagctaattaaaagctgattttaatttatacattaatttcccagtttcctttttcctgaatactacgctgtgcattctgtacaatccccaaacgtatacatacacactttatatatacacgataatctagcttattaaccaaccagaaacatgagtcttttgctctgtgcattggttctagatttattatataatgcatattccctcgggatttgcttatcc

SEQ ID NO: 61 - DNA, 38 bp, Mus musculus
gatcatttgatgcttcagataaatatgtaaatggtgac

SEQ ID NO: 62 - DNA, 493 bp, Mus musculus
gatcaagataatcccccacaggcatgcccagaggcccatttcctaggtgagactatagtctgtcaagttgacaatgctaaccattgcagtgagggagagaaagaaggccaggatggtgcctctctgttactctgcttacccacggggtgcaaggacagtgggggatgggcctgagcttcctcatgaacacacacatgagagcagtcagcacatggcctcttcctctaagcttcacagtggcagccgcacctctgctgttaagacctaacatgtggccgggcagtggtggcacacgcctttaatcccagcactcgggaggcagaggcaggtggatttctgagttcgaggccagcctggtctccagagtgagttccaggacagccagggctacacagagaaaccctgtcttgaaaaaccaaaaccaaaaccaaccaaccaaccaaccaaacaaaccatctaacatgtacatcctatccatgtgcacgaatcatac

SEQ ID NO: 63 - DNA, 277 bp, Mus musculus
agaccagtgccggagccgttcctggctgaggcagcccaagtccttgaagagcttgaagaggtcgctgcggaacttgacgccgatgaaggcatacaagaaagggttgacgcagcagcggacggaggccaggctgtaggtgacgtcataggcaatgttgagctgcttgctggtttcgcagctgctattggtgatgttgaagttggccaccgtctgagccaggaccaccccattgtagggcagctggaagactatgaagactaccaccacggcaatgatc

SEQ ID NO: 64 - DNA, 160 bp, Mus musculus
ccctctcaagccttccttgttacttagcctctataggtctgtgcattataccatcattcttttaatttacagctaatatccatttatatatgattatgtaccatatttgccttttggggtctggattgccctactcaggatgaccttttctagtttgatc

SEQ ID NO: 65 - DNA, 67 bp, Mus musculus
gatcatgatgtttgttgaagcaacagaaactataagacagtgcccaagagcctctctggagatagcc

SEQ ID NO: 66 - DNA, 167 bp, Mus musculus
gatcgtgttagacacaagtaagaaatgaatgagtcttcctgattttttaaattaacttctccccatattggctgtcactactttttaaatcagaaaggagaatctggacggttccaggcctgcagcgccatgcttgcaaaaggtttacagaatcgctctggacaact

SEQ ID NO: 67 - DNA, 131 bp, Mus musculus
ctaccacagcatcttttgagtgtatatagtcagtgtgctacatgttatctatgaacatatgcaaatgaggtttgagaattaaagttgctgatagactcatgggttaggggtttgattgcctgctaatgatc

SEQ ID NO: 68 - DNA, 316 bp, Mus musculus
gatcacgaaacggttgactaaagcaagactgaaccacaggcagataccaaacccaaagctctatgtctagtgtctagaatacataggtttgggtagccatgcccctgtgaccctgccacctgcagcacacataagacaatactatagacaaccacttctgagtcagaattgcaatgatgtctttggcaaactactctagtctcctttggccaggagctgctaagtggttcaggctgaggtacaatcaacctaggtaggtgggactgtgtgcccctgtgctcctgggtggccttcatgtctgctatgcttgcccttt

SEQ ID NO: 69 - DNA, 526 bp, Mus musculus
gatcatgtcaactatacctggacacggaccttcatccttgctggtttcactacctctggcaccctgcaacatcttgcagtttttggaaccctgtgcatctatctcctcacactggcagggaacttgttcatcattgtcttggtccaggcagattcagggctgtccactcccatgtacttctttatcagtgtcctctccttcctggaactctggtatgtcagcaccacagtgcccaccttgctgcataccttgctccatgggccttcacccatcccctcgtctgcatgctttgtccagctgtatgtcttccactccttgggcatgaccgagtgctacctgctaggtgtcatggctctggaccgctaccttgctatctgtcgtccactgcactaccatgcactcatgagcagacaggtacagaaacagttagttggggttacatggttggctggtttttcagctgcctggtgcctgcaggtctcactgcctctttaccttattgtttgaaagaagtggcccattactt

SEQ ID NO: 70 - DNA, 287 bp, Mus musculus
ctgtcaattcatccagctctaggccgctgtctggctcgatgcttattggtttaacagtgccgatgcataggattctacagtcagagtggcctaagcaacagctaaatattgttttcttgctgttctgggaactagatgttcaaggtcaaggcgtcagtagctctgttatgagacctctctgctgtcgggctgtgtcttcaagttttttcccccctctgtgcatgtgtgttcctatttcctctgcatgaaagaccagtagagccaagtggtggcacacacctttgatc

SEQ ID NO: 71 - DNA, 263 bp, Mus musculus
gatcatgagaggcgagaaacccagacatctctaactcttcttgccaactcaggagccacctgtggccccagctggccaccagccgttcctccctcagaggcctccatttccacaaaaggccttcctggttgttcaggacagagcctggtttccctgataccccttctctcagtggccactgaagttacagggatgcagccagccgtggttgccatgtctgtatatgctaatctccgaattccacttcctgtttagattctcag

SEQ ID NO: 72 - DNA, 122 bp, Mus musculus
gtttgtccgcatgagtcccagggaccactcagagtggctggcaggcattgtggagtggaatgtgggaagacacattcccagccttgtttgcagcttgggactgtctgtgttttgggatgatc

SEQ ID NO: 73 - DNA, 81 bp, Mus musculus
gatcacctgggaagggggaaaaggacaagtctgagctcccagcccacattctcctagggtagcagctccctcacttagtgt

SEQ ID NO: 74 - DNA, 279 bp, Mus musculus
gatcagttcttattaaacaatacagacttaggcaaaatgagtcagaaataaggatatcgcatatcccgagaccatttgaactctaagaagtattttctattattaaagtagttcaccaggcagtggtggcacacacctttaatcccagcactcgggaggcagaggcaggtggatttctcagtttgaggccagcctggtctacagagtgagttccaggacagccagggctacacagagaaaccctgtctggacaaaccaaaaaaaaaaaaaaaaaaaaag

SEQ ID NO: 75 - DNA, 61 bp, Mus musculus
gatcatcacagatgacatagaaccaaactgtaactttctagactacatgtagcagacattt

SEQ ID NO: 76 - DNA, 169 bp, Mus musculus
gatcatacatgaatacaagcaggcttctggtatactcttaagttgaattctgttttctgtagtcgtagtcttgtcttttccagttttaaattctagaacaggtatactgtagagcacccgcctccccttgctctggaggtagggtagagtgggagttaaggtcagttcc

SEQ ID NO: 77 - DNA, 218 bp, Mus musculus
atttctcttgtaaaactcactttctgttcacccattttgtctgtgtccttactaaattatttctatataggaatctttgtatcttctgatataagctagcgcatgggtaccaccagcacccaagtcatctgctgaggtgcttctaaccttgcttgattcagtgtcttcaacagaaggtggagtaaacaggtcattttttaccctagagagttcagatc

SEQ ID NO: 78 - DNA, 96 bp, Mus musculus
gatctccgggtgccagacttgcccagcaagcactcttacctgctgagccatcctgagggcctggatttaaaaaaaaaaaatattgacatattgttc

SEQ ID NO: 79 - DNA, 337 bp, Mus musculus
gatctcctaaaactccctgtgtcaggaaactttctgtgcttttgtattgcgttcctgtgttcgtggaaggcccccacgccttcatccttgctaattctttttggatagcttgttgctttaactagattggccctttcttggctagtattttctgctgtacctatgagtggtgtgggagaactgtgcagacttccaggaagcgcagccatgaagctacatgtgcctatgtgtagacacatcatggattttcttactagtttactagtgggtgataatctgtccttttgagctctccagaacgttctagaagcttaaggagagaaatcacttaagagag

SEQ ID NO: 80 - DNA, 243 bp, Mus musculus
atctgatagtaagtaaaaggacagctaaagatgaagggaaagcaggagagtcctggaagaagaaactagtgtttctaagagttcatcattgataaaatgcaaaagaagtcaattacatacatgtttaggaaactgaatcctcttgttttgggggatgtttgttttgaggcaaaggctctcttacagagccctggctgttctggagttctgtatatcaggctctggcctcaaactcaagagatc

SEQ ID NO: 81 - DNA, 170 bp, Mus musculus
acatcaagaggaagttggaaatgtcatctttagctatcttatatcctggtagctttaagatttcctttgtgtgactttatagttctcaaaatatttttaagggtcaggggaggaagcactttcaagaaatgagatgggagagggaatgtctttgtgttggcctggagatc

SEQ ID NO: 82 - DNA, 96 bp, Mus musculus
agctatacctgaaatttggccaagaacagaagctcaggaaatagtgtgatttaaaaaccaaaaccaatttacaaaaggaagactgtggtgtagatc

SEQ ID NO: 83 - DNA, 191 bp, Mus musculus
ccacaactgaaagcaacacacacagtatttttctgtgggttttaggatgtatccacactcccgaacttcctttccctgaagcacccctcagtttactctgaagcatggtttgagtcccaaggccagtgtcaactttctgccaagtctcaatggcaaaagtctgttttaatctgctcaggctaatgtagatc

SEQ ID NO: 84 - DNA, 345 bp, Mus musculus
cttccagtctttttagctatttattgatatgaattccctgccttatgtatcatccaagattctacctaaaatacttccaataagtatcaaggaccactcaaatattcactattggacttagaagctccactcttaaaaatagattctatagaaagagcctgaaatgggggcatgaaatgggtccatctccaccatcacgcacacatgaacaaagaaaaggaggaaatggtgttaagaaaacttacatcatactatttaaaaataaggaggaaggagggagggagagaaagagagaaagctcaatgcttaggcaagagtgcttaagaaaattacagttaacagatc

SEQ ID NO: 85 - DNA, 229 bp, Mus musculus
gatctcctaaaactccctgtgtcaggaaactttctgtgcttttgtattgcgttcctgtgttcgtggaaggcccccacgccttcatccttgctaattctttttggatagcttgttgctttaactagattggccctttcttggctagtattttctgctgtacctatgagtggtgtgggagaactgtgcagacttccaggaagcgcagccatgaagctacatgtgcctatgt

SEQ ID NO: 86 - DNA, 66 bp, Mus musculus
gatctgagtgctgggaaccaaacctgggtcctctgcaacagtttgtgctcttagctgccgagcttt

SEQ ID NO: 87 - DNA, 286 bp, Mus musculus
gtacggcgatgggcacaggcttcgggacagtccgcgcgacgctcaggcggacaacgggaggcgggcggggaaggcaggggctgcagtgtcaagtccctgacccgggaggctcggaaacttcactgcctctgcgcatccggcatggcccctcccactcggacttcgtcaaaaaaccgccaccgtggagtgtcccagtatgtgcggtgtgggacaaactatcgcactgttgccctggctcttctcctagaccccctttgtgagccaaaagagaaacgctgggcagatc

SEQ ID NO: 88 - DNA, 47 bp, Mus musculus
gatctcgttacggatggttgtgagccaccatgtggttgctgggataa

SEQ ID NO: 89 - DNA, 224 bp, Mus musculus
ctgggttgaccttagaaacgggagttcatctcctccagcagctccgggaaggaaggtgaaggggactaaccatgatgagctttgcacactggactcagggcctgagaaggggctggagggaggcagggaagacatccctcacggtagtgttacacagctggtgttgcgggctgccagggtactcatttgagtccatgctgagtctctcggtgcctcctgagatc

SEQ ID NO: 90 - DNA, 274 bp, Mus musculus
gatctcaggaggcaccgagagactcagcatggactcaaatgagtaccctggcagcccgcaacaccagctgcgtaacactaccgtgagggatgtcttccctgcctccctccagccccttctcaggccctgagtccagtgtgcaaagctcatcatggttagtccccttcaccttccttcccggagctgctggaggagatgaactcccgtttctaaggtcaacccagagtgggaaccgcagcagcagcagcagtcgtctgtgctttgggcttcccta

SEQ ID NO: 91 - DNA, 258 bp, Mus musculus
ggaagaagtgtgtgcaggccatggtcaagtcctgcatggctcccatctgggtccagcagcacccagcctccagtgcttgctcctgatgtcccagtgaactcaggtcctgagcagcaaatcccaggggccagtcctagggagaaaaagaacacactgccatctcagtgcctcaacagaagcaaacctaggcgtcaggtcatgtccttgttacccacatcacacctagacttccctgggtatcatgctctgtgtgagatc

SEQ ID NO: 92 - DNA, 159 bp, Mus musculus
gatctaaggatatatcattcctaggagaaaatgaatatttatgaccttggatttgtcaatgtttttttaaatatggcattaagccacagagataaaaataagaaaatagatacatcgaatttcagtaaaatgaggaagttcttgtgattcaacagaaac

SEQ ID NO: 93 - DNA, 64 bp, Mus musculus
gaggtaagtctgttcagtgtagctatccttagcagctaacagtcctcaaaactttttagagatc

SEQ ID NO: 94 - DNA, 170 bp, Mus musculus
ctacagatgcattattaatattactttttaaaaaaacccagtatactgcttgaaaacagtgaatgcaatgggttctcattcaccttcctgctctcaatcaatctccatctctaaagcaagaagtgggggcccttctggctgagcgaggggtgaagggaggggaagagatc

SEQ ID NO: 95 - DNA, 36 bp, Mus musculus
gatctggagaagatgtcaagttttaaaatgaggcag

SEQ ID NO: 96 - DNA, 206 bp, Mus musculus
gagtgaagcaagaatttggagcccagctgccgcagcctttttcctttcagcaaagctcgggagtgatagatatgcatgaaccaaagcaaagccttgagagtgccacttggccctgcctcctgagggtctcagggcatcagctggagaccaccctgtgacccacacatcaccgactatgaaaacagctcatcagagtaataaagatc

SEQ ID NO: 97 - DNA, 86 bp, Mus musculus
caatgaacaggacacatgcttcacacgacagtccaaaaatgcaaagtgtggaagaattccacagccatagccttcattactagatc

SEQ ID NO: 98 - DNA, 283 bp, Mus musculus
atgccttcctggtagaagagggccatgctgtggcggggaggggccactcaatttttcctgctccctttccctgtcccatattctcaggagcttctagaagcgtagcctgcatctcatgccctgacttggcaccaaatgcttgctttgtatcaacaccgctttctcttctgctctttccagctcgcagccattcaaataataccacccggtacccgtggaatcaggagcagagattccaaattgagtcctaaaatcaaatccaaatgggcccgtcagctagatc

SEQ ID NO: 99 - DNA, 266 bp, Mus musculus
aggcgagcggattactaaggactgaaagactcctaagacttgtctcctgctccctggccagcggtggagctcaagcagaattgcaagctcagctcaggtctcagtgatgcaaagcaccctcgttactccaatgtgtgttactcctacaggtgggctgccttccactttcaaacacccgcacaaacagacctcccaccgtatgccagagcatctgttcgatgctttctggaaactatgcaagcccaaatttaatatccaatcagatc

SEQ ID NO: 100 - DNA, 231 bp, Mus musculus
gtgtgtgtgtgtgtgtgtgtgtgtgtgtgtgtgttacaaggtctcatacagaatccaggctggtctcaaactactggagtcaagccatcttctcacctggcttagctggggtcacagacttgtgccatcatgcccaatggaatgctgttccttttggaaagcctgctactgtcatatactgtcataggagttagcgactgctggcttattccttcgctttgcttggagatc

SEQ ID NO: 101 - DNA, 188 bp, Mus musculus
cccccttcctgtcacctcctgaccccttgcgcaaaggaggctcgtggcccgctgtcccactgggggatggggctggggttgagaaggctagtgagcgcctctaacgctcaggaagtgaagtttgtggttttgggggctgagctccgaaggagattaaaaaaaaaaaaaaaaagtcagagagacagatc

SEQ ID NO: 102 - DNA, 45 bp, Mus musculus
ctttgtataagcagcaaacaaaaagccagaggcagtccacagatc

SEQ ID NO: 103 - DNA, 172 bp, Mus musculus
atacaacaggagcaaagctggaggggaacagatatagaggacagttcagggcatctgcagaggtgctgtggaatggggaggggacagtggataaggggacttaccctgagcatctcggtaataagcatgggtcacactgcggaagcgctcctgtcctgcagtgtcccagatc

SEQ ID NO: 104 - DNA, 216 bp, Mus musculus
gatctatgtcatcttccaggactcagagttaagagagttaccaagtgagagctctcatcaccttctgaagcagttgagaattggaacccagaaagatgcacatgcacgggcacacacacacccacgggcacacacccacccacccatgcagagagagagagagagagagagagagagagaactcacactggtactgcagtaaacgggagcttgttt

SEQ ID NO: 105 - DNA, 112 bp, Mus musculus
gatcttctttctctgctcaattagttcacttctgctttcatctccttttcttttgataaaccatgagtttcattagggctattacaatcacatgcagtttttccttatagta

SEQ ID NO: 106 - DNA, 49 bp, Mus musculus
gaattaggcctagaaacattagaatccagaccacggagctccccagatc

SEQ ID NO: 107 - DNA, 274 bp, Mus musculus
gatcttgttctagaacgaccctgaaggcagcagaacagagcaggactgaaggccaccaaggggatttcaactcttcagaaaaaataagtgactcaccttctcacaaagagcaagaatcacagaggtcagattgtctcctcctgcccatcagggacagagtcccccatctttgccttgctccatctggcaggtaagagatgggaagtctcctttccctcggtctgcagcatccctggcatccctggggagtgttggcacagaacccccctcccaa

SEQ ID NO: 108 - DNA, 88 bp, Mus musculus
gatctgtgtgggcaaagcccatgtgctgcagtgtgtctgggtagaaatgagttgtgtggtgctcaaatgtaaatgaagtccctgtgtt

SEQ ID NO: 109 - DNA, 308 bp, Mus musculus
gatctcattacagatggatgtgagccaccatgtggttgctgggaattgaactcaggacctttggaagagcagtcagtgcccttaactgctgagccatctctccagccccccacctttttttttaaaagatttattttatagtttttgcttttttaacagtactggaacatctcagtaattgctaagttgtccttgctccaggtgagcagtcatattttctccaattctggtttccttacttgtgtcagagaccaaaatagcttgtttaatcagttagagctctttagttacccatatctgtgtagtaa

SEQ ID NO: 110 - DNA, 150 bp, Mus musculus
taagaacataaaagcaaaatttggaggctcaagattcagtttagttgctagagggctcacatagcatgccctccccacccgggattccattctcatttatcgaggcataaggccaggtgtggtgggatatgtgctgggatgcataagatc

SEQ ID NO: 111 - DNA, 265 bp, Mus musculus
gaaaggcacactggtgaaggctgaggaccaccaaagctgcatttctgctaggctaggtagaacaagaatggtgctccactaagaactcaaaaagccacagcccacccctgaggccctccatctgacacatgccggtcacctgtcctcccacagcccagcacagagaagccaccatccctccccttcccacctcctgcagctgacagtgtgcatctttccgcacattcctctctcctcaatcaggtcagaatgtattccaaagatc

SEQ ID NO: 112 - DNA, 41 bp, Mus musculus
cactgaaaatggctagaattctggtgatgggtgagccgatc

SEQ ID NO: 113 - DNA, 262 bp, Mus musculus
gatcggagtccctcgtttcagaggccccacttctatggctcctgccttccttggctacatccattcctgctgagctcctggaaacctgtgtatcaagtcttttccagttagtgcgttctgagtggctctagaaaccgcttcccattacagcgaaagacccgtataaaccatgttctcttcctctgtgacaagagacaacagacaccgcacaaaggactgtctggcctgggggggggtccctggttcacagcttcagtcctga

SEQ ID NO: 114 - DNA, 165 bp, Mus musculus
gatcgctcaatataacagcaacatgccaagtgccacttgtaaaatttgttgttgagcagtctcattatcaactgaagcacaatgtcaggctagcaagaggcaggttcagttgttgattagcgatagcacacacaagccagcacatgctttttctgtgagttctat

SEQ ID NO: 115 - DNA, 98 bp, Mus musculus
gatcgctgagtttgtttacagagcagggacgcctcagctcggatgccaaagctaccaagagctgcaaacgcaaacttagcagaagcacacgtactccc

SEQ ID NO: 116 - DNA, 301 bp, Mus musculus
gatcgcacaggtaaaatggggactcactttagctaaaacaacaacaacaaacagcctgatgagtcgaaagtctctttaggttgccctctgttctccagccccacatcctgaaggctgtgcattcctcccacagcagtctcaaaataaccatagtgctcaagtcccctgtatcaaatggtggtatctgcatccaccctacaggtgttctttgattctttcttttctttgtaagtgtgtctgggtgttttgcctgagcgtatgtatgcgcctagtacctgcagaggccagaataaggtgtcag

SEQ ID NO: 117 - DNA, 263 bp, Mus musculus
gatcgtgagaggcgagaaacccagacatctctaacccttcttgccaactcaggagccacctgtggccccagctggccaccagccgttcctccctcagaggcctccatttccacaaaaggccttcctggttgttcaggacagagcctggtttccctgataccccttctctcagtggccactgaagttacagggatgcagccagccgtggttgccatgtctgtatatgctaatctccgaattccacttcctgtttagattctcgg

SEQ ID NO: 118 - DNA, 45 bp, Mus musculus
actgtccgtgtgggaaacgtttagcaagtccgagcgtgttcgatc

SEQ ID NO: 119 - DNA, 340 bp, Mus musculus
atttctttttgagtacttcatataagagcttcgcatctacaccactcttgctcgccactcctcttttcttctttcattaactactgtccactctccaaacttcataatctctctaattactattgttatttacacacacacacacacacacacacacacacacacacacacgtatatgtaacctactgaatcttactaaatagctttactatcttccaagtaacaggcacttgataaatcttctgtcaatctcccagaacagaagccttaagagtcatttaagttcttttatctcaggctgttctgttctatgccttttgcttttaatccatcaccgatc

SEQ ID NO: 120 - DNA, 158 bp, Mus musculus
gaatgtctagatggagactggacagagttggattcctagacacctaacagaagcgaaagcaggggatggataaggtgggtgcctcgtcctacagcaggttctgagtgtccgcagagactcccatggcttggcaccatggttgaagctttccatcgatc

SEQ ID NO: 121 - DNA, 21 bp, Mus musculus
ctattttcgttctctccgatc

SEQ ID NO: 122 - DNA, 133 bp, Mus musculus
gatcctcatgtcaaggcaggggcagaccagggtcaagggaaaaacacctgctttcctgggttgtaaatgccagaaagggaaggcacggggtgggtagggtggagaacatggcccagacccctgtctcttctct

SEQ ID NO: 123 - DNA, 330 bp, Mus musculus
gcacctgacttcctcatataagacacaaacatcttgagtgctgcgcaggtgtaccaggatacaggtgaatccaatctggtggagatttgcccctgctgccctgattagctgaagctgcgtgcctggtgaggtggcatggcctgctgtgcgtggatgggaactgagagtataaaagagcgagaggcccgggttagaggaggattattattcgagagaggattgttattattgggagatatgaacaagggagatataaacaggggagatataaacaagggagatatatggagaaagaagaaacaggactgaataaatgtgtgcagaaggatc

SEQ ID NO: 124 - DNA, 178 bp, Mus musculus
gatccttctcctgtcttctcttctggaaggctgggctacatgccaacatgtcagagttttacctgggttccttccagaggtttgaactcaggtccttgtacttacacagcagctactttgcctattgagtcaatattttgtgtgtgtttgtgtaggtgtgttcatgtctgtatacttg

SEQ ID NO: 125 - DNA, 50 bp, Mus musculus
gatcgtgcatgcatgggtgtgttttggggagaggttctgtccttgctaag

SEQ ID NO: 126 - DNA, 388 bp, Mus musculus
agctcagcttgtcaggcctgattgtgaacacttcaccaaccgagccatctcgtcagcacagccctgttttttattcccattttcttttctgtatttctgttgaatttctcacatactctcctttctcttctgccttcttctggtttctgcatcatttctatattgacatttaaacaacccccaaaattcaagatacatcaacaaaaatttattcaactagtctttcttacttccatatcaataatgaaagaaaattaaaacctttcaaattcaacaaatccctacactacatataatcactttcctctatgctaaatccaacttgaaattatatcctcaataccctgctggtatttttactgtctacatcactgcctagtcttcgatc

SEQ ID NO: 127 - DNA, 242 bp, Mus musculus
ctggtatatgaacgaagttggtctctaaaggccgtctagaacaacggttctcaacccgagggtcgcaccggggtcacctaagactactgggaaagcacaaatatttacattacgactcataacagtagcaaaattacagttatgaactagcaacaaaaaatagttttatggttggggattaccacaacatgaggaactgtattcaagggtcgcagcattaggaaggttgagaaccaccgatc

SEQ ID NO: 128 - DNA, 173 bp, Mus musculus
ttctaacctgctagggttttctcacgtgggttcttctttgagggctctctggcttccctactgagctgtagctgccaaagttgaagggctgcgtctcccttgcgtctccccagtctttacagctcctgaaacacactaaggtatttattcaaatccctgttttgtgtgcgatc

SEQ ID NO: 129 - DNA, 115 bp, Mus musculus
agggcccttccacctcttctagaattcggtaagctaaaagtacatgtatccgattaatctgaaataattttgtagacagtttggtgacgggtggagggtgtgtggttgcgcgatc

SEQ ID NO: 130 - DNA, 114 bp, Mus musculus
gatcggcgagaccacgattcggatgcaacagcaaaaggctttattggatacacgggtacccgggcgactcagtctatcggaggactggcgcgccgagtgtggggttcggaccaa

SEQ ID NO: 131 - DNA, 247 bp, Mus musculus
ttggctgtggagatgaacgtgggaaccgtggaaatgaccctagaatggggctcaaatgtgaaaggcatgccagaggttgctctgttgttttaagtccctgccgaacattagaatttagcctcagttttaaaagctgttactgcctagttgggtgcttctttcttaaaaagcaaccaaaaaaaaaaaagccgttttcactctgaaatgtattagaaatttgcattagcccaatggctaataagcgatc

SEQ ID NO: 132 - DNA, 187 bp, Mus musculus
gttataaggattgcatacaaatggcatcaggactggatgtggtggcacatgtcttgtatcacagcacttggtgaacagaggcaggggaatctctttgagttacaggctagccagcatgacacggtgagactctgtcttaaacaaacaaacaaacaaaaaaacaaacaaaggtagcataagagcgatc

SEQ ID NO: 133 - DNA, 35 bp, Mus musculus
acctgaatcttgaataatgggctgtttttccgatc

SEQ ID NO: 134 - DNA, 96 bp, Mus musculus
aactaatacctttccttccgctgcgatgtttcatgagactctgggttagtgcatggtcaggggcccaggcaaacagtggcagttctgcccaggatc

SEQ ID NO: 135 - DNA, 213 bp, Mus musculus
gtttaaagagccggttcgacccgctttccgtttcgctccgggtcagctagtactgtgaaccgctcggtcgggtccggcgctgctgcgcacctactcgccgggaccctgaagccccccaactacatataggggtcttcccggaaagtacgcaggaagtcgcgttcggccccctccccccagcaccacacccagtcccttccaccccccgggatc

SEQ ID NO: 136 - DNA, 255 bp, Mus musculus
gatcccagtagagacagaaacagtgcctttggttaagaattccaggcaggatggtacaggattgcaatctcagcatgggagacagaggcaggatttccaggccagcctgggctacagtataaatgggaccctgtctcaagtaattgaaaaaaaaacagagaaagaatttggagactgtgactatagcttggtgatggagtccgtttgcctagcagagtgaagcagctgtgctcctgtgttcacaccacaaaataa

SEQ ID NO: 137 - DNA, 133 bp, Mus musculus
gatccagtgaatctgggcattgtgagtgtgtgacacaacttgctctatgtgctgttagggatttgtgcatgctcagccaacaacaaccgccaacttagactgatgctgtccccctgagaacacagactgacaa

SEQ ID NO: 138 - DNA, 208 bp, Mus musculus
gatcctccctaccggtcctcgggcagacctccagcccttccccagacactgttggaaagcaggcacgccttccacagtatggtctgaggttaacccatgacagcactctgggtgcctggtggtgttcctggtggggacgtcagtagctgtagctctgtcattggtccttgcagcgtctcattccaactattcttcccatcactcctct

SEQ ID NO: 139 - DNA, 245 bp, Mus musculus
atatgtgtttgtgcgtgtgtgtacatgtgcatgcatggcatgtatgtacccatataaatatgtgtatgtgtgtgaagtgctgatgtatttcacacagcattttggatttaatggagaaggtagctcagatgtcaagtgtgccctcctgtcaggagaggaagcctgatgtgcctgctgtcataactctggttttgataaatacagcacgagtgatttttggctgttgggtttgccgtgtatggatc

SEQ ID NO: 140 - DNA, 146 bp, Mus musculus
gtttgcttgcaacattgtcatagcttagtgaacagtatagcattgttctggctcaagaagccctggttcttcaaagctcctacttagatgaaattatttgcatcacaaacaaaaattgttttgcattttttagataatgaaggatc

SEQ ID NO: 141 - DNA, 417 bp, Mus musculus
gatcctaggccagtcagggctaccaataagaacctgccacacacacaaaaggaaagcaaatttttgcaaaaactctagtctcatggtgtcacggtctttaaacatcttgaggggctcgaactggtgaggtggctcggaggtaaaagggctttgatgcacaacctgagttcaaccccgtgttttaaagactttctgcaatgattctggtctgcagtcctagcccaagcacagtcaaggagagattgaggctgaaacggaagaatggaagtttgcataacagctcagtggcagaaataacaggagagacctgaccttaaaaacagggtgtaaggtgagaaatgatgacaaatgacatccacttcaactgtgctacgaacagctacctgtttgcacaccccaaacacacacacacacaca

SEQ ID NO: 142 - DNA, 82 bp, Mus musculus
gtaagagggaatgtactctctgccatcgggacacccagtggaactgctcacctggagtcttgcctccacgaagactaggatc

SEQ ID NO: 143 - DNA, 220 bp, Mus musculus
gggacttcagggcatagagcttagttccagacaaaaccaaagttagcagtcgcctctctcttaaagacgttctctctagccgcagatgacctcagaaggggctctgggagccgactcccacccttccttctctgtttacagaatctggttgggctgtgaggagcgacccacgagacgggctccctgtagtgagttaggccagtgggaaccaacgaggatc

SEQ ID NO: 144 - DNA, 105 bp, Mus musculus
acacacactaacacacactcactcacacatactcacacacactcacacacactgtcacacacacacacacacacacacacacacacacacttttccaccaggatc

SEQ ID NO: 145 - DNA, 517 bp, Mus musculus
gatccctggatatggcagtctctacatggtccatcctttagtctcagctccaaactttgtctctgtaactccttccatgggtgttttgttcccacttctaaggaggggcatagtgtccacacttcagtcttcatttttcttgagtttcatgtgtttagcaaattgtatcttatatcttgggtatcctaggttttgggctaatatccacttatcagtgagtacatattgtgtgagttcctttgttcaaatttcatttctatcaccattgtgtgtatatgtgtgtgttgtgtgtgtatgtatatgacgtgtgtatgttgtgtgtgtatatataacgtgtgtatgttgggggtcaaaggcatgctcatgccacagtgaatgagtagacatcagaggacaactttcaggactcagttctcttgttctaccctgtggttccaggacactaacccaggtcatcaggcatggtgacaaaggttttgactcaaggagccattttacatgcctcataagaagggcc

SEQ ID NO: 146 - DNA, 100 bp, Mus musculus
gcactaggaaggaaattgacccgtgttgttggtttgtgttctggttttgttggtggtgctttttgttttttttgtttgtttgtttttttgtatcaggatc

SEQ ID NO: 147 - DNA, 148 bp, Mus musculus
gatcctgctttctcttttgacacagaacacttctcctgattgactctggtccagacatttctttcaaaggcagaggactctggcttagctgtggatgacttctcagatgaagttcattggttgcgattggaaacgtaatcagagcagg

SEQ ID NO: 148 - DNA, 600 bp, Mus musculus
gatcgcattagggttttttttatggtttctcatcttctcttcaaattagcatagaagcctcttcctaaagaatggatacttaattcttaacttgaaaatatcttttctctgtgtgttttcctctccattgactgttcgctctatctatctatctatctatccatctatctactgaaattaaaaataagggaacgccttcttctcttcattcttgtttgttgtttgtttgtttgtttgtttttgagacagggtttctctgtgtagccctggctgtcctggaactcactttgtagaccaggctggtcttgaactcagaaatctgcctgcctctgcctcccaagtgctgggattaaaggcgtgcaccaccaccacctggctctcttcattctttttaaaacgatttttgaaacctttttagtgaggtcaacattgtgtactccagtcccactcatcttcctgtcccttccctcttaggcctgcctgtctggtacctcactcatgtttgtgtattctctgtgctgagcctcttctgtgctttcccagcacatggctgctggctccagtttcattccagtcccttgtgatgtgagcctagttcag

SEQ ID NO: 149 - DNA, 600 bp, Mus musculus
ctctcatggcatgggtctcaaggtcctgccatttctgctccatctttaccccagcacatcctgtagacaggacaaattgtaggccggaggttttgtggctgggttagagacccagtttctccactggaagccctgcccggttacaggaggtgaccagtttctggctccatgtcccccattgctaggagtcttagctggggtcattctcacagattcctgggagattactctattttatctccttgttcaaagtgttccatcagatattaattattctcaagattcaatattctcaaatattattctcaagctatggacccttcaaattacagatagattttatgaatgaaaagttgtgtggtttgaatatgtagttgagggtgactttgaacttctggttttcctgtgtctaccttccaagtgctggggttacaggtatgagccatcacgccagtttctgtagcactgaggctcaaacacagggcttctgtctgctaggcaagcactccacctaccaagccaaatccccgggctttactgcatctttgtgtgtatatgtatggtatgtgcgtgtgtatgtaaggatatatgtacctgtgt

SEQ ID NO: 150 - DNA, 258 bp, Mus musculus
gatcaacacctgaaaagtcgcgccgcctatacacatccctaattgagaagtatgtggaagattccatccgtgaaattcaattatcatgcaagccaagtggaagcgcttccctggggaaggaacccagcagccgcatcaaaacgaccccacctgtctattttcatgtcaaaagagtgagaagtctgggtgatgaaatagagagcatacatcagcttaatgaaaatttccaggggtccctgcctgtaatgggagtcccat

SEQ ID NO: 151 - DNA, 51 bp, Mus musculus
gatcaccaccagggtgttgagaaaaaaaaaaagcaagttagtagatgttag

SEQ ID NO: 152 - DNA, 98 bp, Mus musculus
gatctgacaaaacctacctgtttttgaacacatgtgggacagcagtctgagagaatctatgaataaaattcctttctgagtctggcacattggtacac

SEQ ID NO: 153 - DNA, 90 bp, Mus musculus
gatcattataccccaaatggtactgtatctatatatacctcaaacatgtcatgttaaagaaaatactctgttgaactaattcacttgttt

SEQ ID NO: 154 - DNA, 30 bp, Mus musculus
gatcacaggactgaatcacatttatgccat

SEQ ID NO: 155 - DNA, 111 bp, Mus musculus
gatcatttatttacttgttttggtgtttcatgtttgtggctccttatgtagtctagatattaacttgaagtctgaagtggaactaccaaagattttcttccatcctcatct

SEQ ID NO: 156 - DNA, 65 bp, Mus musculus
gatcaaccgcagatgaggtctatgcaggaaaaacgatgtctggaattttattaaaattgctcagc

SEQ ID NO: 157 - DNA, 217 bp, Mus musculus
gatcatcatgtcaaacctgacacgtgacgagacaaatctgtgtgcacagaggtgtgacatcctaaaagtactaacaataccgctgggcagggacacacgcggcaattccagtcctggtatccatggctcaagctctgcacggagagcccggcacacggcaggagggagagccacaggctaaggagagcaatgctaactaacatggcacccgtgttag

SEQ ID NO: 158 - DNA, 55 bp, Mus musculus
gatctggcttccaagggcctgtactcatgtctacaatgctcctacacagatatat

SEQ ID NO: 159 - DNA, 535 bp, Mus musculus
gatcagccttcctccaaagctacctgcatagaagagacctctgctctcacctactctcctctacagttcagcccatatggcttcacctgcatcccctacacacacacacacagacacacacacacacacacacaaacacgcacacagcacacacaacacacacaacacgcacactcacaacacaaacacacacaacacacactcacaacacactcacacacacacacaacacacacacacaacacacactcacaaacacactagtacacaaagactccaacacacacattcccatgcactactccctcagtatccgccgcatttgtgttcacactcatccacactctcacacatgtagcacacacacatcattcctacacaggcatggacacacacatgctcctatacaggcatgcccagtactctcacatgcatgtttgcacgttcccaaacaggttcccacaagggtttggcaaagtacatgcatcctcacacgctaatgcaagccgtcacaccccataccacaagcatgcac

SEQ ID NO: 160 - DNA, 361 bp, Mus musculus
gatcagatgtggaaattagagagaagtttttaacggctcatgcacatttctgaaaactctttgcgaggtatactggtagataaatgaacattggtcagactcctctagtttaaaccactctcttccccgctatggggggaggcgagaggcatttctaaagcttatatgtagttgcaaagtgtgtgtggtgtgtgtgcatgtatgtgcatgtggtgtgtgtgtgtgtgcatgtggtgtgtgtgcatgtatgtgcatgtggtatgtgtgtgagtggtgtgtgtgcatgtgtgtgcatgtatgtgcaccgtgttgtgtgtgtatgtgtgcatgtggtgtgtgtgcatgtatgtgcatgtggtgt

SEQ ID NO: 161 - DNA, 52 bp, Mus musculus
ctaacatctactaacttgcttttttttttttctcaacaccctggtggtgatc

SEQ ID NO: 162 - DNA, 148 bp, Mus musculus
gatcataaggactgttagcaggcaaaggcgcgtgcccaattaaaagatggctttcgttccaagaggaatactctggcaaagtcccaagcgcttcggaagcccctcccttcgctctcccaccccagctttgatgctctgattatcctaa

SEQ ID NO: 163 - DNA, 57 bp, Mus musculus
gatcaggctggccttaaactcagggagattcatatggccctgccttcagggtgctgg

SEQ ID NO: 164 - DNA, 174 bp, Mus musculus
ctttctttctttctttctttcttttttttctgagacagggtttctctgtatagccctggctgtcctggaattcactgtaggccaggatggctcagtctgctttcttatagaactcaggaccaccagcccagagataacaccactcacagtgggctggtcctccccacattgatc

SEQ ID NO: 165 - DNA, 91 bp, Mus musculus
gatcacacacttcactgtggcttgtcaactgtgatttgctgatacaagggctgtttacaagtcagctatagctccgcattgcagctgcaac

SEQ ID NO: 166 - DNA, 350 bp, Mus musculus
gatcactaattgagaaaatgccccacagctggatttcgtggaggtacttccccaactgaagctcctttctctgtgataattccatcctgtgtcaagttgacagaaaaccagccagtacacaagtcgacacaaaactagccagtacacaagtcaacacacaacgcgcacaagctgaaggcaaagagaaccaagcatctaccaggcctcagttgctatgtccacttctgcagccactccaaaacacctgtcagaaattcggtttgatagagaactcaccgagggatttccctaacaccaggtcaaccagggcacctcaaacctggaggcacgactggcacaatacaacctaa

SEQ ID NO: 167 - DNA, 126 bp, Mus musculus
gatcacttgataaagatgctctgagcagaggctcacaggaacccagccctgtgtgctccccaggagcgagattcagcagtcaacagtgcagtgttcacgtgaccgtgcgcaggccatgagcactac

SEQ ID NO: 168 - DNA, 229 bp, Mus musculus
ctccttttcagcaagctcctcacatcacaggccttctcttgggatggcagccgccttctatctggaaagtatgtgacagctcacacaatcctgtaagtcttccatgtaatcacattccactgcctctctctgaacgtgctccatgccagggccatgtggagggagcagcaagacttgagctcagctagtctatgaagatggtggcagaacaggctctgctgccttgatc

SEQ ID NO: 169 - DNA, 190 bp, Mus musculus
gatcaagagttcaaagtcatcttcagctacaaatgaagttggagaccaatccagaccctctctcagaaaaaaaggaaaaaggagaaagcaaaaggaaaggagggggagaccgagaaagagaagagggaaggaaagggaagtcaacagaactcaaggtcagcctgggagggtgaatgaggcattgttgtct

SEQ ID NO: 170 - DNA, 137 bp, Mus musculus
gatcacctccactttatggtggacagaggatggcagtagtaactgccccaaggaaacagaaacaacaacaacaacaacaacaacacctccaaaaagaccaaagcagtaagctgtagaacaaatgcaaagagccaaac

SEQ ID NO: 171 - DNA, 77 bp, Mus musculus
gttccacctataaggttgcagacccctttagctccttgggtactttctctagctcctccattgggggccctgtgatc

SEQ ID NO: 172 - DNA, 402 bp, Mus musculus
  misc_feature (371)..(371): "n" at position 371 can be any base.
gatcacatggaccgattgccgcgggacatcgcacaggagcgtatgcaccacgatatcgtgcggcttttggatgagtacaacctggtgcgcagcccacagctgcatggcactgccctgggtggcacacccactctgtctcccacactctgctcgcccaatggctacctgggcaatctcaagtctgccacacagggcaagaaggcccgcaagcccagcaccaaagggctggcttgtggtagcaaggaagctaaggacctcaaggcacggaggaagaagtctcaggatggcaagggctgcctgttggacagctcgagcatgctgtcgcctgtggactccctcgagtcaccccatggctacttgtcagatgtggnctcgccaccccttcttccctcttcattccag

SEQ ID NO: 173 - DNA, 100 bp, Mus musculus
gatcatacgcaatgatttcttaccttatgatataattatgtttagagggaaaacttttttttaaattgaagttcatttattgtatgaaattatttcataa

SEQ ID NO: 174 - DNA, 294 bp, Mus musculus
gatcagcatggtctacagagtaagttacaggacagccagggctccgtggagagaccctttgtcagaaaacaaacaaacaaaaaattagaaagagaccctctctctgatttgaccaatcacccgtgtcaaatcttgccacaaccgaatcaccaccaaattgccagacaagcggctatgctgggtttctgaggttggactcctcaggtagcccgtgtctaggcagaatgatgccagcagctacacttttgagaacaaggtcaggtcaggacttgccgccaaacctaggaatgcagc

SEQ ID NO: 175 - DNA, 55 bp, Mus musculus
gatcagtcatgtcctttagacgtttactttcatcccaacttggaacatttcaagc

SEQ ID NO: 176 - DNA, 218 bp, Mus musculus
ttacaaaggcagaaatatcagaaagagcctgaagtagcagctgttaacctgtaccaggaactggccgaagtacacacgcgttaactcagccctaattattctcgggagatacagttgattatcatacacatgtcaaaatggaaaataaatgggtaactaaaaattgaggaaaataagattaacacttaaacaacctagttcattatgccacggtgatc

SEQ ID NO: 177 - DNA, 27 bp, Mus musculus
gatcacagtgggacagattaaatgtta

SEQ ID NO: 178 - DNA, 216 bp, Mus musculus
aaacaaatacaaagtgataattgtgtgacatctgaacttgtcaatgagataggtaattatctctgggcaatgggtaaatgtgctggccagcaaacctcacagccagagttcaatctccaggaacttaggtggggaaggagataactgacttccaaatgctcacccccaaatatacaattaaaataaaaatcttccttttatgagtagcaactgatc

SEQ ID NO: 179 - DNA, 27 bp, Mus musculus
tacccctggtcctccaacactccgatc

SEQ ID NO: 180 - DNA, 81 bp, Mus musculus
gatcatgacatagacttgagtcacttctctgcagtttgtcaataaaagcccctaagggacagtgtggactttagagataac

SEQ ID NO: 181 - DNA, 240 bp, Mus musculus
aatgccagccatagtggcacacacttttaatcccaacactcaggagaagttaagtttctcttagctcaaggccaagtagcttggtctactccgtgaattccagcccaactacatagtaaaactagccttaaaaaaaaaggcacaggcagagggagataacaaaaatgcccaactcctagctacagtaactgtaggaattaagatagaatctgtagtttgtttatcattatcgtgatgatc

SEQ ID NO: 182 - DNA, 196 bp, Mus musculus
gatcatggcttgattgtaacattatcaaagcttccttggcacactgcagggctgtcttcgggaaactgcgtattgtgctcttcaggtacaaagcatagagcccttacatgacaaacgctggggttaacttcttctagttccctctgccccacttgtggcgcttcccactcatgacttcttcagtgtgtattcactt

SEQ ID NO: 183 - DNA, 143 bp, Mus musculus
gatcatgctgaactcttgaaagtattctagcaaaatgtggcttaaaagaaagaacaaacattaactaggtatgctttgaaaaattacctgtggtaaaatttccacaagcatgagaagttgtttcttttgttgaaccttcagac

SEQ ID NO: 184 - DNA, 85 bp, Mus musculus
gatcatatatcaattttatttttaactttgtttgtttgtttgtttgtttgtttgttcgagacagggtttctctgtgtagccctgg

SEQ ID NO: 185 - DNA, 44 bp, Mus musculus
attgtgtatccagagtgtgacaaggtatatatggttgtgtgatc

SEQ ID NO: 186 - DNA, 140 bp, Mus musculus
  misc_feature (64)..(127): "n" at positions 64, 77, 119 and 127 can be any base.
gatcttctgtctggaagagtgcttgctggttccgactacttttttttttttttttttttttttngcttgggtttcanattggcttcaggttctgggccctttcgtgggttgtgctgcanagccccanacaatgtcttggg

SEQ ID NO: 187 - DNA, 263 bp, Mus musculus
caggaaaccaggggaaatgggacacagtgacatctgagtccttagaagaggtcccacaaaggtctatatgacctagcaacgtcacttctgagttatttctcagacacagtggatgtttgtcacagcacactgtaggacatcccagaacagcaccatgggagaccatggttggtgcaacagagaacatgcacactgagacagtacaagagttcccaagcaagcagacacaaacaatggactcaatacacatacagtggcagatc

SEQ ID NO: 188 - DNA, 84 bp, Mus musculus
gatctgctcaccaaaaatcttgtcctagggaagttgagtttgaactgcgtgcttactggcaaacacgcggtgcccaaatttaaa

SEQ ID NO: 189 - DNA, 43 bp, Mus musculus
acagttccccctggaaatggtccctgtaccagaggagcagatc

SEQ ID NO: 190 - DNA, 242 bp, Mus musculus
ctggggcccagactccaatcccgaaatatcattagctgctgcgcacttctccgaggaagtttacaccagtaccctaagttcaagtctcagaagcctccaaatcctcgttgcacccctatatttcacttggtcatccgactgtaactcactcaccgacaagacaaagaatatcttaggctccgtcgtaaaagaacgagcccggttcaccgcagctccttttatagtctcctttgtgcgagatc

SEQ ID NO: 191 - DNA, 167 bp, Mus musculus
gatctgaagatattttgacaacagctaaaaaaaaaaaaaccaaaaaaaaccccttattactaaccaagggaaaatgcaaaaataattaaaagttcctcaattttaagtaaatatccaaaaagattggttgtataacaaagttgaagagtcaaacagtatttgaataa

SEQ ID NO: 192 - DNA, 75 bp, Mus musculus
agctcattgccgttaattttcctcagcctaatgagaatctaagccttgatttgtatgtaccatagcatctagatc

SEQ ID NO: 193 - DNA, 327 bp, Mus musculus
ccttgaacctagttcagggaataggccacctgggtgggactagtgctggttggggatgaaaagacagttggctcaggtgaaccctgctcgcaccctggtcatcctctgagactgctttgattgctgaccccagtgctccagcaagaacttgcgttcttgttctctccactcaagccggaagaaatctgaggagagggtgtgaatcctgagccaggatgtccaaaacaacggagttgagccagaaggacgtctagttgggcagagttagctcagtcccctgacccccagtccgtgcaagctcgagggtgttatatagtgatacagatc

SEQ ID NO: 194 - DNA, 198 bp, Mus musculus
gatctcttcttatctctaccttttggggcacaatcttatctggggacaccacagagcccaagaattgtcctgtatcagaaatttggaccttttctgtggctatctgtaaaccccactgacttaaagttttaagtagaaaaggatatgccttttgtagcatggtaaggtctttatggcacaggaggatgtcatccatgt

SEQ ID NO: 195 - DNA, 94 bp, Mus musculus
cttcctttccttttttgaaacagggtttctctgtgtagccctggctgtcctggacctcaatctgtagaccaggctggcctcgaactcagagatc

SEQ ID NO: 196 - DNA, 47 bp, Mus musculus
  misc_feature (40)..(40): "n" at position 40 can be any base.
gatctgctccactttacacagctgaccatgagaccatgtncacatag

SEQ ID NO: 197 - DNA, 138 bp, Mus musculus
acatgacatatcaccctcattcagagttcagagtcttcagaaaactgggcgcctgaaaaacctgaccttttaaattttcgtccatagtttcttctgttgaatgaatattcatttaaaagcttcataaatgccaagatc

SEQ ID NO: 198 - DNA, 25 bp, Mus musculus
gatcttcacagcgcacccagggatc

SEQ ID NO: 199 - DNA, 121 bp, Mus musculus
ctttttcttggtatttagggagtcaggaaaagaaaaaccattgggtttttacattagctttcaggtagggttgtggcttttgagcaacaataacgtatgaccttgtggtcggttctagatc

SEQ ID NO: 200 - DNA, 39 bp, Mus musculus
gatcttcttatatctggtttcctgggcgcttcctggtat

SEQ ID NO: 201 - DNA, 179 bp, Mus musculus
gatctctgacagggtttcaaagaactgttactgatgtttagattgcctctgaagacatcacatatactgtgctactctgccttgtcagagtcccgggccctgggcaccccagacggcagcagaggaagagcggggtatcactttctatacttcggtaaagtcattgggatatgtgccct

SEQ ID NO: 202 - DNA, 48 bp, Mus musculus
gatctcctctatcatttatctttcttccttccttccatctgtttgttt

SEQ ID NO: 203 - DNA, 309 bp, Mus musculus
gatctgctcaccaaaaatcttgtcctagggaagttgagtttgaactgcgtgcttactggcaaacacgcggtgcccaaatttaaggagtgccaacgacttcgcgggccagcaaggtgaaaccggagcgcgcacgagtgagcagtggccaggaggcctggccaagaggccagggtccctgagcatgaccgagagctggcgtgctctctgtaacccccaatcagttcacctaatctcgggtcgaaacctgagccctgcaggaggcggggctgagactgcatcccagctcctggcccgctccaggggcgaccc

SEQ ID NO: 204 - DNA, 28 bp, Mus musculus
ccaggcatctccattcttaatccagatc

SEQ ID NO: 205 - DNA, 282 bp, Mus musculus
catagactctttcatttagaataaagtgttccacctaacatcctgtaggaagtgatgaaactaaaaagaaaaataaacgcattttctctttctctcgttactttttccattcactaaacaaaattgacttttttttttccatgagagttcacactgggtctgcctcagtaagagtcacactgttcagcccacacacgctgtgatatgttatttactcattctcttctcaggaaccactctcacatgtgaaccctgaataccagctccctccctcttcagatc

SEQ ID NO: 206 - DNA, 325 bp, Mus musculus
ataggttctgtctcaaaacaaacaaaaaaccaaaacatgtccacagggtccaacagacacagtctccgccactcacaactaatgggtacacaaatacacacctcagccttacatggttacagagagaagcaggaccacaaggtaggcaggcacctaacacttgcttcttggaagttggagcacacacacacacacagaaacacacacacactttctcacactcacacacacattctctctctctcacacacacacacatgcacacatggtcttgtacaagctcctcctgggatgggcacacacaggggtaagaggactccagatc

SEQ ID NO: 207 - DNA, 45 bp, Mus musculus
  misc_feature (11)..(39): "n" at positions 11, 14, 22, 29, and 39 can be any base.
gatcgaacacnctnggacttgntaaacgnttcccacacngacaga

SEQ ID NO: 208 - DNA, 156 bp, Mus musculus
gatcgtctggcccgaccgcgcctcagtagatttgggtcctggtctgagcagccgggctggtgcgggtgtcctcactaggataatgaatacagctccactacctatactacccaagacgacccctcacacgctctgcgaggaaaccggtcttcggac

SEQ ID NO: 209 - DNA, 65 bp, Mus musculus
gatcgaccgcagatgaggtctatgcaggaaaaacgatgtctggaattttattaaaattgctcagc

SEQ ID NO: 210 - DNA, 222 bp, Mus musculus
agtagactgagatttgtgagcgctaagataaagatgagcaaagctttggcagctcttaggtatctgagggccaccgtcctctacaaagcaacgagaggcacggcggattaggatagactggttgcatccaaacactaccttgctgcctcaaaggcttattggacaccacagaaagacctctgctggaggcagaagtcacaggactcctcgtcacagacgatc

SEQ ID NO: 211 - DNA, 533 bp, Mus musculus
gatcggccttcctccaaagctacctgcatagaagagacctctgctctcacctactctcctctacagttcagcccatatggcttcacctgcatcccctacacacacacacacagacacacacacacacacacaaacacacacacaacacacacaacacacacaacacacactcacaacacaaacacacacaacacacactcacaacacactcacacacacacacacaacacacacacacacaacacacactcacaaacacactagtacacaaagactccaacacacacattcccatgcactactccctcagtatccgccgcatttgtgctcacactcatccacactctcacacttgtagcacacacacatcattcctacacaggcatggacacacatgctcctatacaggcatgcccagtactctcacatgcatgtttgcacgttcccaaacaggttcccacaagggtttggcaaagtacatgcatcctcacacgcaaatgcaagccgtcacaccccataccacaagcatgcac

SEQ ID NO: 212 - DNA, 360 bp, Mus musculus
acaccacatgcacatacatgcacacacaccacatgcacacatacacacacaacacatgcacatacatgcatacacatgcacacacaccactcacacacataccacatgcacatacatgcacacacaccacatgcacacacacacacaccacatgcacatacatgcacacacaccacacacactttgcaactacatataagctttagaaatgcctctcgcctccccccatagcggggaagagagtggtttaaactagaggagtctgaccaatgttcatttatctaccagtatacctcgcaaagagttttcagaaatgtgcatgagctgttaaaaacttctctctaatttccacatccgatc

SEQ ID NO: 213 - DNA, 34 bp, Mus musculus
gctggaccccggtgacagactgtgcagatggatc

SEQ ID NO: 214 - DNA, 25 bp, Mus musculus
ttagcaagtccgagcgtgttcgatc

SEQ ID NO: 215 - DNA, 26 bp, Mus musculus
actgcacacattgccggttgtcgatc

SEQ ID NO: 216 - DNA, 141 bp, Mus musculus
caagtgtagacattgcaggaaaaaaatatggtgacagtgaacaaagcccgtgaaggtgacaaaagccagttaaagtaggacaaggcagagcgaggcccatgaccgggaccaggcccaagaaaataaacgaaggccacgatc

SEQ ID NO: 217 - DNA, 162 bp, Mus musculus
gtcggaggagctggctggaccggtacatgccctggccatccaggcgaagacccccgcccagtggagagaaaacccacagttggacattagtcccccctgcctaggtgggagcaagaaaactcgagggacctcttaataaatacctggattgggagaacgatc

SEQ ID NO: 218 - DNA, 157 bp, Mus musculus
gatcgcggggctatctatagagtccccgggatgtctgagaaatcagccctagaaatgactagaaagaaaatcgaagtattcttggctcctggagacttccgcagcgagaagtcacagattcaggacacagattgacaggagctgcgggcgctggtag

SEQ ID NO: 219 - DNA, 37 bp, Mus musculus
gatcccaggatttgggaggcagaggcagttggcccca

SEQ ID NO: 220 - DNA, 70 bp, Mus musculus
caggctggcctcaaacctgcagagatgctcctgtctctgagtgttagatttaataaaggggttcacgatc

SEQ ID NO: 221 - DNA, 230 bp, Mus musculus
gttgctgggccctaagcgcccacatttcacagctccgatgctcatcagcatgactctcctgagcacattatctggtggtggctgacactctcttcagtacccccccccctcccaaaaaagaaaaaagaaaaaaaggactggttgctaaaagaagtaaaagtcaagtcatcaaaaacaatgtaatatcctgtgtgaaagtcacgaagccttgcggtttgagtccctcgatc

SEQ ID NO: 222 - DNA, 193 bp, Mus musculus
gatcggccggctgtccagcgaccggagaaaggagagcactcgaatcgcagaagctatcaggtgagtccgacctctctctgaatgaacgctttggggagcctgccaacggtgaccaaatttagccagttaaaagtacaggctgcccagctgtaaacgtacatcaaacaatgtgcgattttatttttagtgtgaa

SEQ ID NO: 223 - DNA, 467 bp, Mus musculus
atagtaacacttgggaggagccattcccagtgaggctcgtatagcatagccctgtccaatagagcctctgttgcactctgtgtacacttagctccttgcttagggattttttttacatgggtgactacagcaccccaatttcacattggacagactccaggacacccctcggtgtcctgtgacgcatacaacagccccccacggggctgcaccgaaaacgccacagtactgaggctgcacctcactcactcacacacacctctatggctcaacgtcctggagaaaaggctgcgacagattcccacatctgggaatgcagtgaaaaagcactcacactgggggtggggtggggctgggggggcaccctgtcttcccgtcttcccatgaccctcttcccttccaggagaccatagccagagctgacaggagattcagtcgcagctgcacacgctgctgccttgccgatc

SEQ ID NO: 224 - DNA, 323 bp, Mus musculus
gatcgggcaggacacacattggggaggcccatcaagcccgagcctgccttgtgagcccccggattggcagggcagagaggaaagctgctgcgtgctttatagactttggggaagtcacaggctccgcttgcttgggggaggcaggaaaccccctccacctaggcgtctgccagagcacccgcaggcttcctcttgtctctgtccccctccccagcacctcttcccctgaacagcttccctctcctggccctgctgtccctttaaaggaacttgaatcagagttgagaatgatggtgactcagggtggaaggggtggtcacttg

SEQ ID NO: 225 - DNA, 89 bp, Mus musculus
ccagggctacacagagaaaccctgtctcgaacaaacaaacaaacaaacaaacaaacaaacaaagttaaaaataaaattgatatacgatc

SEQ ID NO: 226 - DNA, 406 bp, Mus musculus
gatccaggacatggcagaatatggtcatcttctttgcttgcatgtcacacgaatggcctctggctccacccctgattgcttgctccccttggaagcctcttgagcctagctaacttttcctgttcacctttgtattatgtgctcccaccatggcccaccaggctctgcttgcagcactgcagcctgcagctccagcggcctttacatggctcctgtaaacaagtcccagaggcctcagtgtcatcatttcagcaaccgcctcacttcttggtgccgccttcctttattactttcatatttctgtgaccgaaatacccccaaagaagctactcaaggaaagcagtatgtgtgggctcaccattagaggtcagtcccctgcagcagtggaagcatgtgctggtgacgc

SEQ ID NO: 227 - DNA, 491 bp, Mus musculus
gatcgctactttttcagagacgccttcattaaggggagaatggaaagatgctggttgacttgaaagatttctctctgatttgttttacaggaagtgcattctgtacacatgagagactccgggtggagaggcattgtggcggttgagatgcacctgggagtgccaactgcccccgcttctaccacagctctgcatagcaggctggagcaagcagccagccaaccattgtgccctagcctcatctcctccagaagaggttatctgggctctgtgtaacctctgctctttggctatggtattccttcttggtgctttctgtggtcaacctccaggtacacttagggcctatcctagacagactgggaagaaagaatgacattcccattgacctctgtttttatttcctggaaatccagaccttgttccagttagtggagcatggggttagaccaaccacactgctaagagttttggcctgtagacatatctgg

SEQ ID NO: 228 - DNA, 297 bp, Mus musculus
tagcaaggtaagtacttgtctcaatttccaggtagtatagaagaaacatatatgttacagctttaacaccagaacaatcacacagtgttgtattttagctaaaatatgactctgtggttttcaaatggcatagttgtggacaacttaattaagcacgctcttataagacgtgatagagtatgtgccatccagatactaagaactgtgtccaaagagcttgggacacacactaaggggcctgcctctttcataacggggatgaaaatgactgaggcttcacatttgcacagtacgatc

SEQ ID NO: 229 - DNA, 272 bp, Mus musculus
aagccatctgggtctcaagttgctaaaacttaataactccctccctgtgtttgtcctttatctaatggtaaaatatgacctaatgaaataggttcctaaggctttcatataaggcatgatgttgaaggatggaggacagagtgggatggaaaatcagagcctgcacagaaaaccacaagcagctaacaaaagtccacaaccaaagcctgtgcctgaaatgtcacctacaatgcagtggactattcatatgccagcctggtcctcatgcgatc

SEQ ID NO: 230 - DNA, 326 bp, Mus musculus
accaagaacagagccccaaactaataggatggtttgttgcacgtgtacatgtgtatgcatgcgtgcatatacgtgtgtgtgtgtgtctgtgtgtgtacacccacacgtgtgcatgtgtgttgtgtgttttttaagcaaacctcagtgtgtcatacatactctcctatacttcccctcccttgttccatatgagggtgccttcttatctcacagggttgttttgttttttttctataacagaatgccgctgatgctcttttttctatatgaaccctacatttaatacttatccataagcaaaggaacagtatcttatcttgcggatc

SEQ ID NO: 231 - DNA, 529 bp, Mus musculus
ctgggggctctgctacgcgtcaaacgcctggagaacccctcgccccaggcgccggcacgccgcctcctgcctccctgagcgctgctgcatcctgcacgccctggaacccaggagcgccccagcgaccctgactccctgccagcacgtccaaggctgcttaccccagcaacctcccatcccctgagccctcagtaaatgccatctgtagcagctgtttgtctgagcgccctgtactagggggccggtgggctgggtgacaatgataatggaatagtggctgtcctactgaggacagcacagtactgtttgggacctgtactggtaaggaatacatgcctgcttcctctggactttgcgggtctcaccgggtgcctgggctacccttctaggcttcactgaggcgggttccctgggaggctctgaggttactttcagcgtctgccaggggtccacagcacttagccaaggggctatggattcactcgtggtctgccaggaccaggcttgttgtgagggccccaggtggatc

SEQ ID NO: 232 - DNA, 307 bp, Mus musculus
gtgtttcttttctttcttttttcttttttcttttcttttcttttctttttttttaaatctaagtaaggtgcaacaatgtaattcgaaggggcagtgtcttcccttcctgtagtctctgcttaattcctgaagtttgccaaaccaggagttaggaaaagttggaaacctgcagagagagcgtttgagaggtttgagatgttatacgagagggtttggcaatgtgtggagtacaggtaacttgcggttattgttttcttggccctctatcttcatcctttgtgcttgctatttaccttgctgtcggatc

SEQ ID NO: 233 - DNA, 261 bp, Mus musculus
gatccttgagtctgtacttagcctgagagcgctataacactatatacaaagtaccgactagaaactccacacacatttgttgactgacttaatgtgtagccctgcaatggttgacagttgggggtcagggggctcttgcactgagggtagtgtatagcctaaagagataatcaagatgataagtacatccacactaggacaggagctttaacaagagcttttagtgaagggaactttctgggagcctcaaggaaggcatat

SEQ ID NO: 234 - DNA, 333 bp, Mus musculus
agcaacacctcatgtgggaattcatacattgtaggtaatcagtctactagctgaactatatctccaacccaggaggtcaggtttgtttgtttgtttaacaatctagttttgaaacagtcatatcctaggctggcctcaagttatgtagtcaaagatggccttaaaagatgactcttggttattttccaagtgctgggattatagatatgcacaccaccacacctcatttgtctcggggctggactcaaatccagagcttcatgcatgtgaggcaagcactgtaccaactcgacttttgcatactccattgaaagtcatttttataacaggatc

SEQ ID NO: 235 - DNA, 355 bp, Mus musculus
ctacttatctatcatctatatgtctatcatctatctatctatctatctatctatctatctatctatctatcatctatcatctatcatctatcatcaatcatctatctagcatctatcttccagagctcatgttgtggcttgggcttctcatttcaccatcatcgaaggtagttgcattttttctattggcttcttagaagcaggaggcacatgaaacaacttgctaaccctttcctggtcttttgttgttgttggtggtggtggtggtgatggtggtgctggtggtggtggttgatgtgcacaggagacctgtccggtatggagatatggagagcgtctacgtcctcatgggatc

SEQ ID NO: 236 - DNA, 415 bp, Mus musculus
gtgggacgcggagggtggagatgaattgagaagcagttgtcgatttcctccttcttccaaacatcaaaggcagcggtggatgacaaactgaaggacagagggtttgatgatgcaagaggagccagcagcaaccaaggccagcctcttgcgggtgtgggcagggccttctttacaatgagttcacacacacacacacacacacagagagagagagagagagagagagagagagagagagagagagagagagagactgctctttcagaacagccctaggaggttagcttcagactaagacaggagacagagagtccttgattttgccaaggttgcacagctggggagaaacccagctatggcttcaccttggcccttgttaggactccttcctagtccggttgcagtctcctggatc

SEQ ID NO: 237 - DNA, 256 bp, Mus musculus
gtattagaggccaggccattcagaagatgtggcaagattgtcatgtggaaaatatttgaaaccattctaacctagtcattccatcatcaataataataataataataatactactaaaatgaaaaaacctagatattttgagactgtactgctgtattttaagaaatacacggaaatttagcactgaaatttagtgctagttttaagaatactttgtaccgttacttggacccacaattgcttagagcaagggatc

SEQ ID NO: 238 - DNA, 600 bp, Mus musculus
gatcctgagacagtacaggaactaagaagccctgggcaatttgcagtgtgcacacccagcctgaatttgcctggttctcaccagcctaccaatagagcattgtagtggcagggatgtctgctggtgtctcgcagacaacttttgaggtcctgcttctccagaagtgtgcagctggcaattagcagcctggtcttttcctgtccccaagaccagtgcttccaccaacctggtctcttcccacagcccagccctttctcttcctctttgacacccacttcctctaaatggtggtcacatgctttgtctcttgaaaaaaagttgtatgagtcagggtattttcaacgccgggacagaaaaattgactcaacctggctttttcaattaaccactaatgggtttcacttacagtcctgacaaataccaggcacaattcatccaggacaatagtgaagaatttcatctcttccccccaagccagtcagtctggttttaatatgcacggtggatagcccatagcatgcaatgaactgtgagcacccctctgggagtcagcagagacacacacacaggcacccataccacacactgtgctttgtatca

SEQ ID NO: 239 - DNA, 530 bp, Mus musculus
gatcaaaacaatattcaaataatgacatcagtcaaagtatgatttgatggccatcactcatgtcaataggcaacacataagcctgagagtaagttaaggagaaattcagcaataaacaaattgacatactatgtccactatgagtaaaacctgcctctcttaaaacgttttactgtactccatggctctcccccaatgtgcgttcgtgagagtccccacccctgtgactccatctgtgtgtgggttcaggagagactcctgtgtgtattcaaaagagccccccatgtgtgtacacacaagagacccagtgtgtgtacatgagaggccccaccccatgtgtgttcatgagagacccaacccctgtgcgtgtacatgactctccccatgtgtgttcataagagacttgtgtgtatgggagactccaccctgtgtgtgtacatgagagactcctgcctctcctgtgtatatggaataccttcagagtatcaaatattttcacccactgagccatcttagaacttctctccctt

SEQ ID NO: 240 - DNA, 354 bp, Mus musculus
atacatatgtacacacacactcacaaacacacatatatacacatacatacatactcacacatatatatacacactagtacacacatacgcaaatacacacatgcatatacacgtactcacacatacatacccatactcacacaaacacatatatacacacatactcacatatacattcatacatacacacacatatatacatacacacacttgcatacacacagcacacactcacacacagagacacacagacacacagacacacacacagaggaacccaaaggattggaagaataatttcctgtgctcagtgggaaagtttaccagaaagacaagtggtcatgtgggatgatc

SEQ ID NO: 241 - DNA, 41 bp, Mus musculus
gatcagggaccctgtaccctcccccgtgcagcctgtgattc

SEQ ID NO: 242 - DNA, 262 bp, Mus musculus
ggactgtaaccaactcggagaggaaagggcttatttcattttagtctttacagtccatcattgacggaggttaaagcaggacgctgcttactgacttagctccccgttgctttatcagctactttcttaatacaacgccacccccgcggccgccacctccctaggcaagacccacaggtcaatccaacagagaggattcctcaagtgacactcctatgtcaacgctatcaatggcaaaggtatattgagctaagaattgatc

SEQ ID NO: 243 - DNA, 149 bp, Mus musculus
gatctcaggctgcccgtgggcggggctgacggagggaagcagactaggcctctaccatatccgtgggagggacttccaaggaccgagactgaagaaacagcgcgaaacaggagacactgggaggagaggcggagaccgacacttagtag

SEQ ID NO: 244 - DNA, 600 bp, Mus musculus
agagaaaagactatcttgacctttggatatgcgggtgcaaaaatgagaagaccacagtgcagctgtgtgccctgcacggggcagcgagaggagaaagaagcattttacatgaagcacagaacacgcctgacagttctcaacagcagcacgtcagaccaccgcagcactgctcgtttttctcagcagacccccaggaagcaccacccaggatggacatgtaggggtgcatccgagagaatcaaaatcacacaggggccatccttttggttcggcatgaatgatgggggccgcctgcactggcctccaccttctatggttgttcttccttgtatcaatgtttcaaaaaaaatccttgggctcacaactgcctaatgacatcttcaggagtcaagtcaagaaagagaaaagtagccgacctggcacgtggtagataagactcaagggtgcaataagcagatgaactggcttagttgggctttctattgctgtgataaaacaccatgaccaaagcaactggggcggggggcggggggtgtcatcttacacttccatatcacagtctatcactgaggaagtcagggcaggattcaggcaggaacc

SEQ ID NO: 245 - DNA, 123 bp, Mus musculus
gatcggccaacacaggatagataccacacaggataggaggtacagtgtctggaagattattatcgagcccctgaacgtagtagaagctggctgtcgttccagtgcaagctgagcagatggtcc

SEQ ID NO: 246 - DNA, 237 bp, Mus musculus
gatccacatgaaagccaagctgcacatttgcttcatatgtatggagaggcctaggtctagcccatgtatgttctttggttggtggttcagactctaagagtcccaagggtccaggttagttgactttgttggtcttcctgtgaagttcctattccctttggtgccgtcaatccttcctcctattcttcaataagagcccgcaagctccatccactgtttgcttgtgggtatctgtaa

SEQ ID NO: 247 - DNA, 92 bp, Mus musculus
ccctcagctacatagtcaattcccatctagcctgggtatgcgagatggcagtaaagacactagctgcaaagccttactgcctgagtttgatc

SEQ ID NO: 248 - DNA, 314 bp, Mus musculus
gatccagtcacaggagagcaactgggggagggagcaggacagaagcacaccatagccctttcagggggccgggggcgaggggtggacaagagaagacagataatgactcacaggatgaagaagcctcccacagcccctccctgaactggccatctgttctggggccccagagcaggcgagtaccgtgaagcttggggactagcagccggaccactgaacaaggtcaaccagccagttgtcccacgaggggagaagctaccattgaactgtcactttggaaagtagccagagcccatccctggtcaccacccaac

SEQ ID NO: 249 - DNA, 277 bp, Mus musculus
gatccctagagctgctggtcagctggcctggctgaaactacttctgtgcagtgagagaccctgcctcaaaacacagataatggagacagataaatgacatcgtccgctgtgtctgcgtgtgtatatgtaacacaacacacagtatacacacatacacaccacactcataccgtcacacatgcactctcagtgcatgtgcaacacaacacagtgtacacacatacatacacaccacacacatacacataccaccacacacgcgcacacacacacataa

SEQ ID NO: 250 - DNA, 320 bp, Mus musculus
gatccttgtgcatcactgagccatctccccagcctacagtgtaagtattctatacatattaatttaatcctgccgggtggtggtggcgcacgcccttaatcccagcactcaggaggcagaggaaggtaaatttctgagtttgaggccagcctggtctacagagtgagttccaggacagccagagctacacagagaaaccctgtctcaaaaaaccaaaaaaacaaaacaaaacaaaacaaaacaaaaatcctatggagtattctaaaagtaaaaccgtatcattagcactgccaaataacagaaaggaagaccaaagcaaa

SEQ ID NO: 251 - DNA, 283 bp, Mus musculus
gatcctctgaaaatggagttacagatggttgtgagctgccatgtgagtgctgggaactgaactcgggacctttggaagagctgctggtgctcttaacagctgaggtgtctctccagcccctttgggtgtgttttgttttgtttgttttgttttgctttttcaagacagggtttctctgtgtagccctggctgtcctggaactcactctgttagaccaggctggcctcgaactcagaaatctgcttcccaagtgctgggattaaaggcgtgcgcaaccactgcc

SEQ ID NO: 252 - DNA, 40 bp, Mus musculus
gatccaatatattcatatggagatacatgtatatacataa

SEQ ID NO: 253 - DNA, 352 bp, Mus musculus
gatccaggtcctttcccccttatggtcctatacacccctgggtacttagaggctttcagctctgactggtggtgtggggagaagtgaggggttacacatgtgacacaggtcctaaaagctgtcgccattggcacatgaccatcctaagtctgtggcagaaggctgctcagagcctctgtccaggaacaacccaacacattgcagaaataactgtgcatctgggcaatggggcaactactacctgtccatccagatagctcttctagaggcattcgaaataacacgtaaagtggggtggtgatgaacacatataatctcagcccctgggaaccggagacaggggagtcacaag

SEQ ID NO: 254 - DNA, 211 bp, Mus musculus
gtcacagtacttgctcacttgcctctctcatggtttactcgcccctccttctcgtaccccctttcctcctacaatcctcctcgtctactttcatgccgtatatgtcaaacaccgtcatatataacaatgtatgcatgcagcatttctttttctttcccatcagcctcccttgctccccatcctcccgcccttcctccttcctcccaggatc

SEQ ID NO: 255 - DNA, 309 bp, Mus musculus
agttatgcttgcagacaggaatgtagcatggctatcctctgagaggttccacccagcagctgactcagacagatacagatacccacaagcaaacagtggatggagcttgcgggctcttattgaagaataggaggaaggattgacggcaccaaagggaataggaacttcacaggaagaccaacaaagtcaactaacctggacccttgggactcttagagtctgaaccaccaaccaaagaacatacatgggctagacctaggcctctccatacatatgaagcaaatgtgcagcttggttttcatgtggatc

SEQ ID NO: 256 - DNA, 359 bp, Mus musculus
  misc_feature (152)..(335): "n" at postions 152, 214, 216, 268, 275, 282, 292, 294, 300, 315, 319, 321, 335 can be any base.
gatcgtggtctcttctcttttttccctctacttcttcttcttcttcttcttcttcttcttcttcttctactgtcttcttcttcttcttcttcttcttcttcttcttctttcttcctctctctctctgtctttctctgtctgtctgtctctgnctctctgtctctctctatctctgtctttctctgtctctctgtctctgtctctctttctctgngnctctccctgtctgtctgtctctctctttctctctctgtctctctctctctgnctctctntctctgnctctctctgncnctctgnctctgtctctgtctntgtntntctctcgctctctnacacacacacagatgtacatgcac

SEQ ID NO: 257 - DNA, 440 bp, Mus musculus
gatcggcggtatcatattttatgtgttttatttctgtgtcagaaagtttaaaaggcctcagattggaagtctggtttgcatggaatgcatatgagctttttcatcttattgcccaacagatttagtctaagaaccacctctattatatagggtatgataagtaatataggtaagggaatgcatcccatttgataagtgaaagttgaacacacatagagttggctcaccccggggtctaggctctaatcccctggggatacccaggccaactaaacgctatagcaacaggcattggggcatgaagatactttttgttgtttgtcttgaatttatataggggcttatatctcattacaattaatcatgagttgcagtcaataaatcttcattgctcaacatatttgtaccctcaaatatttttttctttttttgtgtgatat

SEQ ID NO: 258 - DNA, 201 bp, Mus musculus
cttgtaaacacgattattttaaagatataaatggctctttactctgtttaaaaattgtttctttaccagttcttcgtgtacattggtctccatttcacatgaaataaaatattttgtttaatgttagattttcaataccagctgagtgttcgatgtgtgccttttggacatatatttgttgtaaagtggtcatttgggatc

SEQ ID NO: 259 - DNA, 458 bp, Mus musculus
gatcagattcaactcccgcatttctagccccagcatcgtggaagggctactgtgtcttttcaagcactatggtggatacacataatgccagcttccctcattactggtgatgtgagctgtttgcctaaggtcctttctgccaggcttctctgctgccaaggctctgaatttccctttgtagctaatgcgtagccctattggcagactcttcccgtggctgacttctgcctcccgtcacacagcagtaccttgtttgttctcaccttgatgtttcttatatgcattgatgatggtgaacagcccagcaagtgcgcctgtttcttcccttcctcccacttttgttctcagttgtacatggcaaggaaaaccaattccttctttcatatttctcccagaaaaaaaatcctctttataagagttcacatccttgagcacacatgataggagctggtagccag

SEQ ID NO: 260 - DNA, 344 bp, Mus musculus
gatcatgatattgtactgctgaagacaaacatatttaagatataagacttggagaaatcaagttggtattgacattggagattaatctcttttggctagcttttgtagagctagaagttggtatgtaagctataaggaagagaagtattcataagacttacccagttgtctctcctgtaagctaagaccagcctaagaagctaaaattatctttaatgtagaaccacagagaaagaaattgtggtatgaattttgcttgttcgtggacattaaccattaactcaatgataatcaaatgacaatacatagagacaaagatatgcatactagtaaaatagtgataa

SEQ ID NO: 261 - DNA, 421 bp, Mus musculus
gatcgtgctagagaatggtacacttgggttatattaagaaatcttggttgagtggtggtggcaccctcctttaattccagcactcaggagtcaaaggcaggcagacatttgagtttaaggcctgcctggtctacaaagtgagttccaggaaagacagggctataaagagaaatcttgtcttgaaaaaaacaaaaaaacaaaaaacgaaacagtaactgaaaccgaaaaaaaaaagaaagaaagagagaaagaaagaaaatcttacaatgtgggagctggagagctggctcagtggttaagagcattggctgctcttccagaagacccaggttcaatttctagcacccacatggtgggtcacacctgcctgtggcttcagttctagagtttctgacactcacacacaaacatacattcaagt

SEQ ID NO: 262 - DNA, 565 bp, Mus musculus
gatcttgtatttcttcttggcttgtctccataggaacaggcagcacagcagaggtctgggagatggctccgagggtaagggaccaagcaaggtcacctgcgctcactccctggaacccacacagtggacaagagagaaagactctatggcctccacgtgcgtgcgtgcgtgctgtggtgtgcacgtgcccctcccccaaataaagaaaacttaacgaaaaaaaattaaaagtaaaaaaacagcactgcagtagctccaggaatcaactggtcaatcagtgtatcacatttgactatccgatgatggttttattttacatgtatgcacgtgtttgcatgtatgtgggtgcacatgtacaaacacatgtgccaaggccaaaggacaactttgggtgtcctttctcaggagtcatcgaccttattttctgagacagggcctctcactggaatctgactggccagcagcctcccaaggatgctccccaacctcagaaggatgcgcctgtctctgcctcccagccccgggggttacactggtggaccactgggctcttttcacctgggtg

SEQ ID NO: 263 - DNA, 165 bp, Mus musculus
gatctcttcttaaaattacattacagtagaaaatgtttatgaggccgtttttatctctaatattatttattaccactctcctacccccagagtcttacaggcatcagggagtggacaaaggccggcggtactgaatggtgatgttatttttgaaataatgaaaag

SEQ ID NO: 264 - DNA, 137 bp, Mus musculus
tacctgttgctccaacatggtcagaaatcagtttgtttcaattttaagatacaatgagagtaacaccctaaagacttcacattttatgcatatttgctactctgtgagcacatgaacgcttctccttgggcacgatc

SEQ ID NO: 265 - DNA, 104 bp, Mus musculus
gatcgcagatactgcaggtatgtagtaatgaagtctgtaaacatacagaatggagaaggccagagaggaaagtgcaggcattgggtagtcagtaggtaaaatat

SEQ ID NO: 266 - DNA, 600 bp, Mus musculus
gatcgcagctcttccttggtgcttttcccctcagttcaagtgctgtggcggggaggactacagagactggagcaaaaaccagtaccatgactgcagcgcccccgggcccctggcctgcggggtgccctacacctgctgcatcaggaacacggtaactgcatgggtgctggatgtgagggtcacccagtttgccaaacactgccctcactctgcccaagtggagcaggcagtgggagtgggtgggacgtggtggccggggctgagcttgccttagaccaggggccctagcaatgggagatgagtgggcagcttcctctgggagtgtgtcagtgagcgtgtgcgtgtgtgggcctggcccaggcgctttggttgtagttacttggttcttacaacagctttggagggtctcaattggggtagtgttgctttagccacttagggggacttgcccaaggttggcagggctcttcccagcaacagagagccagagtgcccggcaggtgcagcaggctctacccagtcactggaggcagagtacagtgcaggtgctgtgagcactggcagcagagccctgggcagcggcatgcggtaatgtaaatg

SEQ ID NO: 267 - DNA, 222 bp, Mus musculus
ccatgtcaggtgattaacctgtgagtctaacttccaggaatgcaatgcctctggcatctacaggcataaacatacttgtggcttacactcaaactgacacaccaacacatatgtgcacgcgcacacacacacacaccaaattaaaaataaaataaccctttttaaaaaaaatatagaacctatagataattgctttactgcactcacaaacattttaggatc

SEQ ID NO: 268 - DNA, 346 bp, Mus musculus
ggggcacatagtgagttctaggatagccagggttatagaagctatagtgtgagaccctatctcaaaaaaacaaaacaaaacaaaaaaacaaaaaaaacctaagcccgtgtggtggtgtgtctcagtctgagcgcttggaagacagagggaggtgcatctctgagcttgaggctagcctggtctacatagagagctccaaaccagtcaaagtaacaaaatgaaactgtctcaacaatgacaacaacaaacaaacaagcactagaataaaaagaagccagcatggtgtcatgtgcccgtcatcctaccacttggaaggagagaagccagtgcaggaaaattagggatc

SEQ ID NO: 269 - DNA, 538 bp, Mus musculus
gatcccaggcttcctgtaggctaggcaagccctctccccaccctgtcctggtagaattcatcccgaatgtcagcattccttcagttaaaggaatgtgctccctcaggctctctcccatggtgcattgcttcagcacgcaggcagacacttgtccaagctaggctccctgtctcccatctgtaggaaatgcttggtatgaaggccctggtggacctggctagatgggcagcgcccagtgaagggctgtgtctggagcctgggctgtaattagtggtttgaactgggtgctctggggagaggcaagtaagaatttgctttctgtttttagagcaggaggagctggcggctggctgtgccttagccggctcctcgaagagcatttgaggtgttcgccatcttaatgggttaagactctcctgtgctaatctggtgggttgcttttaggcacggtggtcccactgtggttgtgtgaacagtaccttaatgccaacactttggaggcctaaggtatccccatctgcaggaactggggtgcaca

SEQ ID NO: 270 - DNA, 282 bp, Mus musculus
gatcctcacacaaattgagtagtactaacaagagtgtgattcacatagtcaataaaggtataggccatctgtgccctggcttgacctccgcagaccagaagctaacaaaaccaaaacagactcagtttctgcatgctaacttaaccatgattttccagactatttcttttatcctgtgaaaaatatattaatctctattctgcagagtatcccttctttaagagaacatgatttcactgtttttgacaatatgcctagacacagaaaaaaatcatttagttt

SEQ ID NO: 271 - DNA, 123 bp, Mus musculus
ttttgagtgctcagtgaactacttagggcagcctaaggaatacagtgacccaccaggaaatgccttgtgttttggcagtctgatagcatcactcacagctgtcggtcgtgacttcattggatc

SEQ ID NO: 272 - DNA, 40 bp, Mus musculus
gatccagggacaaagagcccattctcctgttccttcgtat

SEQ ID NO: 273 - DNA, 600 bp, Mus musculus
actttcaggcaagctctttgctcagtgaacctgctaccacacacagactcctcctccctgttcccgtcgttaaaaaaagttttatttgaggtttagagcaatggctcagtgctcaagactacttgctgttcttacaaaggacctggggctagttccaacacccacatgatggcttacaattctccagtctcaggggttccagaactctttttctggcattgaatgcacatgatgcatatatagacaagcaggcacacacacacacataaaataaaacaaatcttttgaatgtaattttaaaaagatttattaattttaattttatgtgtatgaatgttttgcctgcatgtatgtctatgcactgcatgtgtgcctggtgctcaaggtgtctgatagcctggtgctgggcttggttcactcaacagctggccctatgaaggccagccgtgaggacacctatccatgctgacagacacagatgctcaaatgagacagccccttctctatgaatgccctcttgagaatgaacaacctccctgcagcagacctccttctggataccctgcccttccatactttctgggtgtctagttctcttcc

SEQ ID NO: 274 - DNA, 599 bp, Mus musculus
gatcacacgcttcacctaattacaaatgatttctttagaggggtctgtatataacagagatgataaaattcaacggcagccctccaactgcattgatatacaggaagtactcatgaaattggagacactgattatctctttgtgtggtgtccacatatgtgccatcatatcatattattattattacatggctaaaaaatggggtcataggtttcatgaccagaaccaaaatattcccctgtaatttacacaggattgatggtaagaaatgaaaacagtttacatttttgataatttacttacttgacataaaatgtgactttcatttccttgcattccttttcacaggtaaggctacgacaatagattctcagttctccacctctctctatcttgtctactctatcagcagcaatagcaacagttttccatggtccttccatctgtaaaagcaataaaaaataacaaagaaaaccatacaaaccattagaatatgagttggtattcacaactctcctctcaatacttcatattttaaaaattactagaaatattcatcaataatatttcatttgttagctctagataatgtttccagg

SEQ ID NO: 275 - DNA, 593 bp, Mus musculus
gatcatggttatttttgtagggtttatttatacatgtctacatgaatttatgtgcaccagatgtgtgcaggtgcccatagaggcctgcgaggatgccagatacagatagttatgagccacctaatatagatgttgggaattgaacccatgtactctgcaagagcagcaagtactcttaactactgagtcatctgtttagccctcctgttgggatttaatggtcagtgtgaaatactatgaagatagaagggtttcctagactctggtgtgtaggggtggggtatctgtgagatgggtaagctctgttggctttctaagaaggagaatgagcagaaggcacacatagacattcacactttcacacacatgcatgccaaacaccacacatgcacaccacataccacacgcgccctcctgtttcttactatgtaataatgttcttgtaataacttagtactctgctaatgaaaaggtcaccactaactagatgctagccttcaactttggaccagaactatgagcccaaataaacctcttgcatttataatttagccagcatgtagaactgtgtcaataacaatggaatagtgttg

SEQ ID NO: 276 - DNA, 410 bp, Mus musculus
gatcatctggctaaaattttataatatgactctttaaattccttaagaattcacaaggacctttatgttgaaattactcatatgtaagcttactggaatgagatggctccccagttgaaaacaccattcttaaaatactcagaaaataagaacgaggccagcccggtctacaaagtgagttccaggacaaccagagctatacagagaaaccctgtctcaaaacaaaaacaaaaacaaaaaccaaaaaaaaaacaaaaaagaaaaaacaaaacaaaacaaaaagaatgtagatataaagaaagaatagtgtttgctggaaataaatagtaatataaacttaacagcagcctgtcaattgcagggtttttgcacttgcagctcagaaagaagtgaccctcctcaggaagtag

SEQ ID NO: 277 - DNA, 377 bp, Mus musculus
gtgggttgtgtgactcagagagcaagcttctacctccacaggcaaggatgcctgtgcacacagaaatgagatgaagtcatatgtggggactggagttgcagtggctcccagaaggaggtgtgcagagttcaggctggagtccagatgaggaacatcaaatagagaggcctttggagggagtgggttctcttgataagtaggactgccacccatatcaagtataagactgccaatcatactgaatctcaggttatttcccatgtagcattgggaacatatagcatttgtcacactgctatagcaaagaatctgtgatgaggttgggagtggaggggaacgcctttggtcctagaaaaagaaccaaaggtaggctgatc

SEQ ID NO: 278 - DNA, 307 bp, Mus musculus
cctgcccttgccagacccgaccgcagctcatcgaggaggtaccctctaaagtcgtcaccttgaggagacaagctctgtcatagtgctcgcagccccgcggcccctgcgccaggttgcggacgccatcttcccgcgccgtcgccgccatctcctcctcctcctcctccaccacctccccctcacctgccactgaacctttcccccagcttggaagccacgccttaaggaagcagagtcggtcggacacccgctcctcctcagagcagcggccaccagagtcaggaagggggggtccaatcacgtgatc

SEQ ID NO: 279 - DNA, 190 bp, Mus musculus
gctcaattagtttatttaaattcaaaacaaagctaaaagcctgatgtgtcagttgccttcagcagagctgtttggggcccattgttaatgttgtgaattaagttctgatgtaagtaaccaagccactccccacactcttacttgcaagagttccaggcagatgttaaggtcaacccacctgactctgatc

SEQ ID NO: 280 - DNA, 269 bp, Mus musculus
gatcacagtgtttatctcagcaacagaaagcaaatgaggacacacctgggtctcactgatatacttggtgatatgtgtagttattatgtctcacagtaattggacaaggaagagagttcattgttttagaatgttgtaactggcattgttcttctctctcttgttttcataaaatctcacaatatctacagctgtgaggtccaaggggctcattggtgatacccactctttctactttgtgtgaccaacctcttttggatgtcaagggt

SEQ ID NO: 281 - DNA, 238 bp, Mus musculus
gatcagttgctattgcttgattgattgcgagactttcttaacaagagtctttgtctcctctcactccctagcttcatcttagaacttaaacccacagcccaaatgagtagttgtatgtcatatgcctcggccaaagcacgactgaaaggaaaagaaaggcagacactggagtgcaggaagaagacacaaggcaaagcccagaattcaaaagtagaagcacagattgttttctttgttt

SEQ ID NO: 282 - DNA, 100 bp, Mus musculus
gtaccctgcatccccggtgtggccttggagtctgatgccagcactacagagccaagccataatacaaaccaaatagaattaacaagagctccatatgatc

SEQ ID NO: 283 - DNA, 252 bp, Mus musculus
gatcaccttcctaggatgaacgaagaaggatggctggaggttagggacccaagggacttccccctagagctggctgtgtaccctaggcatgtgtgactgcagctgtacaagcagggtattctgggattcacagtcctcaggataagatgacactacagattctaagctttatacccaacatggtggaaccccatggtcacactctttcacagatggtcactcccattgcccgaagcccagcctttatccaag

SEQ ID NO: 284 - DNA, 88 bp, Mus musculus
gatcaataacagcaaaagaaaaaaagaagtttacttttcatgtagcaatgtggataattcccatccagagaaacaaaaccagttccag

SEQ ID NO: 285 - DNA, 51 bp, Mus musculus
gatcagggaagatgtcacctccaacccagcctagacatggtgctgtgacca

SEQ ID NO: 286 - DNA, 366 bp, Mus musculus
gatcaaggagcaacccaatagcttctattccccccctactaaaatatgacccactgatggattctggggatgcacagatgttctcagaagttactgatgaacacaccatgctctaacaaatagtatcaaacccacagtcacagatggccctagttaagcacagtgcatcacaaagcaaagcaaagagccttgactgtgggaaaggtacttgtggtgaggactagtggggtatgaaagaaattagagaggatgaaggtagtgatattcagtgtgtgtgtgtgtgtgtgtgtgtgtgtgtgtgtgtgtgtgtgtgtaagactattaaagaacacccttttttaaagaaaggctttcttgagtgtcacc

SEQ ID NO: 287 - DNA, 182 bp, Mus musculus
ggttaataagctagattatcgtgtatatataaagtgtgtatgtatacgtttggggattgtacagaatgcacagcgtagtattcaggaaaaaggagactgggaaattaatgtataaattaaaatcagcttttaattagcttaacacacacatacgaaggcaaaaatgtaacgttactttgatc

SEQ ID NO: 288 - DNA, 61 bp, Mus musculus
gtgaacgacagcagaatcgggttgtacctcaaagcacttacctttcccaatacacctgatc

SEQ ID NO: 289 - DNA, 42 bp, Mus musculus
gatcagtgacaatgtagctttgcctggaaggatacttgagtc

SEQ ID NO: 290 - DNA, 190 bp, Mus musculus
gatcagcaaaatgggacatcgaagttgaaccaaagtcataataaaacatcctgaggtacataaacactctgtaatagactaatacagttcctccaggcaccaacagaaaccttgactacttcccttgactacttcagtcaaatcttctgataaaaccagacccaacttggaaacgtccatgtatacaatg

SEQ ID NO: 291 - DNA, 96 bp, Mus musculus
gatcatctgcttctacccccaattaaaagacggactaagaacataaaaagaatccaggcacctaggtttgcagaaatctaaaggttgagttccttt

SEQ ID NO: 292 - DNA, 134 bp, Mus musculus
gatcacaagttatagttgaataacaagtcctgtgtgtgtctatgtatccgtatatcatattttctttatctgttactctattcatggaaactaggtggatgtgttaacttggctattatgagttttgctgctat

SEQ ID NO: 293 - DNA, 247 bp, Mus musculus
ctacaatggttcaggctttggaatatcactctataggctgtctgccggccaccacccttcagactgccactcacaggtgcccgtgaaggctgccgagaggcagtccccatcagcctgtctcctacacccacacactctgtgtggagaccacaggcgcccaaagggtatgctagtctctgctctaccgcgtaccctctcctgaaggcaggcatttcagagattccagtttcaccaggaagctcagatc

SEQ ID NO: 294 - DNA, 181 bp, Mus musculus
gatcttttccccctttgtagtatcagagagaaaagccatggcatgcatggcacatgctaggcaaacactcaagcatcctactctgtgatgcagtttgaaacaaactttttttttctttttctttctttttttcttttttcttttctttttctttttcttttctttttttttttttttgagt

SEQ ID NO: 295 - DNA, 344 bp, Mus musculus
gatctctccccatcctcctgttgcctcttgtctgtcatacctctactactccatcagtttgctgcctctgagtccctcttcttcctctcctatccctcctcccatcttcctcatctccaggtctctccaggtcttccttcttccctcttttcttccccttttcctctttccactgtcttgtattcccttcctttctctgttggtcccttccctcgcacctctttcctcctgtccctccttttcatgtaccatatttctcttcctctttctgtgtctcctctttccttcctcctttactttccttctaaccttcctctttctcctcctccggcaagcctttgctt

SEQ ID NO: 296 - DNA, 149 bp, Mus musculus
ggttgttccagttaaattggctctctacaggaacatggcttagttctcccttagcctttcatgaccctacacctcagacactagtcaaagtctagcttaataaagtgttcaggatgttggtggagggggggagattgttaatacagatc

SEQ ID NO: 297 - DNA, 211 bp, Mus musculus
ggaccactttagtatgggtcatatgttctaactttctttcattttctaattctttccatctgcattgattgtgcccagttatcattagtgacttattttagtaacttaagggaaagttgtctatgctctacttagtgtcgatttaacttactctccagacatgggagtgcttatttttgtttgccttacctcatccaggagcttgtagatc

SEQ ID NO: 298 - DNA, 27 bp, Mus musculus
gatccgattatgaaaccggttttgaac

SEQ ID NO: 299 - DNA, 37 bp, Mus musculus
gatctgtggaatgctatccagctcttccaacaaatac

SEQ ID NO: 300 - DNA, 133 bp, Mus musculus
ttagtatctgcatctgactctttcagctgttcgttaggcctttcggagggcagccatgctaggctcctgtctgcaagcacaccacaacatcagtaacagtctcaggggtctgagcctccccttgagctagatc

SEQ ID NO: 301 - DNA, 120 bp, Mus musculus
gatctgtggtaatgattctgtaaatacagataaacaacgtacacatgggaattgttccctgtgtgaaagtgttcatcataaggtgtttttattttatctacaatatctttgggtttttag

SEQ ID NO: 302 - DNA, 204 bp, Mus musculus
actgccacattccctaacacctcatcaaagaaaacaacaccacaggtctcaggctgccactctagacctccgagttgactctggctcctgctctctgcaagcaaacacgcatccctcaagtcttcatgctggttctctcaagtcttcatgctggctctctgtagttctgtaagcttaccctttcagtggtgatttggggagatc

SEQ ID NO: 303 - DNA, 164 bp, Mus musculus
gatctcctggctttgtagataaatgaagagagttcgttaccaactgaactaaagagcggcacaggaaattaaaaaaaacaaacaaactgatagttaactcaattgagtaagtatggagttttgggaccaagacatattaggcaaacagacagtttaaggcctag

SEQ ID NO: 304 - DNA, 176 bp, Mus musculus
gttcctgtactttatcatgtcttacccctacctccctccattttaatcatctttactgggatgtaatgcattcctttgtccattccaggatgctataacaagataccttcagcctgtaagctatagaacagtgtggtcctcaaccttcctaactttgtgaccctataatatagatc

SEQ ID NO: 305 - DNA, 92 bp, Mus musculus
  misc_feature (4)..(90): "n" at positions 4, 12, 18, 21, 43, 47, 73 and 90 can be any base .
ccancgtgccanactcanaanggaattttattcatagattctntcanactgctgtcccacatgtgttcaaaancaggtaggtcttgtcanat

SEQ ID NO: 306 - DNA, 346 bp, Mus musculus
gatctcattgcacagaagagttagaagaaagaaagaaaagcagactgggaaaaatttttgcagcgagcattcagagattgaacatctatctaacttatgcaaaattcctatcaaaagaaaaaaaaagcttcaacagctgggtaagttaaaatgtaactataaggcaacacaaggcaaagtgttgttctttttgcttgtttccgagatgagctcaattaaaatatcaatagcgacaacaattctgagctggactaacaaagagtagaacaatactacccaacgcttgtggttaggtaaccttacacaatattttcctaatgctattcggcaataattgtcaagaaaa

SEQ ID NO: 307 - DNA, 140 bp, Mus musculus
gatcttttcctacaagacttctgggtgaccttgccaagcccagccactggctgtggtacctcaccaggacactcggtggacattaggtagtgctccccaagtgctaggtgacagtttatgcttcaaagtgactcctgcac

SEQ ID NO: 308 - DNA, 157 bp, Mus musculus
gtgctgacgcgcccttgcatttgggagagcagtcaagctatctgtaccttcaccgtaagactacattgtcactgctggcttccctcctgtgcaagggacgcatttgggtcagactatgcatgaaacaggacaacaaaggtagggccattggtagatc

SEQ ID NO: 309 - DNA, 70 bp, Mus musculus
gatctcactgaatataaaaagacatcagtccaagggtggaaatttaaccaaaataatacaattgttgttg

SEQ ID NO: 310 - DNA, 44 bp, Mus musculus
gatcctccaggaactagagttacagacaatgcccgccttgtatt

SEQ ID NO: 311 - DNA, 54 bp, Mus musculus
gtggcagtgactgtccgtgtgggaaacgtttagcaagtccgagcgtgttcgatc

SEQ ID NO: 312 - DNA, 151 bp, Mus musculus
caggagagtgtctcaaaaagcagcaaagcacccagcaccttagggtgaaggaccacttctggaatgtatcctcccagttgcaaatgtacactgtctcattcactcctgtgacatactttgtttgtgaatgctaatatcacatagttcgatc

SEQ ID NO: 313 - DNA, 351 bp, Mus musculus
ccagcagagaccaagcatccaaaacatgagcccatttcaggcttcaaccatagcagctcccatctcaatcctgttcaccccccaccccaccccccgcttctctatttaaatcaccactctcagtgaccaaaaagatgctcatggcaaatggactcttggctctcttttacctaatactgaaggtaacaagataatcaactgtttcctctccttcccggggacctcatcatacaacattctcccacatgaaattatcaccacgtccaatacccacatcctccccgtcctgtagagaaaccacatgcctagcagcagtggtttcccacctctgtgctcccttccacctcgatc

SEQ ID NO: 314 - DNA, 281 bp, Mus musculus
gatcgctgtggttggtgtctgtgtatatgcactgtacatactaaccaggtacacacataaatatttaatatataaaaaataaagtgctttctaagaggcccctaggcagggacgttataaaacatttcacaaagcagcaaaacaaaattgatacaatcaaaaaaacaacactataaccaacataggtgaaaacagccaaacacataatgtacaatctggtgttccaggacaaacatctgtcatatacatggtatatacatacatactttttcactcaataa

SEQ ID NO: 315 - DNA, 223 bp, Mus musculus
gatcgctaagtgtgcgcggccgccgtctgcagaatgaatggagggaatgaatgagggtgcgcgcgcccgaggcccggcttgcgtcagccatgcgtgcccggcatggacacggcctggccttcctgggaggatgggaccggatgcagttagtccaggcgttcagcatcccagggcccttcctctgttgcgtggtctgagtaatctgtctcgcagaagataccct

SEQ ID NO: 316 - DNA, 84 bp, Mus musculus
ggaggtctctgtaggtgcttagactcacgttacagtcattccagaggagggagctgcagctgctagtttctgtgcacaccgatc

SEQ ID NO: 317 - DNA, 35 bp, Mus musculus
gatcggctgtcaagactggggaagggtcctcctag

SEQ ID NO: 318 - DNA, 62 bp, Mus musculus
aagcaagaggtaataaaatacatgtggatggatgactcaggggttcagagcatacaccgatc

SEQ ID NO: 319 - DNA, 50 bp, Mus musculus
gatcggggaccttgcataaaggggtccagggctctcagtccttgggaagg

SEQ ID NO: 320 - DNA, 170 bp, Mus musculus
gatcgtgatgacttcataaccatcacgtgtgaaaagacttaatggcgctgaattcacatgacacttaaaatgcacaaagtaacaaattttatgtcacatgtattaaactacagctaagtacatggggaaaaagttagacttagaataactcatccagagtcatatggtag

SEQ ID NO: 321 - DNA, 368 bp, Mus musculus
gatcgaggagtaacccaatagctcctattccccccttactaaaatatgacccactgatggattctggggatgcacagatgttctcagaagttactgatgaacacaccatgctctaacaaacagtatcaaacccacagtcacagatggccctagttaagcacagtgcatcacaaagcaaagcaaagagccttgactgtgggaaaggtacttgtggtgaggactagtggggtatgaaagaaattagagaggatgaaggtagtgatattcagtgtgtgtgtgtgtgtgtgtgtgtgtgtgtgtgtgtgtgtgtgtgtgtaagactattaaagaacacccttttttaaagaaaggctttcttgagtgtcacc

SEQ ID NO: 322 - DNA, 316 bp, Mus musculus
gatcgggccacatctcagacactcctatagctacagagagataccgtttcctgttatctttgcagacaactttatctgttactcagagaaaacctccaggtgcccctaaagaaactgggccctacatcacatacccataccacacacatgcaacatgcaaaacatacacacatacatagacacacacaccacacgcacacagacacatacagacacacacacatactatacatacagacacatatgctacacacatacagacacacacaagcacacatacttcacacacagagacacacacaccacacacacacac

SEQ ID NO: 323 - DNA, 152 bp, Mus musculus
gcctgcctctgcctctcgagtgctgggaataaaggcgtgctagagccttcacttggctctctctctctctctctctcttttaacctcctttttcctttaatgagttatttatttttattttatgtgcatttgtgttttgcctgtatccgatc

SEQ ID NO: 324 - DNA, 43 bp, Mus musculus
gcttcaatattcgaaaagaattagtaagaaaggctgttcgatc

SEQ ID NO: 325 - DNA, 194 bp, Mus musculus
ctaccaggaagtcaggggtttccaggaacccacacttggcttcctctgcacagagggacctcataccagtgagatggtgatatgctcccttgttcctgagcctcagtggaagcgactttctatggatactccctccctcgtgcctctccttctttccctctctgctctcccccccccccctcgccctcacgatc

SEQ ID NO: 326 - DNA, 159 bp, Mus musculus
atacacaccatcagatatacctcattctgatatacctacaggtacaccaatcacacacacacatttactcacatgtacatgcacacaccacatcggttagaaccaaagacctcacacacacccctcacacatgtttcatctccattatcagtgccgatc

SEQ ID NO: 327 - DNA, 23 bp, Mus musculus
gatcgtcaggttatgaatgccat

SEQ ID NO: 328 - DNA, 113 bp, Mus musculus
agttctcagaaccagctactgtttacacagggcctcatgcagccttgctgtcctccattctgcaagcacaggatacacacccctgaaggccagattgtcaggtcagcccgatc

SEQ ID NO: 329 - DNA, 46 bp, Mus musculus
cttcaaaccggtcctgcgaggagtccacaacctctgcctgccgatc

SEQ ID NO: 330 - DNA, 165 bp, Mus musculus
gatcgaggccagcctggtctacaaagtgagtcccaggacagccagggcgatacagagaaaccctgtctcaaaacaaacaaacaaacaagattccattgaggaacacccagatggagacatgggtgttctccatagaagggttaggggcttccacaccgttgacac

SEQ ID NO: 331 - DNA, 176 bp, Mus musculus
gatcggtgtgctttctgcagtttcagcgaggactctgggcccaaaatgttttaaagcagaaaattggtaacactagagatattgtcaaaatacgatttcctctggttcagaaatggcgagagggagggctggaagggtggagtgggaaggaattgtcatcaaagcattgttgatac

SEQ ID NO: 332 - DNA, 106 bp, Mus musculus
ctgtctcaggcatgaaaacactaaaagatgaccaatttcaataaagatgacctgaatgtctactcaattcccaccataaggtctacaagatgtaaatgggccgatc

SEQ ID NO: 333 - DNA, 96 bp, Mus musculus
gatcgtggaaacagagccttgaatataatgaagaaacagagggcaggcagcagccgcagcacagcaggggcactgtgagcaggcagcaacaggggg

SEQ ID NO: 334 - DNA, 145 bp, Mus musculus
  misc_feature (27)..(27): "n" at position 27 can be any base.
ctccctactaccttcccttcctggacntccactgagatgaggcaggataaagggtcaaaagagacctgaccttctctgccaaagccagggatttctggaagaatagaaatggttctggaattcacagatgcagtggtctaggatc

SEQ ID NO: 335 - DNA, 82 bp, Mus musculus
gatccataggtctctgctttccccattcagggctggagttatagatatctgtctatcacccagcttttatgtaggttccagg

SEQ ID NO: 336 - DNA, 34 bp, Mus musculus
tatgtatctacaagccagaagagggcattggatc

SEQ ID NO: 337 - DNA, 71 bp, Mus musculus
gatccgagttctctccggccacgtaccttcacatcccatgcaccctggtatgtaagaagagcccagctcac

SEQ ID NO: 338 - DNA, 26 bp, Mus musculus
tcccataatatttcctcagaaggatc

SEQ ID NO: 339 - DNA, 154 bp, Mus musculus
tatagttctgcctgtggagtgtgagcagaaatgtgtatcgtttctgggtcagagctttcaggaactgagcatgactgctctacagtgtctttctccttctgcctgctgaagccctaggggacaatagaaccacaggatgaaaggactcgggatc

SEQ ID NO: 340 - DNA, 304 bp, Mus musculus
gatccaatggcagctagcagagtcagagagccctcactccagttaactaggggacccacatgaagttcaagctacatatctgctacaaatgtttgagggacctcctagctccacgccacatgctctttggttggtggttcagtctctgtgagccccactgggctcaggttagttgacctacagtcttcttgtggtatccttgacccctctgaccccagagtttaacaataggccttctgactctagaaatctacctacattttttccactttaaattcctcggctcacataataccaatgaact

SEQ ID NO: 341 - DNA, 267 bp, Mus musculus
gatccatctgcacagtctgtcaccggggtccagcaagtagcagcctttctgctgctgtctgtcagaccctccagggagggagagcttgtcttctggcctcccaacaggaccctgcgtgacgatgcagggacagcaatgacaactcattccagactccaggtccctggaggagcctcccacaagggaaagagactacttcactggtcctgggcccctctttgcgcgccccgcccccagactcagcgtctagtgttgctgggctcccct

SEQ ID NO: 342 - DNA, 239 bp, Mus musculus
agggtaacaggcttagtttggggcctttctgttacaggaaaaccatgaaatgtcctgaagtgctcaacaaacagggaatatagaaaatcataatggttcctccctagcacaaggaagcatgtttaaaaattgcagcaaaataaaaaagaacagattcttaagattgagggattttacggggtggtactttttctttctcttataaacatttatttacttttgttattcaagacaggatc

SEQ ID NO: 343 - DNA, 170 bp, Mus musculus
gatccagctgtttgctaacatacgtaaaggtatggatgctgagagagtatctatcgaaagcgaaggcaccctccccaaattcaagaaagcagctgtttctagaaccaaagacaccaccgccgccgccgccaccaccacccgcgagcgcccggaccctgttacagagtgtc

SEQ ID NO: 344 - DNA, 103 bp, Mus musculus
gatcctgaaattatcacatttgaatcaaatcatgccctgccgaggataaataacccaaacgaccgagaaaaccgagaaaaagaacatttactgaccatccttc

SEQ ID NO: 345 - DNA, 38 bp, Mus musculus
gatccagtccagagcaatgttcacgtctgtgatggtat

SEQ ID NO: 346 - DNA, 451 bp, Mus musculus
aaaggtgctctcaatacttaacaatccataagcttgtgctctcttagtcgtaaaggtggggtccatcaaaatcccatgacaccacagcgagaccaaactccttttctcttactccgaatcacccatcccatgtgggagacgaataagaacacaaactacatcttcagtgacatagagtagcatctgcaacagaggaagtggatggagaccttgtctctggtcaaagacaaagcatgtgacagctgagcctggcacttcctacttgggtcacagctcaaacccacctgaaccaacagcagagccccacagggatgggactcacatgtttccctcttgccctggagcttcgtgcatgttgttagaagctaactggctaacacgcacgggaacaggcaatgtagttggagtatgaatcgaagtcactgggcatggtcctcagtcagccaggatc

SEQ ID NO: 347 - DNA, 338 bp, Mus musculus
ctagactagtatggcagaacctatcttcttctaatcatttagatgaatactccacatgagagagccctgagaatatctgtaaaaagtaatccaggttctgttacttctagctaatcttatctaggtaataatagataaggaatcgggattcacgaacacaaatacctgtacaaagcatgttgtctcacacgggacgaacactgtttctgctgtgctttataacgctgggacatacaaaactagactctgcctaagaagtgtttggaaacatttgggttaaattatagtcagataaaacaacaaccatgagtaaatcgaagaatataaaactagggatc

SEQ ID NO: 348 - DNA, 169 bp, Mus musculus
tttcctggacaataatgttttcttcattaaatttacacttagagcattgtcttaatccatgaataattcccagctcctagctcattacctgtgacacagcagggattcatacatttattgaatgaatggatgagtgaatgaataaaagaatgagcatatcaagaggatc

SEQ ID NO: 349 - DNA, 25 bp, Mus musculus
gatcccttctgtctttggttatctc

SEQ ID NO: 350 - DNA, 442 bp, Mus musculus
gatccaccactgagccacttcttcagcctgtgactgtcattcttaatcatccacacagacttctccttggcagattttgcccacctcttaagactttcacaaaggtttttttcttctgcagggcacatgagaaaacaactctgtcataaagaaacccaggaagaaaaccagcagaggcaggtgagttaagcctgtggtggacattccttctggggatgaccagatgggaacagtaattcacagaggcagaggggtctgcagtcactctgcatgccacatgtgtaacccttaagaagtgaggaatgctctcaacaggaaaaacacagcagcaaatgctatgataccaaagccacaactccatgggtccctggagcctctcgaactaagctgccagctagggagctaacactagctttggatgaaacacagctctggtagagtt

SEQ ID NO: 351 - DNA, 345 bp, Mus musculus
gctgggatttgaactcagggccttcagaagagcagtctgctcttacccgctgaaccatctcaccagcccccttccgttcttcctttcttccttccttttttttttccacattgttttcagactgcaccttgtttagtagtctaggctggcttccaattccccaatgattgagctatgggtatactctcttcacctactttgattttttgtttgtttatttgtttttttgtttttttgagacagggtttctctgtatagccctggctgttctggaactcactttgtagaccaggctggccttgaactcagaaatctgcctgcctctgccttcaaagtgctgggatc

SEQ ID NO: 352 - DNA, 148 bp, Mus musculus
gcttcatttaatatacatcatttaccagaaaccacagacatctttgtaccaacatatagtaatattaatcacaatagccatcactcttatgtaaggatgagaagactcccagctaatatgctaatgtgtagaagatgccagatggatc

SEQ ID NO: 353 - DNA, 93 bp, Mus musculus
gatccctgcttctgtaaatccgcaacgacaattgttatcttctccttttctttcttttatttgttttattctattttatttttcagatgaaaa

SEQ ID NO: 354 - DNA, 65 bp, Mus musculus
gatcctcctgcctctgcctccttcagcaaatcctaccggcgtgcgccaccactaccggcgaaaaa

SEQ ID NO: 355 - DNA, 600 bp, Mus musculus
gatccccctttctctctgtctacggcctctgtcctgtgttagctgtaggcctactctgtatgaacagacctcagcggaggggtttggacttgggcttgtgtttcttaagagaatggggcttccatgactgtccctctgtccctttcatcctaaccctgcctcccgctaacaggcagcctgtatgtttcttgcactgttccttcctcctgacggtctgagtcgtttccctcagagactgttgctgctgcttcagctttctctcagcttctctcagggcttccgctctggagtttctcctgcttctctgtttacttttcaaagctcagcctccatcttctgcacctgcggagtcatcactgattcccagctgtggcctgtcacccttccctttctttcttcctcctgtgccaccaccatgcaccctccccttctgtctgttgtgttgtcctaacctttcttctccccatgcaccctccccttctgtctgttgtgttgtcctaacctttcttctcctctctgtgctctgcaggttttagggtctctgtatgatttgtacctgcatttatttgaacctccactcttctctttccctctcttatc

SEQ ID NO: 356 - DNA, 170 bp, Mus musculus
gatcctgcaatacctctcctgggcatatatctagaagatgtttcaactggtaataagaacacatgctctactatgttcatagcagccttatttataatagccagaagctggaaagaatccagatgtccctcaacagaggaatgggtacagaaaatgtgatacatttacaa

SEQ ID NO: 357 - DNA, 153 bp, Mus musculus
atctaaactataatagttgcagggctagttcattgtcaggtgcgtggcgaaagagtgcaaatcccgggggttctttcttcagaatcaacgaggcaatacacttgaacatgtatgtttttgtaatctgcggggcatcacccgtcctccaggatc

SEQ ID NO: 358 - DNA, 120 bp, Mus musculus
gatcccccagaagtgatagtttaacagtgaggtgaatgcaagcaataagctacctaaatcattaaaacttcctattttattagcatctattagttgcacacagcagtgatgggtttcatt

SEQ ID NO: 359 - DNA, 177 bp, Mus musculus
ggacctctgtacaaatgtcgggagataagggaagaaaaagacgacagagatagcagtcaggatgtaatgtgtactagatgagtggttcaagcaataggatggaaagggcttagcaggagagatttttaaggatggaggcagtagattacatctgggaaatgtcactggaactggatc

SEQ ID NO: 360 - DNA, 120 bp, Mus musculus
gatcaccaggctgggcaggccacctaaggaagtggcacgggcacgggcacttccccagagcaccctctgggcactctgagaggggcacagatgtactgcactaggctgggcccggaggag

SEQ ID NO: 361 - DNA, 195 bp, Mus musculus
atataaaatatcgaacgtcctctggcttgtaaatatcatgttaaccttcaaagcgttcgaaagcgcaggaaatctgagtcaacagaatagtatgtaagtttatttttatagaacctgcctgaactgcaagggaggggcggggcgtggacccaggcctgcctgccaatctgcgctgccagtgaactaagcctgatc

SEQ ID NO: 362 - DNA, 502 bp, Mus musculus
gatcaagtcctggtcagtaccaagttaaaaaaaaaactatataaaagctatattaggggacagctgtggcttttgtagaaaagaaggtcctggtgctatgacctgcagatgcccatgtggaagtcttcagatgaagactttctcatggagtaaacatactctgttgtttgaccatgtggacttggttcaaaatgcccatggatgctcctttgggtaccaggcttcagtgggagtcccaagcccatgtctttatttgagcatgagcagtactgatgcttacctagtcttattctttccttgccccctgcctggaccgtctctggttacaaggatgctgcagtgggaagcggtatgaccgttacctttatgggactgagaccaactaaggggaggctgaggaggctgcagtgaagttattgttgggactgtgggctaagatggaagataacatgttaacaaactcaagtgcggaggtctcagaagtaaaattgcctggttagta

SEQ ID NO: 363 - DNA, 56 bp, Mus musculus
gatcaattggtaaccaagccttgaactgaagagtcgtgaggtgggggactttatat

SEQ ID NO: 364 - DNA, 106 bp, Mus musculus
gtatctcccacctggctcaatataggctcttttcaaaggctaaattaagaccaaggacacagaagggtagctcgctgggcaaacgtgatccctgctgatagtgtag

SEQ ID NO: 365 - DNA, 45 bp, Mus musculus
ctctcgtgtggagatattaaaggtgtgaaccactaagccctgatc

SEQ ID NO: 366 - DNA, 80 bp, Mus musculus
gatcaagcagaggggtaaaataagggcaagctcagtgttagacaagctcataagccaaagctgtgaactctccaacgcct

SEQ ID NO: 367 - DNA, 299 bp, Mus musculus
gatcacttcaacatcaagaagttacccagccccgggaagaagtacatttccaggaagcagtgttttcattttttgagtctgctcccatcccgtttctctgcagctgggtaaacttgaagctgggctagcctctgggtagaaggcagctaatgacaactaccttgcctgtcccacggagcccggacagaacctgagataacacacctagcttgctgagtaaaggcaggttactgtgtgaatgactctgagctgttccagctctgcagagcaggaagtctgactgtggagataagagatat

SEQ ID NO: 368 - DNA, 95 bp, Mus musculus
gtcatgatttgtaattccctgtccaactctcattgcttaggtcaaaatggcttaactcctagcctacttcagtgtaaaagtcatgcgtaatgatc

SEQ ID NO: 369 - DNA, 150 bp, Mus musculus
gatcaggctggcctcaaactcagaaatccacctgcctctgcctcctgagtgccgggattaaaggcgtgcgccaccactgcctggctgctttcttttttttctttttctttgtgtgtgtggggtagtggtggtggtggtggtgttcgaacc

SEQ ID NO: 370 - DNA, 210 bp, Mus musculus
atgtgtgtgtgtggcatgtgtgtgccattgtgtgtgtgtgagtgagtgtgtgtgtgtgtctgtgtatgttgtggaacagattcctgtgtatgtttccttcttcacacatgttttcagaagtgaaaccaggctatgaagaccgccaggcagctctgcaaagcagtactgagaaggtgggacactgcgggggtgagaacagtatgcatgatc

SEQ ID NO: 371 - DNA, 187 bp, Mus musculus
gatcacactccatgaagcttctcttctgcaacaggaaacaaatagcaagcaaaaccactggtaatcattatgtggtgtctaacagagagcggtgacaggggtggaaaactgaatgacatttaaaaggagctggagatgttggtttaaggcgtgtgggggcagcctacagcatggaattggtccataa

SEQ ID NO: 372 - DNA, 106 bp, Mus musculus
aaccatcatggtagcttctgcttctctccacgaagatggttgtttccacagttgccctctctacagagtggtcctgtattaagtcacaggtgccatcctggtgatc

SEQ ID NO: 373 - DNA, 174 bp, Mus musculus
gatctaaccacccgtttcctgcccggtcttagatagacctcttggcccccacgcacctagacaatggagtagacaagacttcgaggggaaagaggcttcccaagatgacccagctcattggcttgactcccaacgccacccacttacacagtgagtatctctggtctttgctgt

SEQ ID NO: 374 - DNA, 165 bp, Mus musculus
gatctatgtcatcttccaggactcagagttaagagagttaccaagtgagagctctcatcaccttctgaagcagttgagaattggaacccagaaagatgcacatgcacgggcacacacacacccacgggcacacacccacccacccatgcagagagagagagagag

SEQ ID NO: 375 - DNA, 339 bp, Mus musculus
taggttgtgcctggcctgtgcaggacatgcctatggggtcttcatccctctcacttactctaatgttcactactgacaagcactagtaagaaagtaggtgcctgtaagagactggagcagcctgctgctgacttcagcacctgggaggcctcagtagcaaagcttagggttagcaatccttggggctgtggctggctgagctctggggtaccgtttaagaggaaagctggagtccaggttctccaggccctgggtgcatcccacaacctctctctctctcctttaccactcgcagccttggctaaggatgaggaccgggacctggagttatctgagatc

SEQ ID NO: 376 - DNA, 277 bp, Mus musculus
gatctctccccatcctcctgttgcctcttgtctgtcatacctctactactccatcagtttgctgcctctgagtccctcttcttcctctcctatccctcctcccatcttcctcatctccaggtctctccaggtcttccttcttccctcttttcttccccttttcctctttccactgtcttgtattcccttcctttctctgttggtcccttccctcgcacctctttcctcctgtccctccttttcatgtaccatatttctcttcctctttctgtgtctc

SEQ ID NO: 377 - DNA, 221 bp, Mus musculus
gatcttagatggccaaatgttgtgaacgtttcctagatgtgtcgtgagcactcagggttgagagccctggttatttagcaagtgaagtggatgtatacacaagcagaaggctgaaactagaccccggtctctaatcctatataaaaaccaactccaaatggacaatagaaataagtgcaagactaactccagggtcactggagggatacaaagggagatgc

SEQ ID NO: 378 - DNA, 178 bp, Mus musculus
gaatgaatatatatatgggactaaatgccatgccataaccaagagaacttaaagaagaaagtgtttagttatgcttactctttcaaagagtccagctgccaaagggatgctgtcaggagtagctgagagcatacatctggacccattaacaaagaagggatgcttccccagcaagatc

SEQ ID NO: 379 - DNA, 26 bp, Mus musculus
ggaggaggggcaccttctcagagatc

SEQ ID NO: 380 - DNA, 160 bp, Mus musculus
gatcttaaagctaataggtgtgtgtgtgtgtgtgtgtgtgtgtgtgtgtgtgtggtcagtggtaaaattgtctaccaagctctaggttcacccctcacagagccggagagaaaaggagaaatcaactcaagtcaacccaaacaaaacaaaggactcaaca

SEQ ID NO: 381 - DNA, 262 bp, Mus musculus
gatctgttcccaaatcctcagttactctctgggaaatggcttctgtatgtacacatgttctctagctatgtaataaaagacctctcttccttggcaaaacttaactctaccttagaaaactctgatgagtactagaaagatgacatgttccacaaacgtcttaagtgattcagggttcacaacaaagaaggagatgctatattgtctttcatgacatagcgtctaagtcccatagcataacttctataacacacaagtgggt

SEQ ID NO: 382 - DNA, 238 bp, Mus musculus
acactagcttcgaaacttcttagttgtctgtccctgagccctttgtggtacttcctcctcagagcccagctccagcagtccccttagcggctgtttttagcaaccacaccctctgactgtgggtttgctctgcagtggctttaaggtttgaatacgaaatgccttccacaaacagacactacagaatcttaggtgtcgagacaatgggcatttgagaaggaattggaaccttcagatc

SEQ ID NO: 383 - DNA, 271 bp, Mus musculus
gatctaaagggaaacccttgtctttttgaatctgagccagcacaatattgtatttccttcaatacgtggtgaatgttgtattagcaacaataaatggaagcagggaatctctcatctcatgagtgatatttacaatgtctgtctggaaacaaacggctaatcaagttagtcacttactgttctttagaaaacacagtactttgaaatgcatacctagcagagaatataaagtatttactgttggactagactgggcccccgggtgtgaggg

SEQ ID NO: 384 - DNA, 193 bp, Mus musculus
gatctatctcatcctgttatagccggaaacatgatagcaggattgggcaactctccagtccctttctcttgggtaaagtctgaaagcaaatcgcccggacccatctcctgtctctgcagcctgtcccagttgcctctgccactcactaacttcactccttaatttaaaaagccagcacatttattgaccgtct

SEQ ID NO: 385 - DNA, 170 bp, Mus musculus
gcatgtctccagactctcagctgcttcctgtctgctcctgctggatgcttcatgaagatggagtgaagcagtggtcagcttgtctgtctcagctgttctatgtgcatgtgtgcacttgctggagcttatgtgcaccacaagcacgcaggtgcacacagaagccagagatc

SEQ ID NO: 386 - DNA, 54 bp, Mus musculus
gatcgaacacgctcggacttgctaaacgtttcccacacggacagtcactgccaa

SEQ ID NO: 387 - DNA, 268 bp, Mus musculus
gatcgtgagttcaagaccagcctaaaatacacagtgagcctctgtctttaagaaacaaacaaacaacaacagcaaaaacaaaaatattgctcaagacccaatgttcctcggactatttataggaatcagagttgctgttcttctcagggcatgccagttaatttgaaagacaaggtgtagaggcaaaggaaaagtgattttacttggataaccacctcatggagcagtcaggggaactctagcctcaaagctcttgcagaagttatat

SEQ ID NO: 388 - DNA, 149 bp, Mus musculus
gtagaagctttttagaaatacgtttcttatctatctatccatctatccacccattatcatctattatctatatttaacatctatctaagtatctgtttatctatctacctgtctatacctacctatctacctacctacctatagcgatc

SEQ ID NO: 389 - DNA, 40 bp, Mus musculus
gatcgtgcatgcatgggtgtgttttggggagaggttctgt

SEQ ID NO: 390 - DNA, 197 bp, Mus musculus
gttactattcatctgaggttctcttttgttgtatttgaacaggaggaaggaaccaggagctcaaggatgtagctggaaatgctataaaactgggatgccctagagaatcacacggacaatcctgctaacccatggattgtacactccaatatacaagataacatgtttgtgcaggcatgccaccatgatgttcgatc

SEQ ID NO: 391 - DNA, 104 bp, Mus musculus
gatcgaccgcagatgaggtctatgcaggaaaaacgatgtctggaattttattaaaattgctcagcaactcactgccacgtatacttggagagccacttagggat

SEQ ID NO: 392 - DNA, 88 bp, Mus musculus
ccaagtatacgtggcagtgagttgctgagcaattttaataaaattccagacatcgtttttcctgcatagacctcatctgcggtcgatc

SEQ ID NO: 393 - DNA, 93 bp, Mus musculus
gatcgtagagagatggacccaaatatcagccagagaattagaccagaaaatggaaccaaagtacctgtcagtccaaggatgtagtggcactac

SEQ ID NO: 394 - DNA, 155 bp, Mus musculus
gtccccaaatgtaaacaaaactatcaaaagaaattgggcatgccagaattttgttcttcacattaagggaattctgaaattgaaatcttgctaagggaagggtggcttgagaatattaacagaatcctaggttgaaggagcaggaatagaggatc

SEQ ID NO: 395 - DNA, 487 bp, Mus musculus
cagctagcccatggagctgctgggacacgaggccgcaggctgagcataatggggaagagatggcagattcattcacccacttgaggagaccacaattagtcagaggcatgctgggcctggtcagagtgctcaaataaacattcacaggaccaaagtaataagcattggtgttacagagataaatcctttagcagggacacgggaccccagaaaaccggaaggacatcgttcccatcatgagaacaaggacagcaaacagtcactgagggtatactactgaccagttccaacagggatggtcagaagttgaacgctggatatatcatgagctctgacctaaatattctgagtattccccatgtttgaatggactgaatactcacattttctaaatgctgaatactgaattttcatagcaaccatcataaggcatggtggcagaataatatctctcactcagaaagcaaactattctaagttggggatc

SEQ ID NO: 396 - DNA, 142 bp, Mus musculus
gatcccgtggggactgagcctgcagctcagtggtaaagcagatgtctaacgtggtacagggtcccagatgagatgacacaagtacctgtcagtactccgggaacactgggtgggacttttatatgtttatttgtattcttaa

SEQ ID NO: 397 - DNA, 102 bp, Mus musculus
agtccattgtgtactgagagaggagttaggtttagaaagccttcctcagatgtccctcaaagaagctgctacaactgccctcatcccaagttgccaaggatc

SEQ ID NO: 398 - DNA, 139 bp, Mus musculus
agattgcgtgagttctgatgcatgctggccatgatgtgaggcaggggcagtggttggattcggagtcagaaaactttcccgtctactgccgtaattcccagctaaattcctatcctcgttgtagctgttggtgaggatc

SEQ ID NO: 399 - DNA, 116 bp, Mus musculus
gatccttccgaatctgccatttattgaatatttaaaacacacctcactgcagactaaacacattgcaagcactgggagcagaggtggctagtgagcaccactctagatggtccttc

SEQ ID NO: 400 - DNA, 257 bp, Mus musculus
gatcctcctgcgtctaccttcgggtgggattgcaggcatgcaccaccatgcttggctttgtgtggtactggacattgaacccagaactctttgagcactaggcaagcacatcctgaacaccagtaaaacattttcaaagagaaaagaaaatttaaaacatacacctatctacatccatttccaccatgttagtaaaccagggacattttgaagtgtggtctttataaaaacacccgggtgcttatctcccacgctct

SEQ ID NO: 401 - DNA, 40 bp, Mus musculus
ccagcggtgctcactactgcatgtaaccagctccaggatc

SEQ ID NO: 402 - DNA, 421 bp, Mus musculus
gtctcaaagaacaaaaataaaagaggaaattagtaacgagtcctgagagatagaagagtattcagcctgggaccagagctctgtcttacagtcttgccattctgtggggcctgggacacagcatccttggtctttagaatgccataggcctcctgagggagccttttctgtaggcacttctcccacattcttggatggatgcgatttattctgtgtcaggggactagggtgctggatgtgtgggtcgaatgactgttgttctgtcacttgggaatttgggataggagaattctgagtgcaaggctagtctgcacttgaacgtacatatcgggttttaagccagcctctgagctaccacagtgagactctctcttaactaaaatcaacataaatagtcttagtatggagaggttaggggatc

SEQ ID NO: 403 - DNA, 185 bp, Mus musculus
cgttttcctcggaaaatgtgaaaagaagaagcacgagacgaaaccccctcgagaatgagaaaattaaatctagaacccaaatggcgtccaacaagaacattagctcttgaaaatgaatattgcgcctgcgcagccaccgcccggccagctgctcaactgcagctagagcccgaccccaagcgatc

SEQ ID NO: 404 - DNA, 79 bp, Mus musculus
gtgtcacatgtatgaacagcatcacatggtatgaatggtatcatatggtatgacgtgaatgtgtgcaccggcactgatc

SEQ ID NO: 405 - DNA, 28 bp, Mus musculus
ataccacccactcccttaagaaatgatc

SEQ ID NO: 406 - DNA, 315 bp, Mus musculus
gactgatattagtaggttgttctctaagggccgtgaaatttttagctagaagttcttgctttcattaacagtgccaagtatgagttccatctcatggggtgggtcttgaatacaatcagaaggtggtgagttatcgccataacatctgtgccgctattgtaccagtggacatagttgccaggcaggccattactgtagctcttaggtcattcctgaagctctctggggtctgttaggtgagactgatgataactcttctcttccgttagtgtacacagcaccttttagcactatgaaagcgaggcagtattgatc

SEQ ID NO: 407 - DNA, 274 bp, Mus musculus
gttccgatgtttgtatctcgtttgaattatccatcagttgattaagttgatggtcatctaggctgattcccctacatggccatctcaatattgcttctttaataagacctggacaattaacagcaccagttgacatgccaacttggattgggggaggggtcttaaagggccccgcccttagatgaagagctatacgcaattaatgactgtcagaaagggagaatggctttcccagagatgaaccccctaatggattacccagtaccaagtgatc

SEQ ID NO: 408 - DNA, 248 bp, Mus musculus
attcaacctatggggccgttagacccctggtcttgggtggggtggatatgttattcttttttgctgtggtggcagcaattttgtttgctttcttgttttttgatacagtttctcgtcatgtattcctggttgcctggaattcacttctatagaccagaatggcctcaaatttacagtgaaccccctgcctctggcttcagattactggaattacaggtttgtgctatctcactagttggtgtgtgatc

SEQ ID NO: 409 - DNA, 149 bp, Mus musculus
gatcaagtccccagttaaatgctttctttgataggttgccttggtgatgtctcttcatagtaatagaaaagcaacctaagacaagaggagagagtgggtttaagaacgaggagagagaggaactcagagggtcctggaggtcccgggaa

SEQ ID NO: 410 - DNA, 191 bp, Mus musculus
ctcacacatacattcatacatacacacacatatatacatacacacacttgcatacacacagcacacactcacacacagagacacacagacacacagacacacacacagaggaacccaaaggattggaagaataatttcccgtgctcagcgggaaagtttaccagaaagacaagtggtcatgtgggatgatc

SEQ ID NO: 411 - DNA, 154 bp, Mus musculus
gatcatcaccagtgtagtgttggctttaacggtgcacgcctttaatcctagcacttgggaggtggaaacaggtaggtgtgcttacttcagtgagtgaattccaggccaggcagggatacagagtgagaacctgttatctaaataaataaataaa

SEQ ID NO: 412 - DNA, 81 bp, Mus musculus
cacccacggcttgcttcttttctctatgtgtaattgaagcacatacccggtgggagccatgtaaagcctgtgtccatgatc

SEQ ID NO: 413 - DNA, 390 bp, Mus musculus
gatcatgtgttaatgaaactgtcaggggttgggtaagatggctcagtaggtaaaggcacttgcctcctagcctggagacctgaggttcctcctggggcccacagggaaaaggagataaccagctctctgtcctctgacctcctgggcccctccctcacaaacaaacaaacaaacacacacacaaacgaccagaccatttcccacagtagctgtggtgcgttacactgtaacgggcaccatgtgagggtttgggctttatcacatctccgctagtcatacttggtgtttcctgcgtcttgcttacagttgttctaatgggtgggcggtgatatcgaattgtggttttagcatgtatttcctgtgctctgctaagaccacttacaattacag

SEQ ID NO: 414 - DNA, 225 bp, Mus musculus
ccttaacgctcccttgatgtccactcccgttttctctgcagcgatttattgcttagtctatctataaggtgtatgcaagctgcaaagtcaagtatttcctttgtacttgagcaagtctcctaagtattatgcttcataacgttgtgatatgcttgagcaaatttgagtctatttcataattaagccactgttctgataaaagaccctagagtgctatatctgatc

SEQ ID NO: 415 - DNA, 105 bp, Mus musculus
aaaagagtgtcagatgtcagaactgactagctgggctgacactgaggaatgaaggttggggatatatgcacctcctgaaaacaggaagccttttgttggttgatc

SEQ ID NO: 416 - DNA, 248 bp, Mus musculus
gatcaaccttagtacacagcagagtgttttctgggaagctcatggagacccacttttgtcatcccatagaggttactacaaatctgagcatgagaataactacttgctgtttaatacaaagaaccattagcagtcaatgccccaagttctaagggcacagacttcatacgagaaaaaaaaacaaagcaaaacaaaaactatcacatgctactatctgtactggggaatgcatacaattttgtaggtat

SEQ ID NO: 417 - DNA, 152 bp, Mus musculus
gatcagtagagagcagaggggtctatgagggaggtagagcagcctgggaggcctgaggaaggagggacaagggcagagtcttggtcactctttggtctaattgccttcagaaggcttgcagactctggtttggagttccaggtgggtggctg

SEQ ID NO: 418 - DNA, 180 bp, Mus musculus
caagtagggtttgtgtgtgtgtgtgtgtgtgtagccagtgtctttctcaatcactctccaccttaatatttttttttgagacagaatctctcactgaacctgtatgctgtcaatttgtcatggctgactggccaaggagcccgaagaatttatctctatgctcaatccaacccccagatc

SEQ ID NO: 419 - DNA, 600 bp, Mus musculus
gatcacatggaccgattgccgcgggacatcgcacaggagcgtatgcaccacgatatcgtgcggcttttggatgagtacaacctggtgcgcagcccacagctgcatggcactgccctgggtggcacacccactctgtctcccacactctgctcgcccaatggctacctgggcaatctcaagtccgccacacagggcaagaaggcccgcaagcccagcaccaaagggctggcttgtggtagcaaggaagctaaggacctcaaggcacggaggaagaagtcccaggatggcaagggctgcctgttggacagctcgagcatgctgtcgcctgtggactccctcgagtcaccccatggctacttgtcagatgtggcctcgccacccctcctcccctccccattccagcagtctccatccatgcctctcagccacctgcctggtatgcctgacactcacctgggcatcagccacttgaatgtggcagccaagcctgagatggcagcactggctggaggtagccggttggcctttgagccacccccgccacgcctctcccacctgcctgtagcctccagtgccagcacagtgctgagtaccaatggc

SEQ ID NO: 420 - DNA, 266 bp, Mus musculus
gatctaactcaggctgttcagcttggccaacaagctcaaatatccattccgctgtcacatcgggccccatgtgatgctttatatactaaatagaacaagcaaattgatactagatgggacagtctgcttacccagtttggtgtttggtgggggaggtgagacatatcccacagtcccagagcaactgtcactgcagggtcccaggggaggagccaggtgtgaagctggcagtgtgtgaggtaccctggggaaaatgaatggttact

SEQ ID NO: 421 - DNA, 141 bp, Mus musculus
aggcctggtagtgaccagcaagtactgaacgctcgctctatgccagacacagaccctcttcttccttcgtcttatcctattatccatactgaacagacaaggaaatgaaggcttagatgagtcacccgacttgctgagatc

SEQ ID NO: 422 - DNA, 351 bp, Mus musculus
agtggggcctgaaaatcacatctgggcaaaccctgaggcctgccaagtcctcatcagagggatgccctcttcatcccaggtgctttctgactataaaataaggtgaatactacctcccctgaggttacacctccagggttaagctggttagagaacccagggacacactgggaaacagcccacaacagcaggagctggagcactcacccacggatgtccatggggtccagctccctgcgctggcgcccaccactggtaccaggaagcagtgaagaggtggcccaacccactgtagagcgcttgattgggtgcttgcgcagctcttcctcgtggccatagtacgggaagatc

SEQ ID NO: 423 - DNA, 180 bp, Mus musculus
agtggaaccagattcctcctacgctttgcactccactttcgttttctcttctgtaccattctaatggaggccagagtagcaactgtatagacaaatcaaatcgtttactcttccagtcttgccccttaacagtctttcctttgttcttcctcttagcctcattttctcctttctcagatc

SEQ ID NO: 424 - DNA, 522 bp, Mus musculus
gatcttctgcttcatctgagtaggcttagactggtttgtattattattattattacttgttgttgttgttattttggtgggagtagtagtagcagtaggtgtgtgtgtgtgtgtgtgtgtgtgtgtgtgtgtagatgtcacagcatgtatatggaggccagagaacagcttctagcggttgcttctctccttccttccactgtggtccagggaatagaactcaggtcatcaggctgggcagctgtcacctttaatgctctgagttatctcaccaacgttaataaaaggcttttcaaacagcagtttgggctgggcctggttgtgcagacctggaattgcagcttcttaggatgctgaggcaggaggactggaagctcaagttgtgtcggggaaacttagtaagtccctattctcgtcccgcacgcccccaaaaagccaagaccaagaccaagcagtttggtacagcagaaaaagcacgagagtctcctcctcctcctgctcctctttaatgatgcagaaccc

SEQ ID NO: 425 - DNA, 289 bp, Mus musculus
gatctgtgcattattctgttggaaatgtgacaagattctgttgagaatctcatactctatgaactcttaaaaaaaaaaggtttctgctgttttgagacaaaattacttataaaggtttatgatgtagttaaggccctgaatgtcccccaaagacatgtgtgttgagggtttggtctccactccgtggtcttttgggaggtgttttatgttagctggtgaggcatagtggcaggggaggagagttgggtcatagtccttttgaagaggctattcaggctctggtgcctaa

SEQ ID NO: 426 - DNA, 85 bp, Mus musculus
gatctgactgtgataggagggtcctggggccaccctgacataggcctggtctatgaatgctctcatggactgggcctgtttgtca

SEQ ID NO: 427 - DNA, 188 bp, Mus musculus
ctgcctctctccctggtccctctctgaggttctggaccctcaaaaggccctttcccaccccagccttcaggcctgtaacccagcctcggtttctctcccattgccaaagcacaatggctgttataattaacggattatctcagcgcgacagctgcgcccctttgaaaattaggttgaataacaagatc

SEQ ID NO: 428 - DNA, 106 bp, Mus musculus
gatcttggaccaccacgtcaagcctcttgtacatttctttgaaaaacaaagcttggttccccctagtcaccacggtgaaaaaaacccaggacagtaaaggtcccaa

SEQ ID NO: 429 - DNA, 157 bp, Mus musculus
ttagtacctctggtggaatcaccatgcctgacctaaagctttactacagagcaattgtgataaaaactgcatggtactggtatagtgacagacaagtagaccaatggaatagaattgaagacccagaaatgaacccacatacctatggtcatcgatc

SEQ ID NO: 430 - DNA, 105 bp, Mus musculus
gatcgcaccgattgccagtatagtacctagagtgtcaagttggcctctcagggaagagagaacatgtattagggtaagacgcaagccccagtaaaaacatgtgag

SEQ ID NO: 431 - DNA, 321 bp, Mus musculus
gatcgcttcaccaagtgtgaactgttggtagggacagagcagaccacaagcccctctttgcatttacatgggggcgtcctagtgtaggtggctagggatggtggacaggagaggagggaagacagtatcacataagaacaatagtggagggcaggggaggaagccttctcatggctggggtgaagtcacttccgtagccagagctgactgagaatatcactgctttcctagtaaggaaacaccggaagtcggaagatgataaacgcgaaactcactacatcatagacaccattctgtcttcatcaacagagaaatttataa

SEQ ID NO: 432 - DNA, 100 bp, Mus musculus
gatcgtccacttctgtgtttgctaggccccggcatagtctcacaggagagagctatatctgggtcctttcagcaaaatcttgctagtgtatgcaatggtg

SEQ ID NO: 433 - DNA, 404 bp, Mus musculus
agggtacagcgaagcttgaaaaaagcaaggagtgctctgggaccgggagtgatggagaaagtctgaagcccctttgcacacccctacaatgggtttgcgccaagagaggcgccggcaactctacgcggcgtggggctctccccagcgctctaggttctactgtgctgagccacactagtttctctccctagacctgaagagaccccagaagtctgagagtccctttggttctccatctctcaccaccccccactctcgtgctttaactctgaggagggccactcaagttcattcataagaacaagggctttgctcttaaaggagccgcataccgaaagcgtttgtgtgactgagggttcacatgcacagagctccgcgtgtctcgacatcctctctctccgatc

SEQ ID NO: 434 - DNA, 80 bp, Mus musculus
atctcaggaaactcctagcagctttagtacgcatcgtgctgtttccagctgtcggtattttacacaggttttgagcgatc

SEQ ID NO: 435 - DNA, 263 bp, Mus musculus
ccttcaggattactttggatgattcattagagaatcttgtctttagactataaagcacttgttgaacaaggttacaatgtagcaagcaaccttgttttggaatgtattttgctacattgtgctcttccctggtctggtgctttcatttcacatattttgctcttaatagaagtagggttcagtgctggggatttcatttgctgttttctccattgacctcttgagctgaagttattcttattagaaagtcagggtaggcgatc

SEQ ID NO: 436 - DNA, 260 bp, Mus musculus
ccagcaggcagcgagacgcattttcgcgtggcggtggtgagctctcgtttcgaggggatgagccccttgcaacggcaccggttggtccacgaggcactgtcggaggagctggctggaccggtacatgccctggccatccaggcgaagacccccgcccagtggagagaaaacccacagttggacattagtcccccctgcctaggtgggagcaagaaaactcgagggacctcttaataaatacctggattgggagaacgatc

SEQ ID NO: 437 - DNA, 34 bp, Mus musculus
gtttttcctgcatagacctcatctgcggtcgatc

SEQ ID NO: 438 - DNA, 235 bp, Mus musculus
aaactaggaaagggtatagcatttgaaatgtaaataaagaaaatatctaatttaaaaacaaaaaagaaagacaaaggaaaattaaaaaaaaaaaaaaaagaaacaaaagccactgcaggactgcccaacagtctactgaaaactgtgagccttattcctagatgagcctctgatgcctccacttacaagctaccttcactcctccatctatctccttttgttatgtcccgcgatc

SEQ ID NO: 439 - DNA, 128 bp, Mus musculus
gatcggactcgaagagcagaagaaacaaaactcaaagcagggattaggtcaaaattaaaaagggtttgcacacaaaaggaaaccatccgaagagacaacctacaaagtgagagaaacttgttttgaac

SEQ ID NO: 440 - DNA, 98 bp, Mus musculus
gtctgagaaattgtctttaatgtagtgactgtggagccttgcagggatacccacgatgggggtgtcattcatatgtcactgcacctggaagaccgatc

SEQ ID NO: 441 - DNA, 226 bp, Mus musculus
gatcgcacagcctgctttctcaacagtaggtaggaccaacagcctaggtggcaccacccacagtgagctgggccttccacatcaatcatcaatcaagaaaaatagcacaaaaccctttcccgaaggccaatctgctggaggcattttctcagttgagattccctcttcccaaatgactgcataaaacttgtgtcatgttgacatgaaactagccagcacagggtgt

SEQ ID NO: 442 - DNA, 116 bp, Mus musculus
gatcgggtaatttagtaatagttcatgatattcattactcggcgtaaatcaggaaaaacatttctagatgaatgtggtattctcagtgcacagtttgtttagtttagaaaacaaat

SEQ ID NO: 443 - DNA, 42 bp, Mus musculus
gatcgaggaggggaagtccttccttccttccttccttccttc

SEQ ID NO: 444 - DNA, 113 bp, Mus musculus
gatcgggggttcaaggtcctcctcggggtacctattaggagggcagcccaggctacgtgagactctgtctcaataaaaataaaaataaaaagctgggtggtggtggcgcacgc

SEQ ID NO: 445 - DNA, 96 bp, Mus musculus
gatcgacctgcctctgtcttaagcaagaagggagatagatatgcatagtatttagtgtaatgaaagttacgttgtattacgctgaggtttatcaca

SEQ ID NO: 446 - DNA, 29 bp, Mus musculus
atctaagtagtataatgtttaagacgatc

SEQ ID NO: 447 - DNA, 92 bp, Mus musculus
gatcgtcgtctaacttagctggctttatagtgatataacaaaatattagaggatgctttggttgaaaaagaagtttatttgcatcacagttc

SEQ ID NO: 448 - DNA, 33 bp, Mus musculus
gatcgaacacgctcggacttgctaaacgtttcc

SEQ ID NO: 449 - DNA, 121 bp, Mus musculus
gatcgtcatcatttttataacagtagtgaggagatgtcccctggggccgccctggctctggagagggaagccacatgctccaaggggctatggtgaggaccacagcctttacatttggctt

SEQ ID NO: 450 - DNA, 142 bp, Mus musculus
gatcatgcactgtctgggatagtgatgggctgtgtcctttgttggccaagaggaagtggcaaaaggcaaagttgctgttggctccaggagtcagtctggggacggggctgagatgctgtgggacagactctggaaagggcag

SEQ ID NO: 451 - DNA, 272 bp, Mus musculus
gatcgtggccactgagagaccttcttctggccaccagatgcacacagctgcatgaacatctgcatacacatttaacacatacaaagttgaagagaagcacgtgtgtcttgtggtctgaccacttcctgggcaccaccaagctgctctgacaacggattcccactgggttcggccatcttgcttcctcccctcagagtttgcccatgtcctctgtcttttcatagccacagccttgcccaagataagatacatccaactgtacagtgctccat

SEQ ID NO: 452 - DNA, 74 bp, Mus musculus
gatcgtaccaggagctccaagcgtacccctgatgctacaacctcattcctgagccttgattctgtggactctag

SEQ ID NO: 453 - DNA, 164 bp, Mus musculus
gaacaaggaaggaaataaagaataaaggacatctgacactaccaaagttaggtcaggatgtgtcttacagatggccactcaacagcctatagaaagcaccgcacagaccagcacggtctttttctcccaggtgtctctgaggtactgctttctttccagggatc

SEQ ID NO: 454 - DNA, 88 bp, Mus musculus
gatcccgagtcctttcatcctgtggttctattgtcccctagggcttcagcaggcagaaggagaaagacactgtagagcagcccccaaa

SEQ ID NO: 455 - DNA, 283 bp, Mus musculus
gatcctgggattttctgggcaattggaggccacaatttagatagtttccggaatcgatgtcccttaaagaccagcgcctggactctactgagtaaactcccatttcaacttcctcctcttcctctatttgaacaacgtgtatcattaaattataaaattgttgttgttgttgttgttgtttcaaaaattaactttattgggggaggggcagttgcccgaggacaacttgtgagaaccaggttttgccttccacacttaggggtccctggaatggaacttatgt

SEQ ID NO: 456 - DNA, 151 bp, Mus musculus
agaggagaaatgggggtgcgagaggacaaagtctgtgccccacagcgctggggccagagcccaggagggcctcatgggagaggttgcctgaaggcagtaagagaggcagaggatgcttgggccagagaggttccccacaattgcttggatc

SEQ ID NO: 457 - DNA, 46 bp, Mus musculus
gatcccaaacaactggaacaggggttatcccaaaagctgttgcctg

SEQ ID NO: 458 - DNA, 223 bp, Mus musculus
gatccaactcctcttcacaaagagactatgtgcaggatggagaagaagatgtatccaagcatatcctgtgaaatttatgtcaatgctgtgaaatttgtcccagcactcacaatccagatttctgctttttaggtggctttttctatttcatttcttctggcttcatagaagtttgaggtgacatttttaagacctgtgccactaaaatttcagaccctatttg

SEQ ID NO: 459 - DNA, 159 bp, Mus musculus
gatcggttagtttgaccagccatactataactttagtgcaaccctttacttggtgggtggtactaggaattaaacccaggaccttcacatatactactatcattgagttacatttctagcccttttaaccaatttccctttaaccctttttatcctttg

SEQ ID NO: 460 - DNA, 124 bp, Mus musculus
ctcaagattctgttgtctgagaatctctccctctgcttggggacccatttataatgaggtgatacttcatctgaagtaatggccaggccacggtgtgagactcttgaatgtcacatgctggatc

SEQ ID NO: 461 - DNA, 143 bp, Mus musculus
catgtgagacttgttaatttagatttattctgtagtgtttttgatatgagtataaataagacaattaaattctatattagaaagtggctttttacattgaatatgctttcaggatatgcgtgagaatttggcgatgtgtaatc

SEQ ID NO: 462 - DNA, 210 bp, Mus musculus
  misc_feature (32)..(32): "n" at position 32 can be any base.
ccttactgcagagatgactcggccaacggctncgagctcctgaccacttcctcaggtttggttttgttagttttttctcacagcaatgggaagcataatcaatacaacttcccagaatgcgacctgtgacaagaccaatgagcagactcaaggctgggcacataaaagcaccaaaaaaaaaaaaaaattcccttgcaattattgttcatg

SEQ ID NO: 463 - DNA, 74 bp, Mus musculus
gctgctcatcaccaaaggaagtcaggactggaactcaagcaggtcaggaagcaggagttgatgcagaggccatg

SEQ ID NO: 464 - DNA, 51 bp, Mus musculus
catggcaagatggagactttgtctaccagggccactccaagcacccagctg

SEQ ID NO: 465 - DNA, 49 bp, Mus musculus
gtgaaagggcagaaataattcctgaaggttgtcctctgccttctacatg

SEQ ID NO: 466 - DNA, 191 bp, Mus musculus
catgactatgtttcttttaggtatatctgaatagtatggatctaaatgatgaagttacaccattttctacaaatgggcacagaacacagggcatagatacaaatggcaaggtgaacccagatctctgtgcttatctgcaatataacaacactaagaaatattaggtctctctgtggttttccttaaatcta

SEQ ID NO: 467 - DNA, 217 bp, Mus musculus
gtatttcctgtcagaggaaaagagttttcaaaaaacttttaaaatttttatttgttagcctggaccagtttcatagcaacctgtcatccatatcctcagattcacttatgagtttgtctgcccattaagatctttaaaatggttctaacagcttacttcattgttcattagtaaagggtttatatctacactttgatatttgcttactccatacatg

SEQ ID NO: 468 - DNA, 71 bp, Mus musculus
catgagatgaaaaagaaccttttggacttgaattttgttgcttcaaatgcgtactgcagttgatggaaatt

SEQ ID NO: 469 - DNA, 61 bp, Mus musculus
agggtcccttcaacttcctcagagccaaggctgacttactaccgttccccaagatctcatg

SEQ ID NO: 470 - DNA, 45 bp, Mus musculus
catgcctctggaaagtaccttaaacatagaatcccctccctagtg

SEQ ID NO: 471 - DNA, 36 bp, Mus musculus
ccagatcccattaacagatggttgtgagtcaccatg

SEQ ID NO: 472 - DNA, 152 bp, Mus musculus
catgacttctttcatttcttctgtgtgtctgtcttcctgtgtttgcctgcccctctctttctcttctaacagcccccttgaaccaactgatgcgctgtcttcggaaataccaatcccggactcccagccccctcctccattctgtccccagt

SEQ ID NO: 473 - DNA, 108 bp, Mus musculus
catgggaatgtaatgtattaatgaatattatataaaagaggctaaatagcttggctttaatttctcactttgcctactcaattgagaagtttatggatcaccaaaagt

SEQ ID NO: 474 - DNA, 54 bp, Mus musculus
catgtccttattctaggaagcccccttttttacccctgcctctgagagaaacag

SEQ ID NO: 475 - DNA, 68 bp, Mus musculus
catgaacacccaaatccatatgaatacacacataaaatattttattttctctataatttatgcccacc

SEQ ID NO: 476 - DNA, 39 bp, Mus musculus
gaaagcattgaaatatactggccttattaatggcacatg

SEQ ID NO: 477 - DNA, 200 bp, Mus musculus
catgtgcacacaccccacaaatgacctcagatgtcagtggtactgaaactgagaaactgatgatagagccagtaaaaatactgaaagtgcctgttttgagagtttatattttacaatactttaatatctaactacacacacatacacctgaaaagggctcagaatacacaggcctgagatggctctcaagaaccagcctc

SEQ ID NO: 478 - DNA, 111 bp, Mus musculus
ggccttccactgctcaaagctcagactgcagaaaaggttgatagcctcccaggggcaatgacaccctttctgcttgagcttcccccccccccctctcaggatgtagtcatg

SEQ ID NO: 479 - DNA, 140 bp, Mus musculus
catgccagtccacatctgcttctatgacaaatgccacatcccaacgacaaactcactcattcttcctgtatcaatttacgcatacacataatacttttgctcaaggtacattcatatttccggcaaacagacagctatag

SEQ ID NO: 480 - DNA, 128 bp, Mus musculus
catgtcactcacttggagaaagagttctaattatttatcacggcatttttcacaactatagaaataaagttaatttctttggaaataaagttgaagttgtaatttccagatgggctcaggttgctgtt

SEQ ID NO: 481 - DNA, 104 bp, Mus musculus
ctcctcctaaaagaaaaaaggaaaagaaaagttaaacctgcaacagcatcagcagagctcacccctcctcacctgcagccctggttgcctctcttcctttcatg

SEQ ID NO: 482 - DNA, 227 bp, Mus musculus
gaaaacactgttctgggttcaggggttacttagccttggaatcagagtctacccagagtctacctgcttctacccaaagcaggtggaagaagctgcccaggacggggctcagagtctacatttgaactccctgtgccaagaagtctggatagagtatagtgtctgtatattctaaactttctggaacaacccctgcttacaatactctttccaactctcaggccatg

SEQ ID NO: 483 - DNA, 44 bp, Mus musculus
acctctgtgccagcttctcggacatttaacaactctggatcatg

SEQ ID NO: 484 - DNA, 183 bp, Mus musculus
ctggcagtaacacacttaaactgctagcacctgggaagtggaaataagatcaggagctcaatcaaggtcatcctcagctaaacaagaccccccccaaaaaaaaagaagaagatggcctagaaagagaactcagcagctgctgatcttacagatgactagagtttggttaccagcacccacatg

SEQ ID NO: 485 - DNA, 172 bp, Mus musculus
catgcctggtccctgctgagtgcagaagagggtgtcagattccttggaactggagttatatacagtcgtgtgtcactgtgggtgctgggaactgaacctgtgtcctctgcaaaaacaagaggtcttggttgttgttgttttgtttgaaacagggtttctctatgtggccctg

SEQ ID NO: 486 - DNA, 128 bp, Mus musculus
gcaggagcccttgtgcaggccacaacctgcacagctgtacaaggcctgcctgactgcctgaacagatgtgtgggatcttgccccccttgtgcaggcgtacagatgcagactgctcagagacacacatg

SEQ ID NO: 487 - DNA, 40 bp, Mus musculus
catgggctagacctacactgagttgtgctaaagaagtgac

SEQ ID NO: 488 - DNA, 157 bp, Mus musculus
catgtcctccacagctgagcaccctcaactgtctcccagggcctctgttctatccagggtctgcagggtctctgccccacgcctagcccctgagaaatcttaagcagtctgaaaactacgccactgaactgctaaaaccctggagtcactgatggaa

SEQ ID NO: 489 - DNA, 256 bp, Mus musculus
tagtgctagactctgccttttcacctggcatagattcacctttttccagatatccagggcacttgcaaagaagccaggcatcatcaggggtttggacttccagccagagtctgagttgtcacttgaatgtgctgcattttgttggattcagccccagtctcccgactctttgtgagtttaggataataatcacaacagcaccccttcttatttgatggctaataagctctaggccagtgtcttagctccattcatg

SEQ ID NO: 490 - DNA, 166 bp, Mus musculus
catgtattctgagagtagaatttatacccagagaatacctaagaagtgaactgacgccgggcgtggtgccgcacgcctttaatcccagcagttgggaggcagaggcaggtgaatttctgagtttgaggccagcctggtctacaaagtgagttccaggacagccagg

SEQ ID NO: 491 - DNA, 95 bp, Mus musculus
gcctggtgtggtagctcacacctttaatcccagcactcatctctgtgatttgctaggccagcctggtatacacagtgagttacacatcagccatg

SEQ ID NO: 492 - DNA, 87 bp, Mus musculus
cgacatccaacttctggaaggagagatgggaaggggcatttggggtgctaggaagggatgggaggtgtccctagagcagtgctcatg

SEQ ID NO: 493 - DNA, 150 bp, Mus musculus
catgaaataatgccttcagaactgcattagaaatcacaaatagccctgaatgccctctagatgcttttcttgagaacaattatgtgttaaagtcctaaggcccttgtcagcccaccatatggaaagggagaactaactgaaatgggagtt

SEQ ID NO: 494 - DNA, 31 bp, Mus musculus
actgacaagaatagagagaagttcagtcatg

SEQ ID NO: 495 - DNA, 305 bp, Mus musculus
gtgtcctgctcctgtctgggtcaaggtcataaaagatgagccaaggctgacttcagtgcccacctggggagactgatgtcttcacaggaatgctcacctggaaggtgtcctctgggtgcatctgtgtcacattcggtatagaaggaagaatgccaacaatactctaaaaatattagaggccttgagagtcctcagtggtattccaccaacatcaaagctgcatcgtaatatgccagcctggtcctcacctttcctgcccttcccaggaaaacatcagcctttaacctcagcccataggggacatg

SEQ ID NO: 496 - DNA, 159 bp, Mus musculus
aggatcttataaaaataacagtgacccaaaacataatttttgccatcaagaatctcaaaatcaagtctcatccaagtctactcttctttattgtatcttaaacacacacacacgcacacatcacacaagcacacacacaagaattcacacacatacatg

SEQ ID NO: 497 - DNA, 113 bp, Mus musculus
catggtattctgatgatagtaccaacatactgctgcagctagctgtatctggaaatcccaacctcagccaagtatttgtggttgaaataacctatacttctcacatcaaacac

SEQ ID NO: 498 - DNA, 80 bp, Mus musculus
actgtgacctgagcacttcttgtcttatcaatagctcacgtgcccaggccgggtgaccagtctctaggatgttctccatg

SEQ ID NO: 499 - DNA, 322 bp, Mus musculus
catgcacacaaactggccctgaacttttgacttccaggcctctgcctctctgcgcgcacacacacactcgcactcctgtatatgaagcgtatatgtgtttctctgggaactgtttttatcaggtgaagcacttcctttgttcttgctacccacctccagggctccaggatctccagacagccaaccctaagacaggcccagcttcctctgtatctctgtgatgagaaccttggcatagagctgccctcaccctcgggatagggcttatgttccccggaacgagccaggcacctcaacagctcctggggaggaataggggact

SEQ ID NO: 500 - DNA, 75 bp, Mus musculus
catggcactatgaaggaaatgaagatacaaaagatttcccatacaaagggtcaactgttcaatttggcatttatt

SEQ ID NO: 501 - DNA, 86 bp, Mus musculus
catgatagaagaccacgtctgggatggggtaagggtttctcagagtaccttgccctggggccacatcctaaatctacaacaaagct

SEQ ID NO: 502 - DNA, 292 bp, Mus musculus
catgcaaaagaattccaaatgattttacagatcttagccctctaagagatagatatagcacaagtcctgactcctgaggtaggtacacactgacttccttccacaagcactgcctcagcccggagatgaaggtcacatcaatagagacaagtcaggttaaccgtgagcaacctcaagacaaggaggagcacagcataggtcggtggaagtgtttgcataagcctaaggcctgggcccagtcaccagcattgcagaggaaaaggaaaaacagatagtaggtgccttggtgtgt

SEQ ID NO: 503 - DNA, 155 bp, Mus musculus
catgcagtttaccaatctttttccactctttaaaaagacaaaaaatattagaatactgggctgaggaatggctcatcagttaagagcgctgctcttttgaaggactcccgttctgttccaaatgcccacctggaggctatcctgtagctagaggt

SEQ ID NO: 504 - DNA, 76 bp, Mus musculus
aggaagtgctgaatagagaggtttggggagagcccaacaatctgacctatttataccctgccaggccctgcccatg

SEQ ID NO: 505 - DNA, 38 bp, Mus musculus
catggtgctggaggatcatccatcctgacattctggga

SEQ ID NO: 506 - DNA, 95 bp, Mus musculus
ctttaacccatttatggtgtgaccagaaaccacagatcttacctaggcttcagacacatcacccgaggaaagctccattaaaatcctcattcatg

SEQ ID NO: 507 - DNA, 43 bp, Mus musculus
catgtattcataagtggatattagcaagaaagtacaggctaat

SEQ ID NO: 508 - DNA, 170 bp, Mus musculus
cctctggaagtcaagtgcagctttgcttatttgtttaagccatccaccatccagttattagatctgaattcatcttttagggtcagctttgttgtagatttaggatgtggccccagggcaaggtactctgagaaacccttaccccatcccagacgtggtcttctatcatg

SEQ ID NO: 509 - DNA, 135 bp, Mus musculus
gttttctttcttttttttttaaaagaaacagtctcaagtagcccaggcagtccctaaacttattatatagcccaggacagtcttgaattcctgaacctccctcctctacctcgtagtcctgagaccgattgcatg

SEQ ID NO: 510 - DNA, 56 bp, Mus musculus
agagacccagaaataccaaggtgatttccaactgcctgacctgggaggcaagcatg

SEQ ID NO: 511 - DNA, 145 bp, Mus musculus
catgtaagatcttcacttttccagtgtctgtttgtgctgccttcaaactgttgacctgatgtaaaaatgtttgcatcagctcaggtgtatagaattggactgattccaggagagtcaaatatacagaatatctagtgtccaagat

SEQ ID NO: 512 - DNA, 68 bp, Mus musculus
catgctaatggagtttattcttaggactgcctcctgcatccattgattgacttaaatatgtgcacact

SEQ ID NO: 513 - DNA, 218 bp, Mus musculus
actaggtgactgtctcagggtctcactgtgtagtcctggcctagaactctctatggagaccagccagacctcacactcagatccagatgcctcagcctcctaagtgctgggattaaaggccagtcccaccataccctgcccctgtttctgacatttgaacccctcctttagacagtagggaaactgaggccctgagatatgacacttttaggggcatg

SEQ ID NO: 514 - DNA, 168 bp, Mus musculus
aaacttcagaaagcgggggctaccaaggagactcaattaagatctctcctcgatcttgaaaccatccccagcccttcgcaaagcacatttgacggacagggttctcttgtcttgggcaacacatcccggctacgctctgcagggtgaagctgttaagaacgttccatg

SEQ ID NO: 515 - DNA, 307 bp, Mus musculus
gataagcctctacaaagctggagagggcagtccaaagaaacttgaaaagattaaaagacagtgcctaaggacacaaacgtttttccataaagagcctatgacatattttactgctgctaatgaaactgaccttgaaggaacaagtgtttagggttagcctaaactttggaattggtgaaggcaatgtgtcagctagacaaattagagaaagaactcaacagatgagtcaatgaattgttctaaactagcttgacttaggattttcagcacaggaacaaaagcacatactgtccctctggttggcatg

SEQ ID NO: 516 - DNA, 90 bp, Mus musculus
catggaaaatgataaaaaccacactctagaacatattagaggagtgagttaccctgaagaacacattcgttggaaacggatattgtgtaa

SEQ ID NO: 517 - DNA, 150 bp, Mus musculus
catgcccggctctattactatttctttctttcttttttgtttcaggatccagtttccttgataaatttttcttgaatgttgttgttgttttttcttttgctgagtttttcttcaatactgctgctttttctctccaggttcaggatgaga

SEQ ID NO: 518 - DNA, 96 bp, Mus musculus
catgctgtcactaagctgtgctcttccaaggagatgaagagactagctggtacccttgctatgccaggctttcttcttgtttatacacacctaatg

SEQ ID NO: 519 - DNA, 126 bp, Mus musculus
catgatctaatctgaacttgtatcccaaccctttataaacaagtgaatgtgtaatctaaactagtataagctcttgaataatagctgagtgaattgcctttgatacacgtttccaaattagtagcc

SEQ ID NO: 520 - DNA, 55 bp, Mus musculus
gtcaaccacagcagtactgttactttctgtgggggagacgtctcccctcctcatg

SEQ ID NO: 521 - DNA, 134 bp, Mus musculus
ggcagtgagcttgcccactctgctacaggacctcggtgacccactatatacagccctcttcactacggctcacaatcggagtttaagacccagtgaagtaaacccagcaggaccctttacaaagccaggacatg

SEQ ID NO: 522 - DNA, 454 bp, Mus musculus
cttgtccaaaccagcttagtcaacagcctcctatctgggctccatcttaccctcctcatctagctgatgaatgtacctgccttctgttcccttcctcctggtctgagctgagccttcttgggactgagagccttcatccaccacaggcagactatctttagatcatcatagccccaggtcttcattgcagtgcaaaagtgcagaccttacatttccatttttatgctccctttgtaacggctccttaccggactgcagcataagtggctgagtatccaatcacaatagaacacttagttgtttgcttgtctaactctctcagttacaccattgagtatgttacacagggctgctttgtagctgtcactgaggccacaaggcaaggggactaaggcaggactcagatgagcctgtttttacttcccgttgtccctttcactttgggttgagcatg

SEQ ID NO: 523 - DNA, 171 bp, Mus musculus
atatagactcaatcaaggtattattctggaacaaacaactagtaacaaaaatagtgcaattgcaagtatgataacacaaggcagcctttaccagctttgtcggaaggaaattgttctttgaaatctgaattccagagaaaaagtcaaatgtaaactagaagtgtttgcatg

SEQ ID NO: 524 - DNA, 329 bp, Mus musculus
catgtatgtgcgtgtgtgagtgcatcaacacaagtgcatagatgcgtgtgtgtttgtgtgtctgactgtttaagtaggtggcatctgtcctagtcctgacttttgataagtctacacgtttgataagaggatctctctcaccactcaggttcctccccccacctccaccccagtacacagccataactataaactccccacgcagatgaagcccctctgatcccattttagggacataacacccccctcccagactgagctaatgccttggaccctccaaaactgatctgaaccctctctgaccctgccctcctcccagcacagggcaa

SEQ ID NO: 525 - DNA, 102 bp, Mus musculus
catgattttcagttttcttgccatattccacgtcctacagtggacatttctaaattttccacctttttcagttttcgtcgccatatttcacgtcctaaagtg

SEQ ID NO: 526 - DNA, 45 bp, Mus musculus
aagtatgtctgctatgagtcaaaagtcttatttttgcatcacatg

SEQ ID NO: 527 - DNA, 291 bp, Mus musculus
catgccgcagtggccagcagccctggttccagcattctcagagataacaaggagccagtgaccctttcttcaagcaccaaagaaaagctaaccgaccccacaaagacctgagtatgaatggtttctgcagctaaggcacttcctttgaggtcagcgcagttcggggctgagaaaagagcttgccctggcttagagcctttctctggctcactgtcccagccaggacccatccatcagcccacagtggggtggcatagtgcaatcctagagagatgttcaaagggacatatc

SEQ ID NO: 528 - DNA, 115 bp, Mus musculus
attctctgggttttcctgtggtgctctggacccctctcgctcctacaatccttcctccccatcttccactgctctgcctagtatttggctgtgagtctctgcatctgtttccatg

SEQ ID NO: 529 - DNA, 66 bp, Mus musculus
catgcccctctcgaccctgggagcattcaccatctttataaactgattctttctgggaagatgatg

SEQ ID NO: 530 - DNA, 142 bp, Mus musculus
catgaaacacacttttaactttccacatactttttaaaagtgtaccttcccattttttcgcccctagacccaaattggatgtttctggctccctctcgttcgtagctttcctgtgatgtagaaacctcttagaaaccacacc

SEQ ID NO: 531 - DNA, 70 bp, Mus musculus
gtttcccacggtggaagaggcaaacaagatcccttgggcctgccttcttgtggcactaatcttactcatg

SEQ ID NO: 532 - DNA, 155 bp, Mus musculus
  misc_feature (50)..(50): "n" at position 50 can be any base.
atgtggtgtttaaatgagaatgtggcccataggctcatatgttgaatacntattttccagtacttggaagtatttggggaggactagaggtgtgactttttgaagggggtgtattatgtggatgtactaagaacctttaaatccctctgaccatg

SEQ ID NO: 533 - DNA, 19 bp, Mus musculus
gcatcatagttgtaccatg

SEQ ID NO: 534 - DNA, 48 bp, Mus musculus
catgggttaacagtgggccctaaacttgaactagaaaacttaaagatg

SEQ ID NO: 535 - DNA, 343 bp, Mus musculus
caagtctgtctgtctccttactagccttttgctgttctgactctcaaatggttccttaattggccatttgtcccctaaattaggggcgattaggatcaacactcaagcaatgttccagatggggtctgacgttcctcactggggtcccagggctcctctgacttggtcacagaaaggtcagccctctgacctggcatagatgtctggatgacctctgacctcagctcataaacctgactgtggagattgagactggagggactcagggcagtggctcactggacagtgccagggtgtgcagtggtaggcagacttctatgtcaggtcctcctgtgcctccatg

SEQ ID NO: 536 - DNA, 227 bp, Mus musculus
gcacatatctgagcatctcaagaagctgaagcagcagaatcatccgctcgaagcaagtgtaagccaataagaagactctgtctcagaagaaactgaaacgaagagagacaaaaacaacttctggggctgaagagatggctcagcaattaaaagcccattctgctcactcagaggccctctgtgagctgtctccagatgtttaacaagcacagctaacatttggcatg

SEQ ID NO: 537 - DNA, 105 bp, Mus musculus
cacattcattaaagagactttattaaagctcaaagcacatattgcacctcacacaataattgtgggagacttcaacacaccactttcatcaatggacagatcatg

SEQ ID NO: 538 - DNA, 212 bp, Mus musculus
ggggagaggcttcaatgagccccctcacatttgcatttaaatagcagcatcaagcgcttcgcgtgccacacaccagtgggctcccagatgtcaagccggagtcagtcagatggccagtgcccagctgtcctccctatgtcgtgccggagcaggcagtgaccttaaagagacagcgctcaccgctcctggagcccgactctgggtccctcatg

SEQ ID NO: 539 - DNA, 183 bp, Mus musculus
cttgtccgccaccccgcctgcctcattacctggctcactcactaacgtgaaagccttacagaaatctccaggtcctcagcgggaaaggaagtcatcttcttcctcatcctcggaggacagaagtcggatggtaagcatctgtgctgtgctcctctaactgtgacgccgggttcccatcacatg

SEQ ID NO: 540 - DNA, 110 bp, Mus musculus
atatagtatgactgcctcaaaacaaaacaacaacaacaaaaccccaagatatctaaaggaggaacattccaaaagacagaaatgtccatagaccttgacaaaggaacatg

SEQ ID NO: 541 - DNA, 262 bp, Mus musculus
gtcaagtggatgtttctcattttcaatgattttcagttttcttgacatatttcacgtcctacagtggacatttctaaatattccacatttttcagttttcctcgccatatttcacgtcctaaagtgtgtatttctcattttccgtgattttcagttttctcgccatattccaggtcctttagtgtgcatttcgcatttttcacgttttttagtgattttgtcatttttcaagttgtcaagtggatgtttctcattttccatg

SEQ ID NO: 542 - DNA, 169 bp, Mus musculus
catgaagttagaataattgggataaagcttttatcattatcaattggttttgaaattattgtattgatatcttgtaaactgaatatttattggtacataagtctggttatggttgactactttaagttttaagagttttgattcttccaggtaaatgggtgttgtaatg

SEQ ID NO: 543 - DNA, 99 bp, Mus musculus
catgcagccggggtgggatttgaagattatgcctagtgaatatttaatattaaacacggtgtgatcgaattgatagctgttgaaaactagagcgaaacc

SEQ ID NO: 544 - DNA, 164 bp, Mus musculus
ggacagggtctctctctcttgttgttcattgtttcatatatcatcgtcggcctgcttacagactgcattgtgttcccctgtctctgcctcccatctcactgtagaagtaatgggattacagatagatgctactgtgtctgaaagttaaattcctaggccccatg

SEQ ID NO: 545 - DNA, 264 bp, Mus musculus
agtgggagggagcgccactcttggagctaggcaggaactgttgttacttcaaaaactaacaagacaatctcacattcctgagctgaagaccagatgcagccagggacagggttctgccctggccactagatgggctctctggccctgctaaagcactgcacaaaactggacgaggtgcaccaagagtcccgtgtttggccctcagggcagactagagagcaggactttctcctgggagcagaaactgagcctggggtcttcatg

SEQ ID NO: 546 - DNA, 156 bp, Mus musculus
catgctcataattctgcagtgccttctcataacacaggataaaacactctaacctttaacattatacttgaaaacttatgtggttttttcctaccagagtcatatcaaaccagtctccctctccactcacaaggatccagtcacaatggcctttta

SEQ ID NO: 547 - DNA, 130 bp, Mus musculus
ctgtaggacctggaatatggtgagaaaactgaaaatcacggaaaatgagaaatacacactttaggacgtgaaatatggcgaggaaaactgaaaaaagtggaaaatatagaaatgttcactgtaggacatg

SEQ ID NO: 548 - DNA, 101 bp, Mus musculus
catggcgagattctgtgtccaagctgcctctactcgtgacattccaagatgcctctgaggtgggaactgtgaaataggacagagccccacagtcccctctt

SEQ ID NO: 549 - DNA, 271 bp, Mus musculus
catgggggggggtaccaagaagggactgctgtgattgggatgtaaataaataaataaatagaataaacaaaacccaaaaacaaacagaaacctaaactcaataactgcagaaatgactcttgctcttttctggtaaggttagaagcaggttacaaatctatattagagatggaggcatttcacaccagcataggtataggaagtagatgaaatgaggactacactagagtctgtttgtcacaaccaattctgagtgatttcactgagatat

SEQ ID NO: 550 - DNA, 156 bp, Mus musculus
ctctgagaaacctaccccattctccctcctttctcccataagcaaccacctccacagcattatcaaaagactgctgacagattggtggctcagcagggagagtcagagctgtttcttaggtctaagttgtagctccacagtagtatgttctccatg

SEQ ID NO: 551 - DNA, 115 bp, Mus musculus
catggaacactcaaagctggccagggcccatttaccaggtatcctttgccttctcagctgatgggcatcaacacattaattcacatatgactcgtttgtgtcatatcaatagtat

SEQ ID NO: 552 - DNA, 342 bp, Mus musculus
gtggtttttgtggtagagagacacagaagaaactgaagtccttggaacataattatcactgtggttgaatgtttgtgttcctataacatcctatgtaggaactgaacctataaaagtagtggctccgaaggtggtgtccttaaatgtgaactgggctacaagattttgcccttgtgaatggctttatggaagaggctgtcacttttctgtctcttcctccattatcttggaagacacaacagttcaaggtctcatctgggaaacagagacctttaccagaccctaaatctgccagtggtgtcttgatcctggtctttctgtccttaggagctataatgcatg

SEQ ID NO: 553 - DNA, 75 bp, Mus musculus
ggccacagccagtccacctgtatgcagctgggtgcttggagtggccctggtagacaaagtctccatcttgccatg

SEQ ID NO: 554 - DNA, 127 bp, Mus musculus
ccttagggcccaaaatccttcctcccattcttccataagagtccccaatctccatccactgttcacctgtgggtgtgtgtatctgtctaagtcagctgctaggtggagatgctcaaaggacaacatg

SEQ ID NO: 555 - DNA, 108 bp, Mus musculus
  misc_feature (75)..(75): "n" at position 75 can be any base.
gacagtaaagaagacaaagaagtgagtagagctggatgaaaactaggaagttcagacaaagactgcgggaatgangtgtagagtctagagcccaaacagttaaacatg

SEQ ID NO: 556 - DNA, 81 bp, Mus musculus
ctgctacattcttagctctagctaactagcatcaattgtcccaaccccttctatgtatgactccaaagccagtgtcacatg

SEQ ID NO: 557 - DNA, 173 bp, Mus musculus
catggtctctagagctaagagataccaatgctgcggcaggcagtttttattacaatcattacagttttgacagtgtctggccgtgtgccaaggctggccttcatccctgagctcggtgatgcttctgtcctggtcttctggctcgtcacagcttaagaaagtagctgcttctc

SEQ ID NO: 558 - DNA, 105 bp, Mus musculus
catggaaaatgataaaaaccacactgtagaacatattagatgagtgagttacactgaaaaacacattcgttggaaacgggatttgtgtatatcaatgagtagtta

SEQ ID NO: 559 - DNA, 244 bp, Mus musculus
catggaaagataatgtgtaaatttgggtttgccgtggaaaactttggtttctccatcaatggtaattgagagtttggctgggtatagtagcctgggctggcatttttgttctcttaaggtctgtatgaagtctgtccaggatcttctgactctcataatgtctggtgtaaagtctggtgtaattctgacaggcctgcctttatatgttacttgacctttttcccttactgcttttaatattcta

SEQ ID NO: 560 - DNA, 89 bp, Mus musculus
ggtaagagtgggagaaaatgggggtggggggtggggacactgcagaaacctgggagaaaaaaaatccaactaaaatcaggaaacacatg

SEQ ID NO: 561 - DNA, 50 bp, Mus musculus
cacccccatcccgcagttcccagagggaacagtcccagcaaaaatacatg

SEQ ID NO: 562 - DNA, 301 bp, Mus musculus
catggagatgcaatgaaagcacacaatattgctgaaccaaacagaaagctcaaaactaggcacagaaaagagatacaaacacaaatctgaacaaattgaccttctccctatagcataactaatatctcagagataaaagtggtctttatataccagggcgaaagaggtctaaaaagagaggaataaaaaatatggcatatttcctgtcatatgcagaacctatatgagtctttttgtttgtttctttcaatacagcctatgtagctctagctgtcctagaacttactttgtagaccaggct

SEQ ID NO: 563 - DNA, 93 bp, Mus musculus
ctgttctacaatgccggtttccaacgtatgtgtttttcagtgtaactcactcatctaatatgttctacagtgtggtttttatcattttccatg

SEQ ID NO: 564 - DNA, 195 bp, Mus musculus
gacaggctccaatcagatataccaagggcaggaagcacgtgacaaaatcagatgcctggagacaagtgtaataaaagaagcaacagaaaacaaggttacttggcattgtcacaacccaactctcccaccatagcaagtgatggatacaccatcacaccagaaaagcaagatatggatctaaagtcacttctcatg

SEQ ID NO: 565 - DNA, 79 bp, Mus musculus
  misc_feature (54)..(54): "n" at position 54 can be any base.
catgggtccctgaagggtctctcctttagcaaacccctgtacagttgaagtganttttcaggtacccattggtcttagc

SEQ ID NO: 566 - DNA, 163 bp, Mus musculus
ccccactcctcacagggctccccacatctgccctgggacaccccactcctcacagggctccccacatctgccctggcacccctccatttttcaggcacctgaagtccctactttctaaaggccattcttctacctcaggtcttgctctaggactgtcaacatg

SEQ ID NO: 567 - DNA, 90 bp, Mus musculus
caggacagccagggctacacagagaaaccctgtctcaaaaaacaaacaaacaaaaaaaagaccattatgcattcctgcggctctgacatg

SEQ ID NO: 568 - DNA, 63 bp, Mus musculus
catgggcagcacctcgtggaacactattataagtgtcctccagtcaggtcaacagcgtaagat

SEQ ID NO: 569 - DNA, 40 bp, Mus musculus
cctgtacattctgtgttaaggacagagggcctcctgcatg

SEQ ID NO: 570 - DNA, 70 bp, Mus musculus
catggaggcgcaggagttattgtctaaagttgtgaagatgaagcctagattgtattggagatccgggtat

SEQ ID NO: 571 - DNA, 43 bp, Mus musculus
gcagatatttccacctctgccttccacagtccttcctcccatg

SEQ ID NO: 572 - DNA, 106 bp, Mus musculus
catacgcttacaatgtgttgttatttctggttctcgtctgccttctttataaaaacaaatccactaaggtggagtagccagcctttactcagggactgtcaccatg

SEQ ID NO: 573 - DNA, 236 bp, Mus musculus
ttctgtatatattgtgtggtcagaaaaccgtggttttcctggtgtcaagagttaacactttcagtaatcactcattctaaaccagacaaacctttaatctttcatctggaaaggtactcattcaaaccaatgctctcttaaaaccagagtatttaaacagccaactgcatcttcagggtttcatagaaaatcagcttgatctaaaatagtcactgaattctgatatcatagacatg

SEQ ID NO: 574 - DNA, 192 bp, Mus musculus
tccacccacccacccacctgcccacccagacaaatgttcactgagcattcatatactccattcacttctaagtacagagcctaagaatatgagaaaatcctcatagcaaagaaatgcctcttgcaactcgagtaaaaactcgagtatgggatggaagagttgagaaaacagatgatagtatgagagcctatg

SEQ ID NO: 575 - DNA, 173 bp, Mus musculus
aggagcctagcagaattgccctctgagaagctccacccagcagaaacaaatgcagagacccatcgataaacactggacagagcacagagtcttgtggaagagttgggggaagaattgaggaacccaaatgggatagggactccacaagaagaaaaagagagtcaactaacatg

SEQ ID NO: 576 - DNA, 135 bp, Mus musculus
  misc_feature (68)..(68): "n" at position 68 can be any base.
catgtcctacagtggatatttctaaattttcctcctttttcagttttcctcgccatatttgaagtccnaaagtgtgtatttctcatattctgtgattttcagttttctcgccatattccaggtcctacagtgtgc

SEQ ID NO: 577 - DNA, 59 bp, Mus musculus
catgtggaggccagaagtcaacatatagtctccttcccaattacttgtcactggagagc

SEQ ID NO: 578 - DNA, 212 bp, Mus musculus
gttcagtagccagcaggggggataggaccagcccaaattctccctttgcttggccttgactactagtctgggaagggataagtgggctaaccagaagtcttccacatctctaagtgattaaaaatggaagacgtgatctctggtcattcataaacaggcatttctcaaagttggtctgtgcagtttgtgggaaaaaatgaaatgtactcatg

SEQ ID NO: 579 - DNA, 125 bp, Mus musculus
ctacagagtgaggtcaagctcgaggatagccaggcagggatgcacagggaaaccctgtctcaaaaatcaaaaccaacccaacaaacaaaaacaaaaatggaaggatagaagagagataatccatg

SEQ ID NO: 580 - DNA, 66 bp, Mus musculus
catgtactgaatccctgaagttgatgctgagcaccatcttgtgctgttctaccgcatttactgggg

SEQ ID NO: 581 - DNA, 205 bp, Mus musculus
catgtgtcactcaaaggctgctgagaatcaggctgtacctgtattcctaagccatccacagccatcctgacccacagcaaatgctggcagtcgccccacagctggactccgttcctccctccactcctatagccgaggctatccacacaggctatttcagtgccctaagccttgctacccttatgtatacattgaggacaatgat

SEQ ID NO: 582 - DNA, 119 bp, Mus musculus
agaaaccactgccaaatcaatacattttaattggaagtgtttatgaagcccaggagagatccctaaatgtattaattgcttcctgaggaaatataaaactcacagttactaaagccatg

SEQ ID NO: 583 - DNA, 223 bp, Mus musculus
atcttctacacagatgaaactgacaaagtacaaataaagattatataccaaaatgaaaaaaagtaaacagcacacatttatagatgcatctagcatcccccaaagctcaacaccatccatacttgaagactgcagtggtccctctagacagtatgctccaggtcagccctcagcacttgagaataaacagcttcatttactcagcctgttgtcaggatccatg

SEQ ID NO: 584 - DNA, 80 bp, Mus musculus
actgcctcaaaacaaaacaacaacaacaaaaccccaagatatctaaaggaggaacattccaaaagacagaaatgtccatg

SEQ ID NO: 585 - DNA, 129 bp, Mus musculus
catgagctgtcgatagtgacctgcagtcaaggaaatctgagggcttcctaattaacagaggagctctaaatgagagtaacgcgctccacaaaccccctcacactcggtaagtgtcacggtgcagataat

SEQ ID NO: 586 - DNA, 209 bp, Mus musculus
gccgcgtatgtgtttctttttcatagaagaattagcacataatggaatgtgcgtatctgaagtgcacaactgaggagtatttattattacatacctttacaagatatcttttctcagggagcaacctgaaaacataaggagaaaaacataagaactgccactctaagggttggtgaaatggcacagcctggcggtaggacacacacatg

SEQ ID NO: 587 - DNA, 126 bp, Mus musculus
catggagaaacctgggcttattcaagcagtttcctttgtttaccctgcccagggttgccagtgaaggggctcctccatcactaactaaaggtcttatcctatgctggttcctctccaccccaccat

SEQ ID NO: 588 - DNA, 91 bp, Mus musculus
tataggaatagaaattcagaacttatcagtttgttttgcttcaaatgtcaacacataatttaaatttacaaaccccttgcacatttgcatg

SEQ ID NO: 589 - DNA, 214 bp, Mus musculus
gaagacaaaagatgtgtcaaatacctgggcaaaagggggtggtggtgctctctttccaactcctgaaagacacctctgctcagcacactagtttccaggttcctgggttaggatttgggtgagattggtcggcgatggtttggttcctccattctgctgcttctccctgatacattgagttacagcagcccacgcgtacacactctcgcacatg

SEQ ID NO: 590 - DNA, 105 bp, Mus musculus
gaagaggaaataaggcaatagctagactggaaaaacgagccagcctaagaagctgcagagtagtctgtggggttctgctttggttagctgcctttagtgctcatg

SEQ ID NO: 591 - DNA, 66 bp, Mus musculus
catggatagaggatggaagttgaaaacctgctattaagaacatagccctgtccattagtgagagtg

SEQ ID NO: 592 - DNA, 275 bp, Mus musculus
catgtggcccaggggcacttggagccttagatagctgcctttatggctcctggtggccttggatgtgggtgggtgacaggaaacaggaagagctggatagtggggggtccccaggaggagctagctgtgctctctatcacttttgctctcctggggctacccccgtctcaggggaaggcctgtgactggctaagcaacaagtgtgggctgagacctttctctgtgacactctggtgctactctggccatagcacagatctctaggaacgcactct

SEQ ID NO: 593 - DNA, 85 bp, Mus musculus
tatatggatatgtttatgtgagggtaggcactcctggagggtggaggcattaattagatcctctgcaggtgagccacctgacatg

SEQ ID NO: 594 - DNA, 72 bp, Mus musculus
atatgtggactgtagtcatcttgaacatctgtaacaaaatatatagattaggaggtttagacagcagacatg

SEQ ID NO: 595 - DNA, 35 bp, Mus musculus
gtgcctcttgtctgccaagctggtattgtagcatg

SEQ ID NO: 596 - DNA, 221 bp, Mus musculus
atttgtgacatcttaggagcttaggttggtcttcgagacacagggctgtcccctgtaaagcaggttccatcagtgactccagggttttagcagttcagtggcgtagttttcagactgcttaagatttctcaggggctaggcgtggggcagagaccctgcagaccctggctagaacagaggccctgggagacagttgagggtgctcagctgtggaggacatg

SEQ ID NO: 597 - DNA, 39 bp, Mus musculus
catgacgacttgaaaaatgacgaaatcactaaaaaacaa

SEQ ID NO: 598 - DNA, 78 bp, Mus musculus
cctaagtctgaccgtgccacttcccagtcttccctacacttcaatgcttttaggcacaacaaatttgtacccctcatg

SEQ ID NO: 599 - DNA, 46 bp, Mus musculus
ccccccagcctgctccctccccggagggagtccccagtgtgacatg

SEQ ID NO: 600 - DNA, 77 bp, Mus musculus
gtttaggtgatagggtacttgcccagcagtaggtggtgcccaggattctatcctcaaaattgcacaaacagaacatg

SEQ ID NO: 601 - DNA, 51 bp, Mus musculus
catgttgtgtagatacctacataattataattcataactgtaatttgctac

SEQ ID NO: 602 - DNA, 145 bp, Mus musculus
catgggtttgagccttgtcctgagctggaggaagagagtgacccaaagggaccttggtagcagccagggatgtgttggggagcagagaaacttttatgaacttcagtttcagtactgaaacttccctttccctagacttcctttg

SEQ ID NO: 603 - DNA, 122 bp, Mus musculus
catgggacaactcctttttccttctgggtcaggggagagagacctcctatctaaactgtataggccattgctgtagcccttagctcacttccggggcggggaggaggaggttaagaccctat

SEQ ID NO: 604 - DNA, 79 bp, Mus musculus
catgaaatgaaagaacagagtagcaatttggggagaaaagcctgccgagcggacttaatctttcccaagtgctatcagt

SEQ ID NO: 605 - DNA, 301 bp, Mus musculus
atgcttgtctttcccgcccattacctgcttttgtttgagataatagttttgttactttatcaactagtagcgactagtttacatttggtttcataaataagatccattttaatctgagttttccatccttgatttattttgattcatattttaattgtctagttcccatccctgggcaggactttttgggaaagtcttgcaggtgactatgttgagaatgatttatgttgtattagcacaggtacattcgacagtgctggttccttctggagcgcctcgggtgtgggtccttttcctcagc

SEQ ID NO: 606 - DNA, 65 bp, Mus musculus
catgagtttgattatttcctgaattctacctctcttgggtctattttcttctttttgttctagag

SEQ ID NO: 607 - DNA, 40 bp, Mus musculus
gggataagactggatagtaagccgggcgtggtggtgcatg

SEQ ID NO: 608 - DNA, 230 bp, Mus musculus
cagaaggtagtgtttcacaacagtcctcccgatgatcaattgttttacactaaaccatataggaattcaccctgagaggagttcgaaagcctttcaaaacctgtactgatataaagcaaatctcttttggattcccaatcaaaatgatttggcagaactttaaggccacaaaaattgtgtctgaacaacccctctgagcccagttttgttagcttaaattaagggccatg

SEQ ID NO: 609 - DNA, 161 bp, Mus musculus
cctcaaactaagaagcatccatttcgaagctgctgggattaagggagtatgccaccaccaccagctatggcatttttttctttaattttactatttttttgcttgtatattatggtttccagttttgtgggttttataagctttgagtgtgtttctgcatg

SEQ ID NO: 610 - DNA, 45 bp, Mus musculus
gtccactttaggacgtggaatatggtaagaaaactgaaaatcatg

SEQ ID NO: 611 - DNA, 173 bp, Mus musculus
catggtcagctctcactgccccatcccctgtctccagttcacgcactgtatcctgtgtctttctctgtggctagactcttctcttgggggaggggagtcttgtatatcgatgtgtgctcacgcacatagaggctaaagattaatctaggtgtattcattcatcgtctcattgc

SEQ ID NO: 612 - DNA, 66 bp, Mus musculus
catgtgtttcctgattttagttggattttttttctcccaggtttctgcagtgtccccaccccccac

SEQ ID NO: 613 - DNA, 155 bp, Mus musculus
atggtgtctgttcatagcagtaaaaccttaactaagacactgatataactcacctttcccagcctcaaagtctctaccatctcaggatccactcactcattcaccaaacttcatcaaatgcccactgtgctatcatcagtacagaataaatcatg

SEQ ID NO: 614 - DNA, 152 bp, Mus musculus
catgagactgtcacaagctcctgggatggggaccttaccagaaagccaccaaatcagaggcatccctgtttggtgagggtacatttgtttttccccaggccctgagtgccaggcaggagcaggcaaagttcacctgggaggatgccctggat

SEQ ID NO: 615 - DNA, 110 bp, Mus musculus
gttttggttcttttcaaagaaaaacaaaggtcattgcagctttttgtaccattgaggtgatggtaggaattgagatatataatctacttgaagatatatattatggcatg

SEQ ID NO: 616 - DNA, 78 bp, Mus musculus
ccgctgctctctcaccaacccagtgtgtctgcttttagcccagacgggggagggggtaagggggtggtctgtctcatg

SEQ ID NO: 617 - DNA, 43 bp, Mus musculus
gtgtccctcctgtcgttaggcagtacttccaaatcaaaccatg

SEQ ID NO: 618 - DNA, 117 bp, Mus musculus
agctggtacaatgcttagagcagagctgcagaagcaatacaagagatcctggctcagctaggtgcaagctggaatagactcctgacagttgtcctatgaactccatacacaggcatg

SEQ ID NO: 619 - DNA, 80 bp, Mus musculus
atggatccctggggggcagtctctggatggtccttccttctgtctcagcaccaaacattgtctctgtaactccttccatg

SEQ ID NO: 620 - DNA, 72 bp, Mus musculus
catgatgcacttagcaattcctcaattgagactcaagtgagcctaggctgtgacaaaatgactgttaaaact

SEQ ID NO: 621 - DNA, 177 bp, Mus musculus
catgtaaagctagttcaaaacatactaaataattcagttgtagaagaggtgaggttatctcactgccaggataagctattgaacaagcaagggttctcacttactgtttaagtggaagtgttttcttacttcaaaaagtcattaatgaattttaagctgcataaatatttagttatt

SEQ ID NO: 622 - DNA, 128 bp, Mus musculus
taagcttttctcttacacaatcccccggaaacccacagtttaggtcacaaagacccaggcacctattcctaggcctggtaagtgggcacccaccatttacaaagagctcagcatttggctcacacatg

SEQ ID NO: 623 - DNA, 187 bp, Mus musculus
catgaagatgaaccgggcttgtttctctggcaactaggctcagaaaggataggaccaccagccgagtagctgtcagatggagctgaagacctgagggaaagaatgcttgtgggaagaagctggctccttttggttttgttgttgctggttttgtgaccggatcttgctgtgtgaccctacctaacat

SEQ ID NO: 624 - DNA, 227 bp, Mus musculus
catggacttaattttactgcatttgaattatggaaaatatatatgaaaagtctttagaaaaaggcagaggacgaaaaaaaccaaagaactttaattatctgagaccaagaaaactctttaagaaaaagcagtagatttaaactacgtgttgttaaaatagtcctgtatagatataaagtccctcagagggaagagatttgttgaataaattcagacactcaagagaa

SEQ ID NO: 625 - DNA, 113 bp, Mus musculus
attaaacagcccagtgcactcagaagtgaatgttgagaagtgggtaatctggggacaaacagagggaagaatagtgcccttggcacgtgcaaaggagtttgggaacaaacatg

SEQ ID NO: 626 - DNA, 198 bp, Mus musculus
catgtatgacagtgaggtcaggagtgcccagggagcttgcattggcagaacagcctttcctggccaagcctagtgtcatcaagtatatattggaccagaccttataaaacttgggttccactctggctggaccagcctcaaggcgtcgcctctccaggcctacctcccagacgcagaggcagcatttggaggattgaa

SEQ ID NO: 627 - DNA, 157 bp, Mus musculus
catgggaacttgttccaagcaagggactctgctacaccttcaagggacgctgctaatactgggttcaaccttgggcagcgtgcacagcaggagtgggagggctctgatgaggagagccacccacactgtgagatctaggagataaggtcacatccac

SEQ ID NO: 628 - DNA, 91 bp, Mus musculus
ccctccagcaaattgaaatacgaaagactcaaacacattagaaccattccaataaaaacttgcattgccccaggcccctcccaccaccatg

SEQ ID NO: 629 - DNA, 63 bp, Mus musculus
caagagtatatatccaagaaaaatacagctgagttgactgttagttctgttttggccttcatg

SEQ ID NO: 630 - DNA, 155 bp, Mus musculus
ggtaaaaactctaccagttaaactacattcccagcctgcctccaatgaatttaatttgtgtttttagggtttctgttattgttgtttttgagacagggattcacaaagatctgcctgcctctgcttcctgagtgctaaaattaaaggtatgcatg

SEQ ID NO: 631 - DNA, 80 bp, Mus musculus
gtttagtaactgttttctgtattacttttgttgaaaattagattgttcctggtgactttgtgtgctatattctctgcatg

SEQ ID NO: 632 - DNA, 121 bp, Mus musculus
catgtttctgcttctactttatccaccctgcacacactgactgctatgttcctgtaccttttccatctctccattgaatattcactccaacagtggcattggaaattgcagtggagatacc

SEQ ID NO: 633 - DNA, 90 bp, Mus musculus
acgatggtcttgccctttctcacaccatcaatagtcactcagagctgtggttgttatctgaagtgtgttgcagtccaactttgccccatg

SEQ ID NO: 634 - DNA, 51 bp, Mus musculus
ggagtgtaagcgtcggtgtgtcacccgtgagattaagtcaaagtgtacatg

SEQ ID NO: 635 - DNA, 148 bp, Mus musculus
tagacccagtcttgcactggcctgggactcgcttattaggtttgactgttatctggccaacaaacaccaggaaatggggtgacaggtggttgtgagccctctgaaatgggcattgggacctgaacctgggtcctctgtaagagacatg

SEQ ID NO: 636 - DNA, 60 bp, Mus musculus
  misc_feature (55)..(55): "n" at position 55 can be any base.
tcaccccagctggggctgtgctgaagactctgaaggggaagataggcctatggtnacatg

SEQ ID NO: 637 - DNA, 115 bp, Mus musculus
gttgggctgagccacaagtacacctccactcactgagccatctagcaggtcccaaacaaggtgacttttgtcatccagcaagacatagccatctatgccagtcatccttgtcatg

SEQ ID NO: 638 - DNA, 202 bp, Mus musculus
taacatatttgcttgttatgaaggaaaatgttggatgtgtgtgcctgtggttgagtactgcaagtagtgtcagggaagagaaacctagcttgaacagtcccctcatctccttcatatcctcactccttgtcaggccctgtattaggtagtgcttccctacctccctaatgctgtgaccctttctttaatagagttcctcatg

SEQ ID NO: 639 - DNA, 139 bp, Mus musculus
catgtgagcacaggtacctatggaaaccaaaagtgtaggatcccttagaactggaattataggcagctgtacgctattgatgtgggtgctggaaactgaactccaggcttcttgaagagcatcaactgctcttagctgg

SEQ ID NO: 640 - DNA, 253 bp, Mus musculus
catgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagcaaatggatggatcatagggctcccaatggaggagctagagaaagtagccaaggagctaaagggatctgcaaccctataggtgaaacaa

SEQ ID NO: 641 - DNA, 76 bp, Mus musculus
catgtcctagagttgttccagcacagaagcttttgggagagaccaccattactgaaacgcagcagatgctgcagct

SEQ ID NO: 642 - DNA, 55 bp, Mus musculus
ctgcttgttgtggggaccagccagacaccctccacaggtgcagtggtgcaacatg

SEQ ID NO: 643 - DNA, 81 bp, Mus musculus
catgatgtttgtgcaggaatagaaaccctgactaagacagaggatattcaagatccaaactagcaggttagctgtggttcc

SEQ ID NO: 644 - DNA, 41 bp, Mus musculus
catgaagcacacattaccctgtgacttgcttttttattaat

SEQ ID NO: 645 - DNA, 174 bp, Mus musculus
catgtgtcctcttgtcttgtagtctctattctttgtgattccgcagctctccatagagtgcagttctatgtcctgcctgcaaggtccattggcttactagggtctgcccctcccagaagagtagctcatttagaatgcattactggtgtgctgtcttgcatcttttttacccat

SEQ ID NO: 646 - DNA, 130 bp, Mus musculus
atctatgtttatgcactactaattactgtttagtttatatatgccctaataattaccccattgaaaacttaaattttgtttcaaaagtgtggtctcattggaggtgttaatgtacaatgtctttctcatg

SEQ ID NO: 647 - DNA, 96 bp, Mus musculus
catggccagctgagcgggctggaacctgcccttctgcttcctgtccctgcacctcagcaccgctgtgcacttggtactagacctcaatcaccgcag

SEQ ID NO: 648 - DNA, 55 bp, Mus musculus
catgtgcgtcccccccaaacacgcaagcgcacacccacaaagagaagagacaggg

SEQ ID NO: 649 - DNA, 54 bp, Mus musculus
catggccacttggagagaagggggaagggaatgcggagagagcgggagcaagag

SEQ ID NO: 650 - DNA, 175 bp, Mus musculus
cttaagcactgatcaatggccaaggtttgccgacttgggatctggggtatagacatccacccactgagaccctctaacaaaaccagatgtggaggtacgaagcctggctcaggggcctgtcctttgtcatcagaattcaccagctgcagctcctgggtcagctttgtttggcatg

SEQ ID NO: 651 - DNA, 48 bp, Mus musculus
gtgtattgatatgcaaatgtgttaaaatatgatttaaaattccccatg

SEQ ID NO: 652 - DNA, 44 bp, Mus musculus
gcaaagtgtccacactttggtcttcgttcttcttgagtttcatg

SEQ ID NO: 653 - DNA, 66 bp, Mus musculus
atagcaggtcctggataccccaacataccagaaaagcaagattcagatctaaaatcacttctcatg

SEQ ID NO: 654 - DNA, 305 bp, Mus musculus
catgtcctggctttgtaaagggtcctgctgggtttacttcactgggtcttaaactccgattgtgagccgtagtgaagagggctgtatatagtgggtcaccgaggtcctgtagcagagtgggcaagctcactgcctgctaccagcagttcactatgttttatggtctgctgcctgctggtggtttatagatgctgtgtcgtaagagaaaagttcagggtagcctggagtgaatggagttggggtatcagggaggtctttgtacactggggtgagctaggcctctggaaagcttctgggggttcccc

SEQ ID NO: 655 - DNA, 289 bp, Mus musculus
catgctcccaggcaccaggcttgctttgcataggtgggacagggtcccaatactcagcctggggtgccaatgaggctcaggccacacaccctcttggtaggagtcactgtagtggggtctgtgagagccagtaacttgtgagggtgtgaacttagctcaggacagaggccagcaggaagctttccctacagagagtgttttcgtcttttcctttttctggtttgtttcttgggaagggaacaattttcgcttttagttggcttgtattattcgctactgaaaccttaag

SEQ ID NO: 656 - DNA, 29 bp, Mus musculus
catgtattaagtccctcgtgaggaagggt

SEQ ID NO: 657 - DNA, 248 bp, Mus musculus
catgagtcagaggcttctactccagttaaaactgatctgggtatagaattgtgttctcaagaaatagtaagttataatcaactaagtcatctcctgtctcatttttttcttccaaatcgggtcctcgaattgttataagaagattcaatcaatcaacagtatccctttcccaatttgtgtgctaagtggaaacaggtcttagcacatcaatcacataaagttcaattaagaaggaatttaaagatcag

SEQ ID NO: 658 - DNA, 127 bp, Mus musculus
gctatgagtctccacttgtaaacaattatactcaaacatattcaggacacacttgggcttcctccatcaagccaggcaggtttgttttcttgtttgttttgagatagatggatgggccagcttcatg

SEQ ID NO: 659 - DNA, 68 bp, Mus musculus
cccacccctagcaaccagttcctcctctgaatggaagacatctgataccaactttgagctttcacatg

SEQ ID NO: 660 - DNA, 33 bp, Mus musculus
  misc_feature (4)..(5): "n" at positions 4 and 5 can be any base
atcnncgaatcattctaggcttgtgggaccatg

SEQ ID NO: 661 - DNA, 75 bp, Mus musculus
actattctcaacaataaatgaacttctgggggaatcaccaatcctgatttcaaacggtactgtagagcaatcatg

SEQ ID NO: 662 - DNA, 113 bp, Mus musculus
cctaggcacccaccacaatagttaatccatctttgaatttttgacccagtgttgccaagtattcattgcaacagcttttcaaatgttttattctttcccaaataaattccatg

SEQ ID NO: 663 - DNA, 79 bp, Mus musculus
agaggctaccccttcaagtggcttgcctagtatagctattacagacagagaacttccagtaatttcctcaagccacatg

SEQ ID NO: 664 - DNA, 136 bp, Mus musculus
actctgaactttgctttgcctggtatttttgcctctcttatcccattgaccctgtacagaaaagctgaggaagcaggtgcaaccaggcatctcaggcacccagttaagaagtagatgaaatactgtaatgtacatg

SEQ ID NO: 665 - DNA, 105 bp, Mus musculus
catgattttcagttttcttgccatattccacgtcctacagtggacatttctaaattttccacctttttcagttttcctcgccatatttcacgtcctaaagtgtgt

SEQ ID NO: 666 - DNA, 45 bp, Mus musculus
catgagacagtcccagatccctcaccataaagagctaccatatac

SEQ ID NO: 667 - DNA, 181 bp, Mus musculus
catgcgaccatccatcaggagttggaggtgccatcggctctgccttacagaaaaggaatctgagatttagaaaccccaggtgacccactcagggccaccggggcagtaaaaagaatctaagatctaaagtcagtggaaactcctcccaaccagcagagactcctcccagccagctcttgat

SEQ ID NO: 668 - DNA, 55 bp, Mus musculus
gggaagcaagaggcagtaagaaaggggaaactggggaggtaaccaaagtcacatg

SEQ ID NO: 669 - DNA, 70 bp, Mus musculus
catgctaacaaagaatggggaaagctctctaggcttccaccttaaacaatgaggaagggaagaaggaaag

SEQ ID NO: 670 - DNA, 173 bp, Mus musculus
catgttggtgggactttatgggtattgcttctgatattactaggaggcacaatctcacagaaaactccctgatcttacaatccttctgccccctcttttgcaatgttccctgagcctcaagtatggagttattttatagctgtattcattgagaccagaatccacaggtatgc

SEQ ID NO: 671 - DNA, 18 bp, Mus musculus
ctcacacagatatgcatg

SEQ ID NO: 672 - DNA, 62 bp, Mus musculus
agaagtgatctttcttctgtgtgtccctgtcaccctgggaggcaatcagacggtccctcatg

SEQ ID NO: 673 - DNA, 48 bp, Mus musculus
ctttccttttgttttggacgaatattattgaaatatgtagtgtgcatg

SEQ ID NO: 674 - DNA, 110 bp, Mus musculus
catgagatatgattttagatctgaatcttgcttttcaggtgtcttggcatattcagaactcgctgtggtgggtgaactgggttctgatgatgcccattggtgctggtttc

SEQ ID NO: 675 - DNA, 42 bp, Mus musculus
catggaaaggtatttggaaataggctgttttgtgtgtaactc

SEQ ID NO: 676 - DNA, 80 bp, Mus musculus
ccctaggactcacctggtaggaaagaagtaattcttccaagttgtcccctgacatccacaagcacatagtgtcaggcatg

SEQ ID NO: 677 - DNA, 72 bp, Mus musculus
catgccattcatacatactggcaatggatatatagaaaatgagactccttctaatattgtgtgatgacagat

SEQ ID NO: 678 - DNA, 43 bp, Mus musculus
agaaaccatttacactgccaggtttggggcctgcctatgcatg

SEQ ID NO: 679 - DNA, 282 bp, Mus musculus
gatccctttaacttcttggatagtttctctagctcctccattgggggccctgtgatccatccaatagctgactgtgagcatccacttatgtgtttgctaggccctggcatagtctcataagagacagctatatcagggtcctttcagcaaactcttgctagtgaatgcaatggtgtcatcatttggaggctgattatgggatggatccctggatatggcagtctctagatggtccatccttttgtctcagctccaaactttgtctctgtaactccttccatg

SEQ ID NO: 680 - DNA, 158 bp, Mus musculus
agggtggtctctgcaacccaggctggaacccagcacaataaatagttttatttacataaccgaacgcgtggctctgcggccacatttcggtgcaaattatttacacagtgatgaggaggcaggacaggaaggggtgggaggaggctgagggaggcatg

SEQ ID NO: 681 - DNA, 50 bp, Mus musculus
catgtgtgttcttttgtgattgggttacctcactcaggatgatattttct

SEQ ID NO: 682 - DNA, 63 bp, Mus musculus
catgaggccaagggagaggcaaattcctgtgtgaatcaattatcatctcacagagaacatacc

SEQ ID NO: 683 - DNA, 174 bp, Mus musculus
  misc_feature (152)..(152): "n" at position 152 can be any base.
agtagtatgccacagggagaaagggtatttatcaaagggacaggagctagttgtggtgaccttacctatctgcttgcctctgcctccacggtgctgggattgaaggtgtgcaccaccacacccagcttcagatttttgtttttatttattgngtattcctgtttcacctgcatg

SEQ ID NO: 684 - DNA, 81 bp, Mus musculus
catgcatatacaggatataacctttgtaagtaagaataaagcacataaaaaatactttcagtaatattgtccaaaccactt

SEQ ID NO: 685 - DNA, 142 bp, Mus musculus
catgtgtgtgtttgtgtttgcggagtgtgggggcggcagggaaaggtggccaggctgtcactcagagatcaggatgacaggcgctccctcatctaggcgcgggagctctgattgcagattcgaggaaacaaaatagcaattg

SEQ ID NO: 686 - DNA, 117 bp, Mus musculus
catgaagatgaaccgggcttgtttctctggcaactaggctcagaaaggataggtccaccagccgagtagctgtcagatggagctgaagacctgagggaaagaatgcttgtgggaaga

SEQ ID NO: 687 - DNA, 33 bp, Mus musculus
tcagttccaagagatgacacagccgcagtcatg

SEQ ID NO: 688 - DNA, 94 bp, Mus musculus
cagagactgaaggaaagaccatccagtgactggcccaacttgggatccatcccatttgaaagcatcaaatccagacactattactgataccatg

SEQ ID NO: 689 - DNA, 58 bp, Mus musculus
ccctacagtgacacttactccaataaggccacacatcctagtagtgccagtccccatg

SEQ ID NO: 690 - DNA, 76 bp, Mus musculus
ggcctctattctcggttcagattaagtacctggcttcactgagagcggctctttcattcctaaaatggttctcatg

SEQ ID NO: 691 - DNA, 46 bp, Mus musculus
agtagatggcagagaataatcaaactcagggctgaaattaaccatg

SEQ ID NO: 692 - DNA, 168 bp, Mus musculus
ccaacccaacagctgggaagggttggaagtagccccgaggctggttagtccccttccagatggggaggttagactggggctagccaggctgctccacatagacttccgattcgcattagaaatgaaaagaggagaggaaagggaaaaggaagaaaggctacaagcatg

SEQ ID NO: 693 - DNA, 106 bp, Mus musculus
catggggtctggagccagctatcaaacccaggattgtcttaactgtggtggcttggatgagaatggccgccataggcgcatagatttgaattcttggtccctagtt

SEQ ID NO: 694 - DNA, 52 bp, Mus musculus
acggtgggctgatattttctagatctcctagtgcctatcccctattatcatg

SEQ ID NO: 695 - DNA, 37 bp, Mus musculus
catgaattttgagatattctctgaaccaaacaatatt

SEQ ID NO: 696 - DNA, 158 bp, Mus musculus
ggagaaattatgccttaaattaaaaagcaaatattgaaaaattaaatataatttccattaaatcataatggaccaacaacagaacacatctatctatgtatctatctatgtatctatgtatttatctacctatctatctgaaaagcaaaaactacatg

SEQ ID NO: 697 - DNA, 83 bp, Mus musculus
gcaaggacaactgacagtttgaagcaactattttcatcttgactctcactcggcttttaacgtccattcaggaaacaggcatg

SEQ ID NO: 698 - DNA, 166 bp, Mus musculus
catgagaagtcacaattccaccacttaaaatcagtgcttggaaggatactgtaggccaagaggtaagtagaggggacagcagtgcacgtttttcaaagtgtgggtgtgtgtttgtgggtgtgtgtctgtctgcctgtgcgtgtatgtgggtcagtacaggaaaagc

SEQ ID NO: 699 - DNA, 148 bp, Mus musculus
caagataaactcttaatgggattctagggagtcattctgtagagagcacttgactagaaggttaagtcttagatccagatcccagcacaaacataatacatcctatactcacacacacacacacacacacacacacgcagtcctcatg

SEQ ID NO: 700 - DNA, 134 bp, Mus musculus
catgtctcaaaaaaaaaaaagaatcacttggattgtacatagtagttaataatatgtaattagtctaactgtgaaggggcacttattagtttctactatgtagtgtaaatgaactatgttgctattagaaattc

SEQ ID NO: 701 - DNA, 118 bp, Mus musculus
gaaggttgaaatctgtaatctatcttctatggcatcattcacctctctaatacagctgtagagaaaaatgtctgaagattcggttctactctcgttctttgaggtctcccaacccatg

SEQ ID NO: 702 - DNA, 228 bp, Mus musculus
catggctggactatagagctctagcttcagttgctgggatgttcagtgcatcaccacagagagggttcttaagtggtgatggtggtagtggaaaggtggaccctccagacaaaggaagcactcaccacgaccctgctcacctgtgaacctttcctttcagactgattcctgagatcagccaggcagggctaccaaccagggactcgtaatgaaaatttaggcatatgg

SEQ ID NO: 703 - DNA, 149 bp, Mus musculus
  misc_feature (124)..(124): "n" at position 124 can be any bse.
catggtctggtgagtatggcaccagataggatgttatgcccgtttcttatctcaagaaacaaggaatcttgtttcttatcattaataggaagaatagagcagtcctggctaaatgaaaggtggnaaagttggtttgagtatctctttcc

SEQ ID NO: 704 - DNA, 21 bp, Mus musculus
aaaatccaatacacattcatg

SEQ ID NO: 705 - DNA, 245 bp, Mus musculus
ccctttgttgtgcatttcagctaatctcatccctgtttgggtcctggaaccctcttgcttccctggcatctaggacttgctagtggctacccccagctccccattccccattgctacacacctctgttcaaattcctgaccctctgtatatcatcccagtctcttctaatacctgacctgaaccccctttttcccctccctctattctcttccttgcaagtccctcccaccttctaccttccatg

SEQ ID NO: 706 - DNA, 183 bp, Mus musculus
catgggtcatttctgatctttaccaagcaacagtgatgaatctataaatagaaccatcagttcaagaaacacaactttagattcctttccataccttgcttttgtttcttacatcttccccctgccctgtggtttttcttttaatcttgtttttacaatccaaattgtatccccttctctgtc

SEQ ID NO: 707 - DNA, 55 bp, Mus musculus
ttgggcctttgcataccctgttctggctaagacaattgtcacctgactgggcatg

SEQ ID NO: 708 - DNA, 25 bp, Mus musculus
aagtggatgtttctcattttccatg

SEQ ID NO: 709 - DNA, 294 bp, Mus musculus
tataagcaatcccaaaaattctacctgggaactcctagagctgataacaccttcagtgagccaagtatctgggtataggattaattttaaaaaaatagaaaatcagtatctctcttacatacaaataacaaaagggctgaaaaagaaattaaggaaataaaacccttcacaatagccataaataatataaactatcttgggataactctaaccaggcaagcaaaagacctgtatgatcaaatctttgaagaagaaaattgaaaaaggtatcagaggaggtaaagatctcccatg

SEQ ID NO: 710 - DNA, 28 bp, Mus musculus
catgggctctgcttaagaaaccccggag

SEQ ID NO: 711 - DNA, 197 bp, Mus musculus
  misc_feature (29)..(47): "n" at positions 29-30, 39, 45 and 47 can be any base.
catgcttttaggccttttcacgatcttannggggaccgngagagntngctgctggatgatctctgagagagcttatcgtcctcaaactgctgatattcaagctgtttcgcagctgcagcagcaaagtcccggtctttgtcaccgatctgtgaacagcaacaatgagcacctttcataacagacaggaaatggatgct

SEQ ID NO: 712 - DNA, 26 bp, Mus musculus
ggcgtacctgtgtatatgcatgcatg

SEQ ID NO: 713 - DNA, 293 bp, Mus musculus
gtgctaggctcactcaagataaaatttgctatttcagctccctggataataaaatctatcctctcacagctgtgactctcacaggggtgcaggcaggacgacatcaagagagtgatggcctctaacaagtgttctgcccacttcctcttccgggtcaaagactagatctagactggtggggctgttgattcactatgaatgtgcctgacaccatcccacacttagcatcatagacacttgggggactggtgatacactatgatgcctgacaccatcccacacttaacatcatg

SEQ ID NO: 714 - DNA, 261 bp, Mus musculus
ctatcccgagggtgagggcagttctatgccaaggttctcatcacagagatacagaggaagctgggcctgtcttagggttggctgtctggagatcctggagccctggaggtgggtagcaagaacaaaggaagtacttcacctgataaaaacagttcccagagaaacacatatacgcttcatatacaggagtgcgagtgtgtgtgtgcgcgcagagaggcagaggcctggaagtcaaaagttcagggccagtttgtgtgcatg

SEQ ID NO: 715 - DNA, 160 bp, Mus musculus
ggggttgactagaagaaggaggcgattagggtgtatcatatgagagaagaataaataaaggaaaaaataaatttacaaggattaaaaagtaattacatacatacatacatacatacatccatacatacatacatacaagttaaactgttatggtagcatg

SEQ ID NO: 716 - DNA, 190 bp, Mus musculus
aggatgatattttctagttccatccatttgcctaagaatttcttgaattcattgcttttaatagctgagtagtactccattttgtaagtataccatattgtctgtatccattcctctgttgaaggacatctgggttctttccagcttctggctattataaatgaagttgctatgaacatagtgaagcatg

SEQ ID NO: 717 - DNA, 321 bp, Mus musculus
catgcctgcaggtcacagccttgcgcgcctccagtgcccagcgttcaaagtgacacagactctgtcaggatggttcaaatgcaaatctctgcaactgcgttagccgcttctaaccaagacagaaagctgccgtcctgtccttcgtgtctgtccccataccccatatcgggtagcttttctttcagcattgtccagacaccatcatatgcctacatcgcacaagttctctgaggccagataattggcagcactcctgttgtgtgccgagagtgcagaaaagggctatcccgaaaaggtgtgatctggaaagaaggaaaaaac

SEQ ID NO: 718 - DNA, 172 bp, Mus musculus
atcttttggccagagcaagcagggactgagtgagcagaggtgacaggagcgagcaaggctgacaaagtcttccatattcctactaggatgacccattaagccccatttaaagcattccattgctttccaaatacaaagtcccaaaatccacattctttcaaataaaagcatg

SEQ ID NO: 719 - DNA, 216 bp, Mus musculus
ttaacatatggtttttaaaaatccataatgagcatatgatagagaagtcatcagagctcttcagctccacatcatctgtccccagaagtattactactcctaacttgctgagccaaggcacagatattctttgtgtaagcatctcttctttatcctgtgttgccacgcaggagcacgcacactgcttcctgtctgaggttgttccatatcagcatg

SEQ ID NO: 720 - DNA, 36 bp, Mus musculus
catgccagggcttgaattaacacaagtgccccagat

SEQ ID NO: 721 - DNA, 20 bp, Mus musculus
cctgtctgtatatgcacatg

SEQ ID NO: 722 - DNA, 180 bp, Mus musculus
catggaaaatgagaaacatccacttgacgacttgaagaatgacgaaatcactggaaatcgtgaaaaatgagaaatgcacactgtaggacctggaatatggcgagaaaactgaaaatcacggaaaatgagaaatacacactttagtacgtgaaatatggcgaggaaaactgaaaaaggtgg

SEQ ID NO: 723 - DNA, 118 bp, Mus musculus
  misc_feature (63)..(63): "n" at position 63 can be any base.
catgaaggtaaattatgaccatcagggttcagacctcagctcgaccggagaccagcctgcaantccccacagccctccctaaagtgggttaaaagacagaaaagaattaaatatctga

SEQ ID NO: 724 - DNA, 36 bp, Mus musculus
catgcactagcaagattttgctgaaaggacccagat

SEQ ID NO: 725 - DNA, 18 bp, Mus musculus
gacacatacacacacatg

SEQ ID NO: 726 - DNA, 275 bp, Mus musculus
gtaaatgtattaggttcagaactggcactgctcacttatgttcacagttgtttgggtaaaactagaaccaaacacaaaagcaaaagagccaagcagcagagcagggagcaaggggcttggggaaaacactcacctctgttgtgtcttcttctagctgtcagggcattgagtggcaaggagtggaaaggaactttgggcattccgagtcaggaaaagtgtaccaaaataacactatggaggttagcaagtgttctagagggcagaataaatacatg

SEQ ID NO: 727 - DNA, 166 bp, Mus musculus
gtttaggtcattggtggtacactctccaaggacagtataaattgatttttttctgtatccttctttgttcttggccataaggcacttggagtgcattaatatgtacttattattactatgtcttttcttgtctttggcttaaaagaaacagggtcaagtgaccatg

SEQ ID NO: 728 - DNA, 80 bp, Mus musculus
agttttctttaaaaaaataaagtaggaatgaaactggaacaaaaatgcaataaattttaaaccatcaccgctaaaacatg

SEQ ID NO: 729 - DNA, 31 bp, Mus musculus
catgattttcagttttcttgccatattccac

SEQ ID NO: 730 - DNA, 125 bp, Mus musculus
gagaggagcctggggaaatgaaggtccagcaacaggcccaaagtgggatccagcttaaggggaggccccaaggcctgacactattactgaggctatggagcactcataaaaatggacccagcatg

SEQ ID NO: 731 - DNA, 107 bp, Mus musculus
catggcagccttggagtatcaggctgctgttcccaatgtgggatgcagagggcactgccagcctggttatcacgcaccactgtcacacagggaagcgcccccttccc

SEQ ID NO: 732 - DNA, 73 bp, Mus musculus
ggagttcttctcttcaataacagagtaaattctccctcagcagttctcccaggaaacccataacctagccatg

SEQ ID NO: 733 - DNA, 54 bp, Mus musculus
ccttagatgtttgtctaatcgacaaaatactttatatgtgaaaaggaaagcatg

SEQ ID NO: 734 - DNA, 57 bp, Mus musculus
aataatcagatttccagagctcccaggaactaaaccaacaaccaacgaatacacatg

SEQ ID NO: 735 - DNA, 195 bp, Mus musculus
atccagtaatcattcatcttattgtttccacacaggaaaacctgtaatagatggttcatcagctttatttataactttctatcttgaaagcaactggaatgcccttcagtaggtaagcagatacactaggctcacctcaactataggcacaatgaaaggaatgaaatgtcaactcacgaaaggtaagtacacatg

SEQ ID NO: 736 - DNA, 163 bp, Mus musculus
cctcgccatatttcacgtcctaaagtgtgtattactcattttccgtgattttcagttttctcgccatattccaggtccttcagtgttcatttctcatttttcaagttttttagtgatttcgtcgtttttcaagtcgtcaagtggatgtttctcattttccatg

SEQ ID NO: 737 - DNA, 138 bp, Mus musculus
catgcaagaacaggacaaatgtctgtgaagaaaatgagtgagcgtgaacaggaggtcaaggatccggtcccaggcagctctcagtctgggcaagcatttctaaactttgccttccttcctgttgggggtgaaggtctg

SEQ ID NO: 738 - DNA, 105 bp, Mus musculus
aataggagtagatgagaatgaagatttttcaatttaaaggaccagcaaatagcttcagcaaaattatagaagaaaacttcccatacctaaagaaagatgcccatg

SEQ ID NO: 739 - DNA, 38 bp, Mus musculus
catgcagccccattagtgattgatcctgttccatataa

SEQ ID NO: 740 - DNA, 518 bp, Mus musculus
catgggctctctgctgataatgctgaggctgtttgtgctgtagtctgcgctttttgccccctctcagaaaaactgtatgtcataggagttgctggctattgggtacataagcaaagccaccctattgtgccagtgccttagacagtgagacaagaaaggcccctggttagaaatcttatcaggactgggaatgtaactcagttgataagagtgcttgcttagcgtgcacacagccctgggttcaaccgcctagtactacagaaactgagtgtggcttcacacacctgtaatcccagcacttggagagatagatgcaggaggattagaagttcaaggttatctttagtcacatagtattggtagccagccagcctggaatacttgagatacttacaggaaggaaggaaggaaggaaagaaggagggagagaggacaggaggaaggagatagatatacacagaaagagacagagaaacagagattcaggagacacaaagacatacggagacacagtgaga

SEQ ID NO: 741 - DNA, 164 bp, Mus musculus
catgtggttgctggggattgaactcaggacctctggaagagcagtcaatgctcttaaccgctgagccatctctccagctcccttttagacttcttagtagcagcattaattcttgcttggtttcagttctgacaaccacagcagtcaggagtttgagtaagagg

SEQ ID NO: 742 - DNA, 125 bp, Mus musculus
cctcataatgtttgtttgagcatttttttaaaacctaacttgtcttttgcttatctattgtggtttcttagtgtgtgtgtgtgtgtgtgtgtatgcgcgcgtgtgctctggtcttcgtgcacatg

SEQ ID NO: 743 - DNA, 220 bp, Mus musculus
  misc_feature (178)..(178): "n" at position 178 can be any base.
atttgtgacatcttaggagcttaggttggtcttcgagacacagggctgtccctgtaaagcaggttccatcagtgactccagggttttagcagttcagtggcgtagttttcagactgcttaagatttctcaagggctaggcgtggggcagagaccctgcagaccctggctagaacagangccctgggagacagttgagggtgctcaactgtggaggacatg

SEQ ID NO: 744 - DNA, 122 bp, Mus musculus
catgtatgcacaaccaaaacttataaatatgagaattcacttatagtcctagtcctttaatacagaatttagcattccgatataaaacaacagattaaaccccaacagttagaatagagcag

SEQ ID NO: 745 - DNA, 106 bp, Mus musculus
aataggagtagatgagaatgaagattttcaacttaaagggccagcaaatatcttcaacaaaataatagaagaaaacttccccaacctaaagaaagagatgcccatg

SEQ ID NO: 746 - DNA, 79 bp, Mus musculus
catgcacaccctactcctgggtgatcgtaccagctccagcctctgttctgcacgctgtgccttcaacctggcaacctcc

SEQ ID NO: 747 - DNA, 125 bp, Mus musculus
catgaaaacctgtctcagaaaacaaaaacacgttgagagccagcatagaagccataggaggtaatgtgtgtgtgtctgtatatatgacaagagcagacctgtgctgaaccagttaactacttttg

SEQ ID NO: 748 - DNA, 167 bp, Mus musculus
catgctactaaccagttgaggcagtaccagttgttgaagatgctgtcttttatccaatggatggttttagctcctttgtcaaagatcaggtgatcatagggtgtgagtttatttctgggtcttcagttatattccattgatctactggcctgtaattgtaccaatac

SEQ ID NO: 749 - DNA, 109 bp, Mus musculus
ggttaggaattctggacagttggtacttggtttgaatatagtaggtgacaagctgtgccttgagtggggtggcaagcagggttctctgcagcaggatgcagtgtacatg

SEQ ID NO: 750 - DNA, 70 bp, Mus musculus
catgaaaatgttaagtcctgacagacagggtgccatctgccaagaatttgagtaatctagaaacagaaat

SEQ ID NO: 751 - DNA, 20 bp, Mus musculus
catggggttttgtggatctg

SEQ ID NO: 752 - DNA, 249 bp, Mus musculus
cagaacaaataagctggaaaggatgaagcagccacaacataactgctgttggcttctttgtgtacattttaaaccttcctctgaaagagtgaccaatgcttttaactgctgagttatctcacccgacttactttctctctctctctctcttttccttcttcctaaaattaattgtgtgtgtatgtgtgtgtgtgtgtatgattcagaaaccttttatgtggtggtagaagaccatctgcaggattcatg

SEQ ID NO: 753 - DNA, 33 bp, Mus musculus
catggtcccacaagcctagaatgattcgtggat

SEQ ID NO: 754 - DNA, 28 bp, Mus musculus
ggggtccaggagagaaacttgagtcatg

SEQ ID NO: 755 - DNA, 150 bp, Mus musculus
ggaaagagatactcaagaccaactttaccacctttcatttagccaggactgctctattcttcctattactgctaagaaacaagattccttgtttcttgagataagaaacgggcataacatcctatctggtgccatactcaccagaccatg

SEQ ID NO: 756 - DNA, 101 bp, Mus musculus
gtccttcccaaagaatagtgttaactgagctctttgggtggcaataaatgaattgctctggtgggacaggcagtgcacatatggggagggggagacacatg

SEQ ID NO: 757 - DNA, 20 bp, Mus musculus
catgttcttacttcttgttg

SEQ ID NO: 758 - DNA, 48 bp, Mus musculus
gggtatatgaattatatatatatgtgtgtatatatgtatacaggcatg

SEQ ID NO: 759 - DNA, 157 bp, Mus musculus
catgcgccctaagactcatctccacgaatgacgtgacgacctaattgcattccttctaacccactgattaggcaaaccaccctccaaagggctcgctgagttcctcttcgggaagaggtgtgttgagtacgctggaatggatattcgagggctgagg

SEQ ID NO: 760 - DNA, 88 bp, Mus musculus
catctctcgagcccttgcccagccttttttcttaaaattgtatttttaaaatttattttctgtacacaggtgtgtgagtgtgaacatg

SEQ ID NO: 761 - DNA, 299 bp, Mus musculus
catgtggacctgggggctaagtcagggtgaagcttccacagctaagtggctggaggctgccctaaaagctcaggaggcaccgcaagcaagccttgaaaaaccttacccaccagcttgaccttagacttctggccttcaggctgtgacaatacattcctgctgtttaaagaaccatatggttggtgatgttttgtttgtttctggttcttttgtgttggtgttttttgtttgcggggtgtgtgtgtgtgtgtgtgtgtgtgtgtgtgtgtgtgtgttgcagtgctagagataagatctga

SEQ ID NO: 762 - DNA, 196 bp, Mus musculus
gtctaaagttttcaaatgatggataagttgttaaacctcctttaagatctcaagcacaaaaagaaagacatcaaatacgaatagtagaaaggaaaggagatttggaactagaggccccaagagtcataaagagaagaatttaaacaactgtacccacaaattcattagcatagatcaagtagtccatttcttcatg

SEQ ID NO: 763 - DNA, 27 bp, Mus musculus
catgtatgttctcgatgccttggcctg

SEQ ID NO: 764 - DNA, 117 bp, Mus musculus
aaagacattaactcttgagaaccaaggggtaggacagtatagactgaattttgcctcccctcttcataagttgtcactgctaacctcatttcagaacttaagcatataaccttcatg

SEQ ID NO: 765 - DNA, 50 bp, Mus musculus
catggagaactagcaagagcaggatggcgtttctctagaatgccgtatag

SEQ ID NO: 766 - DNA, 41 bp, Mus musculus
  misc_feature (34)..(34): "n" at position 34 can be any base.
catggtgactttccatctttagaaccataatcangtttaat

SEQ ID NO: 767 - DNA, 103 bp, Mus musculus
catgcttatatccctcaaaaattttacagttaaactgaaaatgcttacttacttttttttcttacttatatctagtatcgataagaactgtcccaaaggacac

SEQ ID NO: 768 - DNA, 76 bp, Mus musculus
ctgggtcttagtcctctgaggtccctagcacatcagaggttcatcagttccaagagatgacacagccgcagtcatg

SEQ ID NO: 769 - DNA, 34 bp, Mus musculus
catggagaatgcacagtcaaaacgcttgcatcct

SEQ ID NO: 770 - DNA, 104 bp, Mus musculus
caccccctcccgccttacatcaatcctgggtgcacaatgggactgtggatgactgatgtctgcgcaaacaacttgcggggaagtctagctgacaaacgctcatg

SEQ ID NO: 771 - DNA, 194 bp, Mus musculus
atgtatccaatggcaaagcacgggggaggcttcatcttgaagagaagagtgctcttggtaggctatcctttttttgagacaactagaaataggagcatttcaacaatctggacatatgtcctcccacaagaacttgttgagaatgggtctgaattaactggaaataaaagtgaacacattctcctatacacatg

SEQ ID NO: 772 - DNA, 78 bp, Mus musculus
tcactccattttagttcaaatgctacaactcctttgagcaccactgtcatttcaagaccttattctgtgaataccatg

SEQ ID NO: 773 - DNA, 138 bp, Mus musculus
catgcttagcccagggaatgacactattcgaggtgtggccttattggagcaggtgtggccttgttggaagaagtgtgtcactcactgttggggtgggatttgagagcttcctcctagctgcttgaggatgccggtctt

SEQ ID NO: 774 - DNA, 96 bp, Mus musculus
catgagctgggtgaacgacagcaaaggtttgtttctcttttaaggaagacaatggtgtgaaattggttgatcctttgggggaaatgttggcccctt

SEQ ID NO: 775 - DNA, 183 bp, Mus musculus
catgatctcactgtgagggctggctaccttggagctcactgtactgaaatattctggccgattgcctcttcgctgggtttatgggcacacacagtacttgtctatgagtctttgttaggctgagcctagtggtgcaggcctgtcatctcccctactttactttaggctctgaggcaggaggat

SEQ ID NO: 776 - DNA, 136 bp, Mus musculus
tctggtaacttgggggtctgataaaacagttgggggatttcttttcttttcgcgtctgaagccaatgttattacaggtgtgtgcttgtctctcccacaccctgcccctgttgcctaacacacgcggcacacacatg

SEQ ID NO: 777 - DNA, 119 bp, Mus musculus
catgactcttcctccagagttagaggtggagccaggacaaactctaaagaaaagaaaccccaatcaaaaagggaagctggtatcatccaacctttaaattactccacatccctccagag

SEQ ID NO: 778 - DNA, 221 bp, Mus musculus
catgtctgtcccaaaaggaagttccttcctctgtcctccacatctgaccagcaccatcattcaatctgcaacccaaaccagacatttacatcatctatgcctcctttcctgcttgtctcccctcaaccagcacccagcaagctttcaggtatccccttagtgttgtcaggatctctccagttctccagaccccaattctgttctcactctacactgctagc

SEQ ID NO: 779 - DNA, 76 bp, Mus musculus
aaagctaacttctcatcacctacctaatagcctgagagccctgtgtagaaaaattaaggagtttagttccttcatg

SEQ ID NO: 780 - DNA, 57 bp, Mus musculus
catgcagacaaagtaaataagaaaacaaattaaatgtaggctggacggatagatggt

SEQ ID NO: 781 - DNA, 177 bp, Mus musculus
ctcagctcctaggcaacacttgtagacccacagccccttcacacacacacacacacacacacacacacacacacacacggctggggatccaacccatctcgtccttacacgtgctctaccatcacaccacacatttccagcacttttatctgaagtgtttccttttatttgtgcatg

SEQ ID NO: 782 - DNA, 162 bp, Mus musculus
cataaccactataaccagcctgcttacttggctttgtttcgagggcttttgttttagagctctttctttttacccttctccgtgtgtgtgtgtgtgtgtgtgtgtgtgtgtgtgtgtgtgtctgtctgtctgtctgtctgtctgtcttagtgtttgtacatg

SEQ ID NO: 783 - DNA, 121 bp, Mus musculus
catgtggtccacggttttactttactagggagcaacctgtaccacagggagagaggcctaaggacaggaaaggagctgacccagaactgaaaaggcacacaccattctgccagcacttccc

SEQ ID NO: 784 - DNA, 228 bp, Mus musculus
catgtcctacagtggacatttctaaatttcccttctttttcagttttcctcgccatatttcacgtcctaaagtgtgtatctctcattttccgttattttcaggtatctcgccatattccagttcctacagtgtgcatttctcattcttcacgtttttcagtgatttcgtcatttatcaagtcgtcaagtgaatttttttcattttctctgattttcagttttctcgcc

SEQ ID NO: 785 - DNA, 157 bp, Mus musculus
catgttgcctcaagacagatctccactttaaagacatacctaaaggcctggaagcttagtcaattaagctttcctgcccagacactcctccctgaaaaaggtatttaacctcaggcccaccctgagaagtggggtatgattttactcatccactttc

SEQ ID NO: 786 - DNA, 114 bp, Mus musculus
catggtttctattactgtgttgaagcaccctgaccaaagccaattgggggacgaaagggtttatttggcttaaacttccaaatcagtgtttatcattaaaggaagtcagggtag

SEQ ID NO: 787 - DNA, 67 bp, Mus musculus
gcaagtgtcagacggctctcagggagatacacatagctttattggataactgcagcttgaagacatg

SEQ ID NO: 788 - DNA, 108 bp, Mus musculus
catgtacctatgtgtgtgtaacatttgcctattttcacacagttaagaaagcatcgttatgaaaatcattacaactttccagataaacagatccactcagccacagat

SEQ ID NO: 789 - DNA, 97 bp, Mus musculus
gcccttctctctgaacttttcagttcctggataaagtcagtgttccacctctatacctgactagttttcctaaattctgagtcaagcatatttcatg

SEQ ID NO: 790 - DNA, 132 bp, Mus musculus
gacctcgtgggcgggcctgaggagacagtgcagatgaggtgtcagtaaggaggatgcaagcaagaaagatgcaggagatgatggagaagctgaagaaggcactgaagaaggcacagggaagaagagtgcatg

SEQ ID NO: 791 - DNA, 96 bp, Mus musculus
cttgccgttgagagcgtccagatcccctgacttgagtgggtccaccttgtttggtttggttcgcagtgtcggctgtggagccccaggccttgcatg

SEQ ID NO: 792 - DNA, 58 bp, Mus musculus
ttcttatccactgagccacactgctaatactgtgatgtcttttttaagactcaccatg

SEQ ID NO: 793 - DNA, 42 bp, Mus musculus
gggttcaacacatttttggagattgatcaaaattaaaacatg

SEQ ID NO: 794 - DNA, 138 bp, Mus musculus
catgaaggagagtctgaggctacatccaccaggctctatgatctccctctgctgcatccaggacattctccttctggatgaagatgatgctggcgctggcgctggcgctgacgctgatgctgctcgcttctgcgtcct

SEQ ID NO: 795 - DNA, 223 bp, Mus musculus
ccttgtcctcaaattacaaaactccctagggtcttttctctgggctacaaaattctgcaaatggactcaggaggaatcaatgtggaaatttcactttgccttcccaatcagcaaaataatgtttgccaaaatcgttagatttctttcccctaagtaggctactgccgacttgaaagcagtggttccagaacccgagcccaggggctgccacttcctatgcatg

SEQ ID NO: 796 - DNA, 220 bp, Mus musculus
  misc_feature (47)..(57): "n" at positions 47 and 57 can be any base.
cccttgtcctcaaattacaaacttccttagggttttttttttggctncaaaattttncaaagggcttcaggaggaataatggtgggaaatttacttttgctttccaatcaacaaaaaaatggttggccaaatcggtagaattctttccctaaataagctactgccgacttgaaagcagtgggttcagaacccgacccaagggctgccctttctatgcatg

SEQ ID NO: 797 - DNA, 46 bp, Mus musculus
catgtatcttaagaacagagccagtgctctccctctcccacttgat

SEQ ID NO: 798 - DNA, 46 bp, Mus musculus
  misc_feature (9)..(9): "n" at position 9 can be any base.
catgcagantaaagtacatatatgtaaaaaataaaaataaatcttt

SEQ ID NO: 799 - DNA, 547 bp, Mus musculus
  misc_feature (310)..(544): "n" at positions 310, 433, 437,449, 455, 468, 472, 477, 488, 517 and 544 can be any base.
gtgctctcccttgcctctcctctcctgagtttctctgtaggtgtaagggctggaggtgggcccaagaaccagagatcagaggagggaacttccggagcagaggccctgggagcagtgttaagcaggctttggccaggtctggaggtgtccaggcagggaggtggagctggaagagaccaattagtcaaacggctgcaattggccatttggaagcaattaacagggtctccattaccatattatgcccctccaccccctccacactctactaggctctgctctgtatggaagggggaaggtggaggctcanctcaagccagggagactacaatggaggcccagtgctcgccaggatgcacacactcaggcaccctccgtgtgaggaggggagggcagggcagcatctgaagcaacctgtcattcacagcctganaganggtgggaacaanggcttncaaagccaagaangcangtggntagaaatgcangaaaacctctctggtaagaaaggctgaangaagcagctagggttgtaaaacaagancat

SEQ ID NO: 800 - DNA, 232 bp, Mus musculus
ctccctctccctctagctggcctagcaggggccaatacaactgcagggaatcaaggaagagccttttcctgaactgtcctggatgccccagtccaacagcaactcccacttgccctggcttggtttgctccactgtcctgaaggcacagtgtgatatcccagacctccagcgagacagcccaacctgcaagccctgatgggaggggtggcctgagacaacagtacctacatg

SEQ ID NO: 801 - DNA, 169 bp, Mus musculus
catggactccagggtcagggtgtaagaaaaaggtggagcctgctaggtgtggtgacacacacctttaaccccagaactcagaaagctgaggcaggtgactagccaggagttcaaggtcatctagttcatcagatctatagagtgaaacagccaggctacatttgagatc

SEQ ID NO: 802 - DNA, 108 bp, Mus musculus
gctcaacacttaaaagcgcctgcagaggggtgggggtttaattcccagcacacacatagtggctcagggaatctgaagccctcttctggccactgcgtgaactgcatg

SEQ ID NO: 803 - DNA, 225 bp, Mus musculus
gtgggaagctatacgaaagtaaaacacactctaagaaagagaacaggctgcctgggagagggaggtgccaggggcttagacaggaaggtagttttcaaaaactgaaaacttaagctatctgaatgaatgatacaaaataaaagaagacacaagaatttccagtcacctgagatatctcacactcctgttctttcaaccttctagctgaaaggagaaagagccatg

SEQ ID NO: 804 - DNA, 196 bp, Mus musculus
catggaaggagttacagagacaatgtttggagctgagacgaaaggatggaccatctagagactgccatatccagggatccatcttataatcagcctccaaaccctgacaccattgcatacaccagcaagattttgctgaaaggaccctgatatagctgtctcttgtgaggctatgctggggcctagcaaacacagt

SEQ ID NO: 805 - DNA, 164 bp, Mus musculus
catgcttagattgaccgcaatatgtgtggtactcttcagacttttaaagatttgctgaatatcctattccccttaaattgtgatcaccctagctagatctaatcttagatctcgaaagttctacaatttgcctcaatttgattactgttttcctccttgaagac

SEQ ID NO: 806 - DNA, 232 bp, Mus musculus
cttgccttgggaagtgaggggttctaatgaaggttgcaagcctgtccacccagggccctgctaaagaaggaatggtccccagcctgttttgtcccctctgtggcttcttagttctggacactgagccagtctgggcagcaggcaattcacactgtgaatttctgtggaaagcattttgggggttctgaaagccctgtacattctgtgttaaggacagagggcctcctgcatg

SEQ ID NO: 807 - DNA, 254 bp, Mus musculus
catgggggctatgtcctagggtagacaccccctttatccctcacctccttccctgtcttagcagtggtgtcccccactgtgactctactgcatctgggagctgtctcccgggggacttcctcctgctggagtgagtaggtggctagggcgaagcctgtgtaagaggcaggaggtgttttgcacaactccaaagggtgcagatcctgctggctccagcttcccagggccagacccccaaatacccttcacccagc

SEQ ID NO: 808 - DNA, 142 bp, Mus musculus
gtgtatgttctctggtgaaagtgttaaccagctcactccgtgaagagcacgctgctttcagatcagtgttcagagtcttgaataattggtttttagaatcataaaattgcagtcctttacaaaggactggaagtgactcatg

SEQ ID NO: 809 - DNA, 151 bp, Mus musculus
catgtgaattctctatttgcaatgtgcttggttcatacttccatactctacccagagcctgttagaaaaatcactcttccccaccctattcttcaccagtcaatatgtatctagtattctaaacttcctccctcctaaggcagtggggaag

SEQ ID NO: 810 - DNA, 120 bp, Mus musculus
catgtgtactctcaccatcagaattatgagcaacccacaatttcttcacatttataactgacccagtctgaggtattgtgcctttagcaacagaaactgaactcaaaacaatcggcacac

SEQ ID NO: 811 - DNA, 120 bp, Mus musculus
ccatatcagaccaaccttcccacacaacagtaggccaccaggtgggggcaaagtcctgggtaaggttcttggcactgtaattttgaatcccaataataatgactgtgttatttgctcatg

SEQ ID NO: 812 - DNA, 69 bp, Mus musculus
taaaacctttagggagctgataaaaatctatcaaaacaacactctgtctctcgtatccagccatccatg

SEQ ID NO: 813 - DNA, 53 bp, Mus musculus
tctgcccagcctttgcttcctccctggtaacaggatgctaattagaattcatg

SEQ ID NO: 814 - DNA, 94 bp, Mus musculus
catgtaaaaaaaaacttcattaacaactacaacaaagcagagaccttggcccttggattggggcccctctgagagctataggctgggatactgg

SEQ ID NO: 815 - DNA, 77 bp, Mus musculus
gtgcgtgataaccaggctggcagtgccctctgcatcccacattgggaacagcagcctgatactccaaggctgccatg

SEQ ID NO: 816 - DNA, 145 bp, Mus musculus
atgtcaacattgagtccagtaaggacatcgtatatgctggtcattattatagctctaagggttcatacatgagacagaccacccccttaccccctcccccgtctgggctaaaagcagacacactgggttggtgagagagcagcag

SEQ ID NO: 817 - DNA, 78 bp, Mus musculus
catgagacagaccacccccttaccccctcccccgtctgggctaaaagcagacacactgggttggtgagagagcagcag

SEQ ID NO: 818 - DNA, 88 bp, Mus musculus
catgagaaaaatttgtctctaattctctttgttgaatttttgtgtggttttgatatcaggtgattgtggcctcatacaatgaatgtgg

SEQ ID NO: 819 - DNA, 45 bp, Mus musculus
ccagtgaagtaaacccagcaggaccctttacaaagccaggacatg

SEQ ID NO: 820 - DNA, 250 bp, Mus musculus
tcgggggaaagttatttttataccttcccgctctggattaagggagggtaggaaaggattggatgaagctagagacagagtggcaggaaggtggtagacctgaaattgtcagacaaccacttatcgttgggaagggtataaggtgaccacagcactagcagactgttctggacgtagtaaggagttcctgcaggggaggagtgggtcagcctttgaatcccatatggtggttcacaagtcagcctacatg

SEQ ID NO: 821 - DNA, 141 bp, Mus musculus
  misc_feature (63)..(63): "n" at position 63 can be any base.
catgtgtttttagcaactgtgctcattttctgctgctgctaggaataaaatcaaatctagtanaattgctttaatacaaagttattgtcatccatctctgaagatctgaagtattgctggggggtctccaactcacccacc

SEQ ID NO: 822 - DNA, 235 bp, Mus musculus
caagggcctctcctcccactgatggtcgaccaggccatcctctgctacatatgcagctagagacacagctctggggggggggtactggttagttcatattgttgtccctcctatagggttgcagaccactttaggtccctgggtactttctctagctccttcattaggggccctgtgttccatccaatagatgactgtgagcttcttataagcataaactttcacttaccacatg

SEQ ID NO: 823 - DNA, 143 bp, Mus musculus
catggtgttagcctccaggcaggaagcataccagaggagaactccacagggaagcctttgttttctgctgttaaaaacaaagtatgatggggcttagaagaggctttaagaggtcctctggagaaaagaatctattttccatt

SEQ ID NO: 824 - DNA, 105 bp, Mus musculus
catgagaggtttttaagtcctgaaagaccatcatacctagagtctatacaacaaataaacttggaatacagtgaagctagtaaaaataacttcctgagcttatgg

SEQ ID NO: 825 - DNA, 80 bp, Mus musculus
cacagtcaggaagcagaaagatgaacgttgactctcagctctccttctccctttagttctatggaggtctccagcccatg

SEQ ID NO: 826 - DNA, 193 bp, Mus musculus
catgataaaagtcttggaaagatcaagaattcaaggcccataaataaacatagtacaagcaatatacagcaaacacagtagccaacatcaaactaaatagagagaaacttgaaacaatcccactaaaatcagggactagacaaagttgcccactctctctttaactgttcaatagagtactcaaaatcctagc

SEQ ID NO: 827 - DNA, 29 bp, Mus musculus
catggtagctttctagtgaggtctcttcc

SEQ ID NO: 828 - DNA, 76 bp, Mus musculus
agtacccttagccaataaaccatccctctagtccctgtttgttttgttttttttttaaagacagggtctcaccatg

SEQ ID NO: 829 - DNA, 75 bp, Mus musculus
catgagctaggccatctgcaagctggtctcgtcttgaccaggagtacacagaagcctggctcaggacttggtaac

SEQ ID NO: 830 - DNA, 238 bp, Mus musculus
gttgtttatgcagatctctcagcgttagcattctatgggattctttggaaagaccttttcagttatcttccatttctgaggctgtttctaggcaacggagtggtaccttcctttaatcttcccctgaccttttctgcctatgaagatgttgactagtgagcccgtggggatgtgtattatctgttacatttatttatggcttggtagcgactccttggttgttgttcagcttttcatg

SEQ ID NO: 831 - DNA, 133 bp, Mus musculus
catgcctccctcagcctcctcccaccccttcctgtcctgcctcctcatcactgtgtaaataatttgcaccgaaatgtggccgcagagccacgcgttcggttatgtaaataaaactatttattgtgctgggttc

SEQ ID NO: 832 - DNA, 54 bp, Mus musculus
tctaagtccagtctttcacacacactgactttggtcatctgtaatcacaacatg

SEQ ID NO: 833 - DNA, 128 bp, Mus musculus
catgcacacaaactggccctgaacttttgacttccaggcctctgcctctctgcgcgcacacacacactcgcactcctgtatatgaagcgtatatgtgtttctctgggaactgtttttatcaggtgaag

SEQ ID NO: 834 - DNA, 38 bp, Mus musculus
gggctgaaggaaaatgttgtgtcatcttttgtggcatg

SEQ ID NO: 835 - DNA, 136 bp, Mus musculus
catgtaccacttttgctaatcccctaaccgccccttggtaagcatctaaagtgatatatctcttggtctactgaagttctgccctgtctccatcggggattctcgggaggctaaaattatagactatttgtgaaag

SEQ ID NO: 836 - DNA, 23 bp, Mus musculus
catgtccttatgatatggaaaaa

SEQ ID NO: 837 - DNA, 79 bp, Mus musculus
catgtgccaagagccattacaggctcagactaacatctgcctgtaaacaacggttgctaagtttccagggaagcgtaag

SEQ ID NO: 838 - DNA, 78 bp, Mus musculus
ccagatgaccttgaactcagagatctccttgccttagcctcctgggattcatagccgctatgcctcaagatctccatg

SEQ ID NO: 839 - DNA, 52 bp, Mus musculus
catgtagtttgcaaacaagacatccctggtatatccagaacctgagctatgc

SEQ ID NO: 840 - DNA, 65 bp, Mus musculus
ggatatagtgtcaaacagtctgatgtattcataggtttgtatccatagttatcaaatctctcatg

SEQ ID NO: 841 - DNA, 90 bp, Mus musculus
catgtaccacacacagacttggtaataagttagatgataattacaaaagcaacaaataaaaccaacaaaacaaaacaaagcttggtaata

SEQ ID NO: 842 - DNA, 58 bp, Mus musculus
gttaggagcacgaactgctctttcagaggacctgggtttaattcccaacactcacatg

SEQ ID NO: 843 - DNA, 119 bp, Mus musculus
catggtcaatgataaacattccaaaacaccaaaaccatcctctctgtacaggctatgatgattcaactgctgcccttcctcatttcttgttcccaactcctactgaatatttcctgcat

SEQ ID NO: 844 - DNA, 93 bp, Mus musculus
catgatagaagaccacgtctgggatggggtaagggtttctcagagtaccttgccctggggccacatcctaaatctacaacaaagctgacccta

SEQ ID NO: 845 - DNA, 136 bp, Mus musculus
caagtttttgtaagggagctaagaaaggcattgttggttaggttggaaagagggggcaggacctggctctcgcttcagcccactcccctctgccccccagcctcaaacacttttaccctagcatagcagaaacatg

SEQ ID NO: 846 - DNA, 116 bp, Mus musculus
catgaactcagtgggcagatgaagagtttttgtgtgaactggggctttgcccttatcatcctgtgtgttctcctggtgaccctcaagcttggctgcaatgatccccacttacagat

SEQ ID NO: 847 - DNA, 112 bp, Mus musculus
gtttattactccaatgattcgcacagccgggttgcaagtctaaggcaggctgtctgccttcctggaggtacttaccccacctccccctctgggggagctccacttggccatg

SEQ ID NO: 848 - DNA, 152 bp, Mus musculus
catgattttcagttttcttgccatattccacgttctacagtagacatttctaaattttccaactttttcagttttcctcgccatatttcacgtcctaaagtgtgaatttctcattttccgtgattttcagttttctcgccatattccaggtc

SEQ ID NO: 849 - DNA, 83 bp, Mus musculus
gtaaccactcatttacctgccccaatgatgtctgggccaaggcacttttaaattcatatctactgtgactataggtgcccatg

SEQ ID NO: 850 - DNA, 39 bp, Mus musculus
catgacactgctcactgttgctctctaaccttggtccag

SEQ ID NO: 851 - DNA, 54 bp, Mus musculus
  misc_feature (2)..(2): "n" at position 2 can be any base.
gngcttggcagagtagagaaactctttgggaaacttggttcagatccagacatg

SEQ ID NO: 852 - DNA, 42 bp, Mus musculus
cacctctgcctcagtttccctgattatcaacaagtgctcatg

SEQ ID NO: 853 - DNA, 187 bp, Mus musculus
catgtaactcaagaaagtctagtaggcgtagtggtaaatgcctttgatcccagcacttgggaggtagaggcaggtgggatctctacaaattcaagactggtctggtctatatagtgagttccaggccaaccttcacattgaaattcatctcaaaacaataaaaatagaggaagatatagtcaggcac

SEQ ID NO: 854 - DNA, 61 bp, Mus musculus
gaagacattcatttttttcttgggaggggatagaatccaaggctccaaagcagagttcatg

SEQ ID NO: 855 - DNA, 275 bp, Mus musculus
gaccacgctggcctcgaactcagaaatctgcctgcctctgcctcccaagtgctgggattaaaggctgtgccaccactgtgcttactgatctctttgatgtcccagttatagctcttgggttccccacccatttgtagggggacccaggacacctcagagctctcccaagtctaaaaagggcagggttcctggctcccttaatgccttatcaagcacaacagaactcaggggcagaaaatgttcccaggaagaacttagctgtggggagagtcatg

SEQ ID NO: 856 - DNA, 132 bp, Mus musculus
catttttctttatagctgagtgttattccactgcaaaaatttgaatattccactattctgttgatgaatgtctaggctggtcacgttctcttgcctttgtgaatggagcagcaataaacataagtgggcatg

SEQ ID NO: 857 - DNA, 106 bp, Mus musculus
ctccattgggccgagtgaagctgtggttcagagaaactctatggacaagcttgacttccagaacattgacctggtctctgagatcaacaagcgtaggaaagccatg

SEQ ID NO: 858 - DNA, 49 bp, Mus musculus
catgggaaagtaatccgtggctaacacaaaggggaaataaagtaatatt

SEQ ID NO: 859 - DNA, 175 bp, Mus musculus
catgtaggaccctgaatgccagcaatgaacaataccagcttggttttccgactcttgctttctcctccctccactactaactagcctcaccgttgcatcttgtgactcagaggtcttgtttccagggcttccttccttccagtgttcttctaatgcatctaaagtgaaggggtgg

SEQ ID NO: 860 - DNA, 220 bp, Mus musculus
catgcaaagcctctgcagggccgacagcaaggaaggcccttctagatctccagcactctgtcaaaagccatcactcggcaggcaggcaaccacaatgtagggaagacctgtaaagccttcagagaggaacagctggcagcccctgggtcactcagagtggccaacagctactcttgtggagacagcaggaggaggcctagactatagaaggatggaggac

SEQ ID NO: 861 - DNA, 107 bp, Mus musculus
catgcacacaaactggccctgaacttttgacttccaggcctctgcctctctgcgctcacacacacactcgcactcctgtatatgaagcgtatatgtgtttctctggg

SEQ ID NO: 862 - DNA, 51 bp, Mus musculus
  misc_feature (16)..(16): "n" at position 16 can be any base.
catgaaacattatttnttttggaagtctgcaggtaaacttaaataggttaa

SEQ ID NO: 863 - DNA, 147 bp, Mus musculus
agcaagaacaaaggaagtacttcacctgataaaaacagttcccagagaaacacatatacgcttcatatacaggagtgcgagtgtgtgtgtgagcgcagagaggcagaggcctggaagtcaaaagttcagggccagtttgtgtgcatg

SEQ ID NO: 864 - DNA, 49 bp, Mus musculus
gatttttattttccttagcatcctgattggagatgcctgggtgcacatg

SEQ ID NO: 865 - DNA, 104 bp, Mus musculus
catgtagagactgccatatccagggatccaccccataatcagcatccaaacactgacaccattgcatacactagcaagattttattgaaaggacgcagatgtag

SEQ ID NO: 866 - DNA, 260 bp, Mus musculus
gacctgtaccctaccctctgatggaggccatctatttgcctgtccccaggagtccccaaactgctcaaagaacagactgtgggctctggaaagctagcaggtgaccccgggggatgttctgagcagtgccttactgaagtttatccaggccctagggtcccctcaactgctcacacagcctagggtgggtctcttgaggagtcacttgtcacttctgttgcttcccaagagacccagggaaaaaaggaaggaaggccatg

SEQ ID NO: 867 - DNA, 214 bp, Mus musculus
atctcactcgtaaaatgaacaaagggactgcagagatggctctgagcttttaagaccatagcctgcttttccagagagcccaggcttcatttcccagcccacatatggcagttcacaaccatctacaactctagttcctggggatctcacacttttgtcttctgtgggcactgcgcaaatgtgcacagaaatacacgcaaggaaaacacccatg

SEQ ID NO: 868 - DNA, 36 bp, Mus musculus
aagaaacactcttagctgggcctggaagtgcacatg

SEQ ID NO: 869 - DNA, 213 bp, Mus musculus
ctaaagcagattattatacttattctactgaccataatgcaaccactattatataaacagaacatactataaagtgaataacattaggatacaaaatgtataaaaggggagagaggataaccattgtgaagtatgtttaaataaaatgtttgggatttgaggaaattaataaattagttaccctttttgctttggggaaagaaaggcagcatg

SEQ ID NO: 870 - DNA, 154 bp, Mus musculus
cagccccaaacccatcagcctgagactgatgcacaggaggcaggccagttagttattctctgggcccctctattttgccttctgtaggttaatcccaccgctcccagtgctggaaagtgcaagcattgtgggaagttaaaaacgtgccaccatg

SEQ ID NO: 871 - DNA, 89 bp, Mus musculus
catggacaatgcacccctcaagcagtgtcttccatacagacaagcatatttattttctatacagacagcaactttgctgaggtgtaagg

SEQ ID NO: 872 - DNA, 199 bp, Mus musculus
ggatgaagaagcccaaggtattaggtcagtcttgctctgacttctcacagtaaaaatacaactcccagggactaaaatgacacagaacagcttagcctctggacattgcttttggattgcaaagtgataagtgaaaaagtaataagtctatctacattggaaaacatttggtaacttcatttaaacacacttccccatg

SEQ ID NO: 873 - DNA, 140 bp, Mus musculus
catgtcctacattggacatttctaaattttccatctttttcagttttcctcaccatatttcacgtcctaaagtgtgtatttctcacgtgtattcgttggttgttggtttagttcctgggagctctggaaatctgattatt

SEQ ID NO: 874 - DNA, 236 bp, Mus musculus
tggaaaatgagaaacatccacttgacgacttgaaaaatgacgaaatcactaaaaaacgtgaaaaatgagaaatgcacactgagggacctggaatatggcgagaaaactgaaaatcacggaaaatgagaaatacacactttaggacgtgtaatatgtcgaggaaaactgaaaagggtggagaatttagaaatgtccactgtaggacgtggaatatggcaagaaaactgaaaatcatg

SEQ ID NO: 875 - DNA, 145 bp, Mus musculus
tgacatacagaaagaacacaaatacctgtagctgctgtgacaggaccaaccattctaaatatcaaagcagctgttgacacctaaggactggtctgactgctagatctaggagtttcaacttgcaaaagctggcttgatgctcatg

SEQ ID NO: 876 - DNA, 45 bp, Mus musculus
ttatatatatatatcgttttctcttactcctgaatcagtgacatg

SEQ ID NO: 877 - DNA, 333 bp, Mus musculus
catgtcagccctcagctttacacaggtgtcaaaaaaaaaaaaaaacactgactgagatcttccgtctgccattagctgttattgtgtacattaagtagaatccactgcttaacccaggctactgggctcaccccagtattcaaggaggtgccacaggactcaaaggatacagaagttacatattaaaacccaatctcgtagaggattcagaggaactaagtttggtaggggcacagattgtagtaccattaagcccctctgttcctcgtggagaaccactactgtccagcaaggcgggaaggacccaaatcaagcaaatgagacttgttctgg

SEQ ID NO: 878 - DNA, 291 bp, Mus musculus
  misc_feature (8)..(244): "n" at positions 8, 78, 94, 118, 153, 234 and 244 can be any base .
catgatanatccctttttgtgagcattccatagcctcagtaatagtgtctgaccttgggaccacgctgtatcccactntgggaccttcttttcntcaggctactctccatttccattnctgtaattctttcaacagaaacatttatgggtcanaggtgtgactgtgggaggacaaccccatccctcacttgatgtcctgtcttcctgctggaggtgggctttataagttccctncccctactgnccagcatttcatcaaagatccctccctaggaatcctgggaacctctc

SEQ ID NO: 879 - DNA, 107 bp, Mus musculus
gataagcttatcttgaacttgaatgtatatggagaagcagaaaccttgaaacagcccacagaaactgaagaaggatgaaggtggaactctcagctggaatattcatg

SEQ ID NO: 880 - DNA, 230 bp, Mus musculus
catgttcccagctgggcaaggcctcgggttcctcggtgaagagtgtggaccagccgatgagccctccgacgtgtggatgaaacggctggcttttgtttagttttgttttaacctccccaacgagactttgatcagctccacctcgaaaatgttcgcgaaagatgcggagagcctgagggactgcggggcagcaacgggctccggcctagcccggcccgccggcccccaga

SEQ ID NO: 881 - DNA, 63 bp, Mus musculus
accaagtgttaataatgtactgatggcttctgcctgtggcagtacacttgtcctctacacatg

SEQ ID NO: 882 - DNA, 206 bp, Mus musculus
ccttactgcagagatgactcggccaacggcttcgagcccctgaccacttcctcaggtttggttttgttagttttttctcacagcaatgggaagcataatcaatacaacttcccagaatgcgacctgtgacaaggccaatgagcagactcaaggctgggcacataaaagcaccaaaaaaaaaaactcccttgcagttattgttcatg

SEQ ID NO: 883 - DNA, 265 bp, Mus musculus
  misc_feature (156)..(252): "n" at positions 156, 191, 234, 251 and 252 can be any base.
gactgagcctgcctggggccgtagggaagggggggttggaccctctggtatttgcagttaccactgacagggtttttccgagatgccagtgtcagggtgttcggtgctgaccccccagggaccgtgcagccccgatggctgtctcggtcctctcancttttccgccacccctgggatatttcaggactcantccccgcaacagctctgactgaggtcagctctgtgaccagggnccctgtccccggtgtgnngtgtatttgcatg

SEQ ID NO: 884 - DNA, 49 bp, Mus musculus
catgtagaaggcagaggacaaccttcagggattatttctgccctttcac

SEQ ID NO: 885 - DNA, 72 bp, Mus musculus
gttcctccattctgctgcttctccctgatacattgagttacagcagcccacgcgtacacactctcgcacatg

SEQ ID NO: 886 - DNA, 80 bp, Mus musculus
catgccaccaacaaataagtaagtaaaaaagaaggaaggaaggaaggaaggaaagaaagaaaacattttaaatctgtaat

SEQ ID NO: 887 - DNA, 276 bp, Mus musculus
cggagcttaggtctatcatttaaagatacaaccaaataggcagaatcatttcctgaggagcccattttctttatctcaggtcctgcagatttctccctggtattatcagggaggagcagcagctgagctatcctatctcctttactaatagaaaaaacgcctttagggcttgagcacaggacctgtatttcaggggaatgttgacaatccataactccagggtggactactaagccctgcaaggtgagtgaaccccggccgagaataaggcccatg

SEQ ID NO: 888 - DNA, 228 bp, Mus musculus
catggcctgagagttggaaagagtattgtaagcaggggttgttccagaaagtttagaatatacagacactatactctatccagacttcttggcacagggagttcaaatgtagactctgagccccgtcctggggcagcttcttccacctgctttgggtagaagcaggcagactctgggtagactctgattccaaggctaagtaacccctgaacccagaacagtgttttc

SEQ ID NO: 889 - DNA, 56 bp, Mus musculus
ccagatatcatactgagttcgtaggtggttttaattaatcacgggcccctggcatg

SEQ ID NO: 890 - DNA, 135 bp, Mus musculus
ttggtgatccaaacccaaagagacaaatgctgaatgttcactctcattttctgttcttagctccaaatcttcagatatgagtaagcaacacataaattatgaagggaccatactgggatgtagggggcttgcatg

SEQ ID NO: 891 - DNA, 82 bp, Mus musculus
catgagcactgctctagggacacctcccatcccttcctagcaccccaaatgccccttcccatctctccttccagaagttgga

SEQ ID NO: 892 - DNA, 221 bp, Mus musculus
atatagctgtctcctgagggcctatgccagtgcctggcaaatacagaagtggatgctcacaatcatccattggacagagcacagagtccccaatgaaggagctagagaaagtacccaaggagctgaaggggtctgaagccccataggaggaacatcaatatgaactaaccagtgcccccagagttccttagaactaaaccaccaatcaaagaaaacacatg

SEQ ID NO: 893 - DNA, 201 bp, Mus musculus
catgataaggttagagttttgtgagcctccttaaccttgctcagcaagcgttgggctcttggcagccgagctgccatctttctcatccccgatagagccagccgcccttgtcgtgtcttgaataagttagaggaggcattatagagcggacctaaacatttgccttggagcctgagggatggggattggctgaatgtgaat

SEQ ID NO: 894 - DNA, 94 bp, Mus musculus
cagaactgtgctctttaggaagccagacgctatgccttaggccctgttccctccagaccttgctctgtgctacagtgtaaaagcgaagatcatg

SEQ ID NO: 895 - DNA, 53 bp, Mus musculus
gagaattagaaaagagataacaaaggcgagaaagagaggcgtgtgagagcatg

SEQ ID NO: 896 - DNA, 46 bp, Mus musculus
gtttccagattgtcctagtagctgggctgcaggaacagccagcatg

SEQ ID NO: 897 - DNA, 259 bp, Mus musculus
gggggtgggggtggtaagagaagattaattagcctagcatatataaggttttggattcaatcttcaactccaccccttaaagaataaataaacaagtagatagattatagacagacagctagatggatagacagatagctacatagatacatagatagatgatagataatagacagacagacagataaatgatagatagatgataggaagtcccagttaacaaatggaaataaaaagacaaaagtcccctttgtccatg

SEQ ID NO: 898 - DNA, 35 bp, Mus musculus
gtatatggaatatggcaagaaaactgaaaatcatg

SEQ ID NO: 899 - DNA, 162 bp, Mus musculus
  misc_feature (82)..(82): "n" at position 82 can be any base.
catggtaaaggtcaggagtacacctgtgcttctgtgttcttctgtgttggctgacagctgggcagaagtgagttcaggaggncaacccatacgatgagacaagccggggcaaagtgggatatgtggaccgcagcacatcagaagggtgtgcccgacataaac

SEQ ID NO: 900 - DNA, 164 bp, Mus musculus
catgaagtatattattagaggggaactagtcttactgctgagcagcgtgttgtcttctacagaggatgtttgtgttctggaatttaaaattacttaaagtaatagtgtcaatgaaacgttgtccggtgacttgcttcttttaaatgatcactgttagacaggga

SEQ ID NO: 901 - DNA, 57 bp, Mus musculus; identical to SEQ ID NO: 734

SEQ ID NO: 902 - DNA, 77 bp, Mus musculus
catgatttgatagggttatttggttctctggaatctaacttcttgagttctttgtgtatattggatattagccctct

SEQ ID NO: 903 - DNA, 147 bp, Mus musculus
gcaaatagtcctttgtaccgaacttccacacactaatgtagtgaattatttaaaatttattccttaatctttttttaaagtccagactctatccccctccttgtccaccctctgattgttccacatcccatacctccttgcctcatg

SEQ ID NO: 904 - DNA, 361 bp, Mus musculus
ttccatctcttgtattctgttgctgatgctcacatctatgtttccagatttctttcctagtgtttctatctccactgttgcctcactttgggttttctttattgtgtccactttcctttttaggtcttggatggttttattgaattccatcacctgtttggttgtgttttcctgcaattctttaagggatttttgtgtttcctctttaatgtcttctacctgtttggttatgttttcctgtaattctttaagggatttttgtgtttcctctttaatgtcttctacttgtttagcagtgttctcctgcatttctttaagtgagttatttaagtccttcttgatgtcctctaccatcatcatg

SEQ ID NO: 905 - DNA, 224 bp, Mus musculus
catgagttttctacttttttataaaattatataaagtcatttagtagaacctagctttatttaattttaccaattaatataaggccactgatattattgacttttgtcactacaaaatacagcaatgaaataatctttcttctaggctccttcctcatcaaactagttcttcagctcacattaatacttttttcaagttgtaagggacctcagggacagggggc

SEQ ID NO: 906 - DNA, 129 bp, Mus musculus
catgagcttatagtttcagtaagagagcatagatagaatataggtgcctgtgcgctggctcttttggttgtatttaaatcctttatctctgagaagtcggaactgttggcaacagacaatatggtagcc

SEQ ID NO: 907 - DNA, 145 bp, Mus musculus
ctgacacaggtatgcccagtccatagtgtgcagagcacagatggccaaggataactaggaatgagacctacttaacccaaactccaaacattatgaaactttaaaaaaatgacttcagttgaactttgcaggtaaccacatcatg

SEQ ID NO: 908 - DNA, 139 bp, Mus musculus
attgtgtccttttaacattcttgctttagtagaacatcctctgacccgtatctgattcagtgaaaaattccttcacgagtctgccttagcaaaacatcctttcacctgtgtctgcttcaggaaaacaccccttcacatg

SEQ ID NO: 909 - DNA, 171 bp, Mus musculus
catgttggtaacagatacaacaagcagacttaaactaataagaaaacagctatgattaatatgtttataacttagctgaagagaatgtatggagctttgaagttaatcttttcatatacacaggaatgccttcaaaaagcattgcagcagatttcaaaggattaaactcat

SEQ ID NO: 910 - DNA, 266 bp, Mus musculus
catgtggcgaaccagcatcacttttgctctttccttactaacccaggacatccatcattattttaatagcatccaccctagtagatataaggtgataccttattgtgatttcatttgcctttctctgaagatcactaacaatcaaaatctggttcattttatttatgaattctcatttgtcttttgctaaatatatgttcacaattcttttcaatttaaaagcaaattgttttgttaataatgagctaacttttcatacattgaag

SEQ ID NO: 911 - DNA, 110 bp, Mus musculus
ttgctgtgggcctaattcaaggctgatagatcaccacagaaggacactgttttcctccgggcagcaggaagtacagggtagggactctagaatcactgccctagggcatg

SEQ ID NO: 912 - DNA, 189 bp, Mus musculus
gtacttgaagttttagctagagcaaaaagacaatggaaggagatcaagggaatacaaagtgggaaagaagtcagagtatcattatgtccaggtgatatgatagtatacataaatgaccctatagattacacctaagacctctacagtggataaatactaaaatatttactacacagaaatcaccccatg

SEQ ID NO: 913 - DNA, 33 bp, Mus musculus
catgcaaggtatgaactcactaataaggggata

SEQ ID NO: 914 - DNA, 234 bp, Mus musculus
catggttcacactccataatatcttgttctcactaattcctctaatcccataatatacaccaataatttaacaagggaatttctacattgatttgtaataagggagatactgtgtgaacttacccaacaaaagtctccaatagaagtgtggataccacaggaagtcttgtgacaaccattaaaatttgggtctgataagaagataaccctttaaatatatagatttatgtaaag

SEQ ID NO: 915 - DNA, 149 bp, Mus musculus
catgggctggggaaaggcagagagaagaacatctggattgttcctaactttgcctttaaaatgagacttcaataatacttagacgtaccagcttctcacagtcagttaaaatgtgacacacacacctctcagcagactgaatgggtgag

SEQ ID NO: 916 - DNA, 76 bp, Mus musculus
agagatggttgggatttaagttaccagggtagggtcaccacaatcaacccttgatgcctttataggaagaaacatg

SEQ ID NO: 917 - DNA, 210 bp, Mus musculus
catggaagtctaaaagacattaggttctggatggaagaagagaaaattatctttaagttttagaaaagggatgataaaacaagtcttaaatcttctcaattttgccataattcatttgaattaatattggtaaatgctttgtgtggtcccataaagttcaatgtgttatatcactaagtagttatttgtaaaattataaatagcctctat

SEQ ID NO: 918 - DNA, 119 bp, Mus musculus
cttgtgaattgtttaactgttttgaaaaagtagatgttttctctatttatttttgggacaattatcagaatttgaaacaaactgtgtatctcttatttactttctgcttaacccccatg

SEQ ID NO: 919 - DNA, 384 bp, Mus musculus
catggttgctatattcattaacacaaatcatttaaaatccttaatgtaaaatgggcacattttcaaaattaaaatatatgaaaaccaataaagatagaaaatttaggaaaaaaaataatccaagcaagatgttaacatccaaccacagcagcatattagcagcaggacaaaaataaggacaacaaccaagaaagggattgtggttaatgtatgcctcattggaagggataataggatgtaaaagtgtgacaataaagagaaaaaaatctcttttaaaatgtaagttaaaataataaaaataatttaaaaattggtgttctcagggctggataatattactaacaaaaccagggaattattaataaaaaatctcttatcagttat

SEQ ID NO: 920 - DNA, 142 bp, Mus musculus
aacaagttttaaatggggcatagtggatcacatttgtgatcccagcacttggaaggtagaaataggtaaattaagagttcaaggtcatttctcagttatgtagttgtacatttctagcgatgtagttgagttcaaggccatg

SEQ ID NO: 921 - DNA, 60 bp, Mus musculus
gtcctccaatgtgcatttctcatttttcacgtttttcagggtttctcgccatattccatg

SEQ ID NO: 922 - DNA, 145 bp, Mus musculus
aattgcattgaatctgtggatttctattaacaagatggccatttttttcctatgttaatcgtactgatccatcaggatggcagtctttccatcttctgatatcggcctcaatttctttcttcaggggcttgaagttatcgccatg

SEQ ID NO: 923 - DNA, 62 bp, Mus musculus
ggctaggtactcctaaaccttcctctgctatcctaggcccaatagaaaaaaagtggcccatg

SEQ ID NO: 924 - DNA, 157 bp, Mus musculus
aataatactttcactgtactttaaaatattatctcctatctcactctaatacttctgtgaaagaagcaatatcgtctctttgtagataaaaatggctgagaagggcaccttcaagacactaagtgactaactcagactcagaagttcagagaccatg

SEQ ID NO: 925 - DNA, 145 bp, Mus musculus
catgctctactatgttcacagcagtcttatttataacttccagatactggaagcaactcagatgttcctcaatgtaagaatggatacagaaaaaatatggtacatttacacaatggggtacaactcagctattaagaacaatgac

SEQ ID NO: 926 - DNA, 123 bp, Mus musculus
aaaacccaagaacaattaagctgtagttcccaagtgtaattatattatggttgtttctgcttgctttatatccctatatacaatttatgattcaagtattagtgggaatagactaatggcatg

SEQ ID NO: 927 - DNA, 32 bp, Mus musculus
catgccaagccttctggtatcaccctaaaggc

SEQ ID NO: 928 - DNA, 237 bp, Mus musculus
catgctcttctctgctgttcttactgaatttttaataagaacaattccacacagctcgaaagcactgctcaattaagagatattcctaccaggcatctttggaatcctgcaagcacctcttctctgtttcctgatgaccctcaatttggttgtgtccagaggttggtggggaggaggggaggggaaacgaagcttatttttttttaattgcaagttcaattttacaatgttctcgat

SEQ ID NO: 929 - DNA, 189 bp, Mus musculus
catgctaggcaaatgctccactgaatgaattacatttccaatcctttagatgcattttaaagagaaaagattgagtactgaagttttgaatagaatacaggaataagggactaaacatatatatagccttatatagagaaatattaagtaagtagtaactttgcttgtgtgtgtgtgtgtgttgcacac

SEQ ID NO: 930 - DNA, 123 bp, Mus musculus
catgccattagtctattcccactaatacttgaatcataaattgtatatagggatataaagcaagcagaaacaaccataatataattacacttgggaactacagcttaattgttcttgggtttt

SEQ ID NO: 931 - DNA, 148 bp, Mus musculus
catgcacagctggtgagtgagttgtcttctggtacaaaaatctcctcacaggcacatttacaagtgcctatatctttgctagcttcaagaacacaaagaagggacacacaaaagctcttctgagtctccttctcctgctgttattttg

SEQ ID NO: 932 - DNA, 39 bp, Mus musculus
atcgtcaaagttagcaaaattataaatgtgaaagtcatg

SEQ ID NO: 933 - DNA, 109 bp, Mus musculus
catgaattatgtttgttttatttcttttgtacatcattcaatgcagtaatctaaagtttggggtcttggtcttatatcttggaacttcagtgacttattggttctaacg

SEQ ID NO: 934 - DNA, 125 bp, Mus musculus
agagacagtcacaaaaggggcccattcttgttaagaatgggccagtggagaagttcgggttagtggagtagcctgcctcagtttcctcctgtcttctgtagttaaatgtgttaatggttaacatg

SEQ ID NO: 935 - DNA, 26 bp, Mus musculus
catgtagcatttatcttagccagcac

SEQ ID NO: 936 - DNA, 185 bp, Mus musculus
catgtacagactatgaacaggaaatgtttttgcaaataactctgtgcattagaattttcttcagaaatataaccattttgacagttgtaggttacacttttaaaattacaaaatcaataaaattgatctacaaaccgaggcctacaaaacccttgctggatattgaagacggcataatattaaag

SEQ ID NO: 937 - DNA, 110 bp, Mus musculus
aattcccaccacccacagggtggctccataaccatctgtaactccagtctcagggactccaaggccctcttttggcttgcaagggcttgcacacacacagcgcacacatg

SEQ ID NO: 938 - DNA, 571 bp, Mus musculus
catggtgaatgattgttttgatgtgttcttggatttggtttcgagaattttattgactattttggcattaatactcataagggaaattggtctgaagttctttccttgttgagtctttatgagggtatcaatataattgtggattcatagagcaagttagattgtgttccttctgtttatattttgtggaatattttgaagagtattggtattagatgttccttgaaggtatgatagaattctgaactaaacccatatggttctggattttttttggttggaagaccaatgactgcttctatttctttaggtgttatgggactgtatagatggtttatctgaaccagatttaactttggtatttgttatctgtttagaaaattgcccatttcatccatatttcccagttgtgttgagtataggcttttgtagtaggatataatgatttttgaatttcctcagtatgttttcttatatctccctttccatttctgattttgttaatgtggatactatctctgtgtcctctgtttagtctggctaagggtttttctatcttgttgattttctg

SEQ ID NO: 939 - DNA, 128 bp, Mus musculus
catgggttaacagtgggccctaaacttgaactagaaaacttaaagatgctcatagggaagaagaaaagagcagaaagcttagcttctagacaggggtaaggcttagagctcaataaaaaaggaacccc

SEQ ID NO: 940 - DNA, 56 bp, Mus musculus
catggcctgtctcagtttacttcacagctgaacaagaggcagagagtgacaggtag

SEQ ID NO: 941 - DNA, 261 bp, Mus musculus
catgctcgccagtcccagaacctggaaggctgaggcaggaggattaaaaagccttggggacaccaggcttggtggcaccggtcgtaaatccagcactggggagttaagaagcaagtgagtcacatctgtgagtctgaggctatcttggtctacgtaaccagctctagtatagccagcctgggatacatagtaaccagttctagtatagccagcctgggatacacagtaaccagttctagtatagccagcctgggatacacc

SEQ ID NO: 942 - DNA, 198 bp, Mus musculus
catatgcgtattcacatttgtgtgggaacgtccttggagaaagcaggagcaggagttacagacagttataagctgcctgacctgggtgctgggaaacacctcaggtcctctggaagagcagtaagtccccttaaccaatgaaccatctatccgtccagcctacatttaatttgttttcttatttactttgtctgcatg

SEQ ID NO: 943 - DNA, 116 bp, Mus musculus
  misc_feature (83)..(83): "n" at position 83 can be any base.
cacacacacacacacacggctggggatccaacccatctcgtccttacacgtgctctaccatcacgccacacatttccagcacntttatctgaagtgtttccttttatttgtgcatg

SEQ ID NO: 944 - DNA, 292 bp, Mus musculus
catgcctggtgcctgcagaggtcagaaagtgttggatgccctggaattagagtaacacatagttataagatgctgcgtgggtgctgggatttgaacccttgtcctctgcaagagcagccagtgctcttaaccaccgagccatccctccagcccctgattactcactcttcacggcctcaatcttgtaaggaatattgaggctgccaagtgacgcaagagcacctaggaaggcagccacatcggtggcactctggaagcactgcgaggatgactgcacacattgccggttgtc

SEQ ID NO: 945 - DNA, 203 bp, Mus musculus
catgctggccatttattttgatttaagttatactctagacctttgtaaatattagccattgcatattacagaaatttcttagcagagatagtctctcactcttagtgatgagcaagctggagctcagcattattctcccagctaagatacagaattacagacgtttatgacggacacatcttggatgtagttacttagtccac

SEQ ID NO: 946 - DNA, 42 bp, Mus musculus
ccccccccgcccctgccagaccgcagccccaagcacagcatg

SEQ ID NO: 947 - DNA, 157 bp, Mus musculus
catgcctccctcagcctcctccaccccttcctgtcctgcctcctcatcactgtgtaaataatttgcaccgaaatgtggccgcagagccacgcgttcggttatgtaaataaaactatttattgtgctgggttccagcctgggttgcagagaccaccct

SEQ ID NO: 948 - DNA, 107 bp, Mus musculus
catgaattcaatggtgtgcttgctataaatgcaaataaaccatatatatcatattacactcaattttaaatatttttcctaatattaataaaggtgatggggaactt

SEQ ID NO: 949 - DNA, 548 bp, Mus musculus
  misc_feature (491)..(536): "n" at positions 491 and 536 can be any base.
catgtctactttattgcatattaggatgtcaggtcctgctcgtttcctgggaccatttgcctggaagacatttttccattcttttactctgagatagttcctgtctttgttgttgaggtgtgtttcttgtattcagcaaaatgctggatcttgtttgcgaatccagtctgttagcttatgtctttttacaggtgaattgagtccattaatattgagagatattaaagagaaatgacttttggttcctgatatatttgtttttctagttagttttgtgtgcttgggactctctccctttgactgtgttgtgagatgcttaatatcttgtcctatctttggtgcaggtgtcttccttgtgttagagttttcattccaggtttctctgtagtgttatgttagaagacatatactgcttgaatttagttttgcctggaatattttgttttctccatctatgttgattgagagtttttctgggtaaaatagcctancctggcatttgtgttctcttaaaagtctgtatgacctctgactangcttttctggcc

SEQ ID NO: 950 - DNA, 529 bp, Mus musculus
catggtgaatgattgttttgatgtgttcttggatttggtttcgagaattttattgactattttggcattaatactcataagggaaattggtctgaagttctttccttgttgagtctttatgagggtatcaatataattgtggattcatagagcaagttggattgtgttccttctgtttatattttgtggaatattttgaagagtattggtattagattttctttgaaggtatgatagaattctgaactaaacccatatggttctggattttttttggttggaagaccaatgactgcttctatttctttaggtgttatgggactgtatagatggtttatctgaaccagatttaactttggtatttgttatctgtttagaaaattgcccatttcatccatatttcccagttgtgttgagtataggcttttgtagtaggatataatgattttttgaatttcctcagtatgttttcttatatctccctttccatttctgattttgttaatgtggatactatctccgtgtcccc

SEQ ID NO: 951 - DNA, 221 bp, Mus musculus
ccatgtcaggtggttaacctgtgagtctaacttccaggaatgcaatgcctctggcatctacaggcataaacatacttgtggcttacactcaaactgacacaccaacacatatgtgcacgcgcacacacacacacaccaaattaaaaataaaataaccctttttaaaaaaatatagaatctatagataattgctttactgcactcacaaacattttaggatc

SEQ ID NO: 952 - DNA, 23 bp, Mus musculus
acactaacacaaagaaggggatc

SEQ ID NO: 953 - DNA, 32767 bp, Mus musculus
  misc_feature (2178)..(2262): "n" at positions 2178 thru 2262 can be any base.
  misc_feature (14746)..(15383): "n" at positions 14746 thru 15383 can be any base
  misc_feature (28120)..(30598): "n" at positions 28120 thru 30598 can be any base
  misc_feature (32397)..(32767): "n" at positions 32397 thru 32767 can be any base
cctctcaaactcttggtaattctcctgcttcggcacgctggggactgggactacacctgtgtgccaccatggctggctatttctctctcttgaacactggaagagtgctcagagtttactggatctgggagaagctcgaggctgggttatggaagccggctctgcttgctccagctcagggaggagttgcctgagggccaggcacttcgaaggacagatgggacccaaggccagacactgggccccagctcaccagaagtggagccctgactgtctctgagagggtaagctggggtggctgccaggcgggcaaggccaaagcctggcagcagccggtggcccctcttctggcagagatatcttggcatgagcctggctctgcccatgacactaaagtgccctcttaattagccaggctcttgccaagcactggccacgattgccttgtttcacagaattcaccttggactggcacagatggggagggtggatagcccggtgttttgtctttcttctaggggagctgggctcaagggcaggactcctgggccagcccaggtttttccctcagaaaccacagcatgaatactggcatgatggagcacacctgtaatcagcagaaattgagacaggaagattgttgagaatttgaggccaacctaggctaaatagggagaccctatctctacacactccccctccccccgcccctggaaatgctggagggtctggggaagatggctcagtggttaagggcacttgctgctcttgcaggggacccaagtttgattcccagcatctataacttggtggctcacaattccagttccaggcactctgacaccttcctgtggtctgcaaggcacctgcattcattctcacgtgcatgcgcacacacatgcgcgcgcgcacacacacacacacacacacacacacatctcataaatacaaataaaataaatcttgaaaacaacagtgacaacaacacatgctgaacatggtggtgctcctgacatggtggtgctcctgacatggtggtgctcctgacatggtgatgctcctgacatggtggtgctcctgacatgatggtaagcctgacatggtggtgctcctgacatggtggtgctcctgacatggtgatgctcctgacatggtggtgctcctgacatggtggtaagcctgacatggtggtaagcctgacatggtggtgctcctgacatggtggtgctccctgcactgacagttctgaggaggtggagataggaggatccagacttggaagcttgcctgagatagaccctgtctcagaataggctggaggctgcctctgcccttttgcttctatctctttttccatatgtgtgtgtgcgtgtgtgcatatgtgtatgcatatttgtaagtatatgtatataaataaacacacacacacacaaacttactctgtatactaggctggccttgaactcagagacctgcctgtttctgccttcccagtgctgggattaaaagcgtgtgccatgggctggtgagatggctcagtgggtaagagtacctgactgctcttccaaaggtccagtgttcaagtcccagcaaccacatggtggctcacaaccatccgtaacaagatctgacgccctcttctggtgtgtctgaagacagctacagtgtacttaaataaataaatcttaaaaaaaaaaaaaaaaaaaaaaaaaggcgtgcaccaccactgcccggctagttagctttatcttccgtggatgttttgtctgcagtatgtctgagtgagggtgtcagatcctctgtaactggagttatagacagttgtgagcagccatgtaagtgctgggaattgaatccgggttctctggaagagcagttcatgctcttaagcactgcgccatctctccagctgtccttatttatttttaagggtctcttgtagccatacaggccagaaacccaccattagccacggaccttgagctccaagtgctgggtgacaggcccgcatctctcctggtttgtgatctgctagggatggggtctaggacctcacacaggctgcataagcattcccctcacccaccctcatccccacccagtcctggacaggctctggctgtgtaggctggtctcctcctttctatccccctgcctcagcctcctgagtgctgaggnnnnnnnnnnnnnnnnnnnnnnnnnnnnnnnnnnnnnnnnnnnnnnnnnnnnnnnnnnnnnnnnnnnnnnnnnnnnnnnnnnnnnctgtggtggctcccgagtgctgtcatcccagcactggggaggttgaagcaggaaggagaatcacaggttcaaggccagcttggtttacttgagactctgtctcaaaaagaccaaaccagggactgggaggatggccagtaaaatgcttttccagctatcgagggaacctgagtttcatcctggaactcatacaaaaagctggctgtggtcaggtggcgcatgcctttaatcccatcactcaggagacagaggcaggcagattcttgagttcgaggccagcctggtctacagactgagttccaggatagccaggtctacacagagaaaccctatcttggaaaacaaaacaaacaaaaaaaactaggtgtggctagcctgtaaccccagtgctgggtaaacaggggcaggtgaatacatctccgggattcgccagcctgtcctatctatgagctctaggtctggggagacagcctgtcaaatcaatgcaagcaggtgacaaccgaggaaagacacccaaggttgatgcacgggcaagtgtgcacacacacacaccacagcaaacaaaaactaacaaaacccaaaccatattttgctgtggtggtggttgttaaattttatttattctgtgtgtatgggtatttcacctgcatgaatatctacctgtgtagcatatacatgccgggtactttcggaggtcagaagaggacatcaaatcccgtagaactggagttacagaaaatgaacttgtggcttctgggaatctaacttggatcctctaaaggacaggcaggactctgaattcttgagccacagatacagctttccaaacccatgttttgtaagagccaccaggcctgaaaactctgggccatgtcccgtttgttgtgtctaggcctcagtttcctggaaggcagagaatgcgtaggtccgttgttagtggagacagcagtggtggtaacagcctggtctaccctcttggtcagagggaggcaggcggagagtaactcagggcctgggggcaacacccagctgggcctggggctagtgggggctcagccaggcaggacgtgggtcctcctacttcctaagctctgatgggcaagtggtgccagtggtaccaggctgccctgaggggcccttagagcaggtgaccacagagccacaaagaggctattcatggcctccggttcacgaggctgcccctttattgagggcttgaaccacagaaagctgtgtggtctgcagggaagctagttctgagctgtctggccagctacagtagtgtgtgtgtgtgtgtgtgtgtgtatacacatggtacttttttctatctatctatctatctatctatctatctatctatctatctatctatctatctttgtgtctatgtatctaataataaattgatctatttaactatgtagatatcaatccattgatctatgtatctatcaactgatgtgtatgtatgtatggatgtacctacatgcgtacttgaggcaggacttaaagtagcccaggctagccttaccacatttcatagcagaggatggtcttgaacttcaggtcctcctgtctctacctcgtgagtgctgggattacaggtttgtgccaccacgcctggcttaggaggttctgtggttagaatccaggatttcactatcaactgggccacatcgtcagccatattcaatatgctttcttttacattcttacttatttactacaaatgggtcccaggaaccaaggtcggcaagcctgatggtgagtgctcttccctgctggctgacttatttgctcttttttttttttttttttttttctagacagggtttctctgtgtagccctggctgtcctggaactcactttgtagaccaggctggcctcgaactcagaaatctgcctgcctctgtccccaaccccacccccagtactgggattaaaggcatgcgccacacgcccagctcttatttgctcctttgaattaaggtctcatgtacacaaggctgaccgttcatgcacaatacagctaaggcttgctttgaatttctcagtttctttcttctacccaacagtttctgagatttcaggtccgtcctatgtcatgcccaggttttttgtttgtttgtttgtttgttttttggttttgttttgctgtttttcaacacagagtttctctgtggaaccctggctatcctggaactctgtataccaggctgtccttgaactcagagaccctctgcctccctagtgctgggttaaaggtccctgccatcaccgtgaaacttaagcccagcttctcatttggtggctggaaatttgcctgcctctgcctctctccagctgcctagcactgatgtctggttgagagcaggggaaactgaggtgccgctaggacaagatctcatgcaaccgtgaacagccctactgagccatcctcctgggacagcctctcaggccaggccttctgtgtcttctgctatagtagcagtacaaagttgacacaaccttgctcttcccagcagctgggagttcctgagaagtgtaaatgaggtttccaggaaagccaagaggtgagagactgaaaagttggagggataagggggtgcccatcaagctgcagtggagacttgttatctgttgcgcatccctgacatctcagcaggaggatcaggagttcaagggcatcctcagcaacatagtaagtctatggagctagcctgggctacacagatgccattacaaaaaaaaaaaaaaaagtaaaaaaaaaatcttgggatatgggggatgggtgggtgaactgtgtagcccagggagtcactactggttcctttggaagtccctgttctgcatggagatcatggagattctggggacactccaggagtcctccttcagggaactaagttggggagcagggcagcctatcctgtggccttatttcctgtctggtgcaagcgccaggcaaggcatccagccaggagcgactcaggcctgacctccgctaactgttctgttttgtgctgcaccctcatctcagcagggatcaggtggcacttgggtccccaggggatccagggacacagtgtccatgtccccatctttccccacagggacctggggcagggccgaagaggagacctcgtgatgtgtacaggtgtagctcatccctccgaggactcaggggacacttggggaaggtgtgacacagagcaggctggagctctgtgcggctctttattaagtgtgcctacaacaggggcagagacacagcagcgacaatgataacagcccactcccaaccgaagctcaatggttaccagactcagccaactgcagaattccagtccataacggcacctcctttcctttctcaggagcttaccagagaggtctcaccccaagccttcaccccatctagagcaaatgcttatatcccccatgtttgctcagagcagagcatggagggaccttcctgtcaccagaggcagaggcattctgtatacgtgcatacacgcctctgtgtgtgtgtgtgtgtgtgtgtgtgtgtatttggtacagatctaagcatagaaaattgaaaagcattgaggttggtgattgaaaggctcactgatgggcaagtcgggttcgagtgcgctaactgtatgactctatggatccgaatatcatgctgttttggaaaggaatgagggagctactgtttctaaggaagagaagaatgggcaccaagacatagggagggaaggtgggacagtaagcacttacagccgaagcccaagacctggaacccaaggggaaaaacaggtgtggccaggcttggtggcacgcgcctttagtctctgagttcaagtccagccaggattacatagcaaaactttccctcaagaaaaaaggtaggggctggagagatggctcagcagttaagagctcttccgaaggtcctgagttcaaatcccagcaaccacatggtggctcacaaccatctgtaatgagatctgacgccctcttctggtgtgtctggagacagctacagtgtacttacatataataaataaataaatcctaaaaaaaaaaaaaaaagaaaaagaaaaagaaaaaaggtagaggaggaggaagaggaggaggagacggcaagacaaaactaactacatagctgggggaggtggtgcttgcctataatcccagcacttggaaggctgaaagaggaaatcaggagttcctatgcagctttggcttatgtgagcctttctcataaaaccaagagcaaaaaagcaaaacatgaggtggtaactcagctggagagtgcttgtctagattccctcagtgaggggctggggtgtgactcagtgcctagaatcccccagggaggggctgggggcgtggctcagtggtagagcccctgcctagaatcccccattgacgggctggggtgtggctcagtaacagactgctcacctaagatgttcaaggccatgactttcattgaaaacatcacaaaacaaacaaaaccatcagtgaggttgaatgtgtatccatgtttgcttgtctccatttaaagaacacctggaagatctctagctgctggtggaggcgggagggtgaaggctgcttcatcctttgtatttgaactgtgtggctgtgggtgtattatctgttcccaaggactgcacatgaaatgagaacaatgaaggcttcggttctgctgagatgaacctcaattctccacagatgatctcacccagagccagatggaagtcccccaacatttaagcctctgttctgagtgctggacccaaactcatcttaagggaaaacccaaagagcctttctgtggtttccttccacaactgtctttcaatgtgtgtatgtgtgcacgtgtgtttgcttgtgtgtgtgtgtgtgtactatgtgcatgtgtgtgagcatgtgtgtatatgtatgtgcatgagtgtgtgtgtgtgtgtgtatacatgtgagcatgtatgtataggccagaggttagtgatgggtaactttctccagagctctccaccttagttttattgtctgtgtgtgagcggctgtgggcactgtacaccacagcacatgtgtggaggtcagagaacaacttgtggctgtcacttctctccctctgtgtgggtctaagacctggatccagcgctttcgcttgcttgagacatctcgttgactagctcctccgttgttaacacagggtctcactatgtaggtccagttatcttggaatttgctctgtagaccaggccggcatcaaactcagagatagacctgcctttgcctccagagtactgggattaaaggtgtgcaccactaccacccagtttaaaattctaaaaagatttgtgggtgcagggatttgaggaggccaggagagactgttggatctctgggaactggagttagaggtggttgtgagcccccacgggtgctgagaactgaactagggtgcttgagaggagctcactcactgctgagcccccactttagatttgagtccctcgtactgaagctgagttcagtgatttggctgagctgaccgctcagggtgggcttttcgatgtgcaccacaggcctggctttataggtgaggtcatgcttgcacaactggccttttggtgactcagccaactccccagaccttttttcttttgcatttacgtgtgtgtgtgtgtgtgtgtgtgtgtgtgtgtgtgtgtgtgtacatgaagtgagagggggcagtctgggaagggtcagtggacaacttaagggagttggttttgccttccatcatgatggtctagagactaaattcagcccctcagcctgggagcgtgcctttaccctccgagctcccagctttgggtttttgaggcaaggtttcatatagcttaggctggcctggcattcaaggtcatctcagaggcctaggatgaccttgtgttgtcggttctccggcctttacctctggtgtgctggcgtttgccttaccacacccaggcatcccccatagcttaagcctaaagctctcggatggccagcacgcccatgccctgacgtgaagttcagtgactaatcaatacagagcgttcacggagccctgacacatagcagcattgacttaaccttaacagcctggtgtgtaatgaggccaacttgtccgattctgcccacgatgcgatgctctgggttaaacaggtttgaacagagtaccggatggcagggagggcaccctcagtacagggttttggctgttactgcttccagtctcctgacctgctcccccaaggctggtcttaaactcaaagcaatcctcctgtccctgcttctcaagttctggaattacaagtgtgactcactgtacccaggaatatgtgtctttattacagaggaaggagagctcagagagtgagagtaacctgtgcaaagtcccacagcaggagagggtggctggctatcggccgtgaacttggtgacctttcctgtgacctctaagggaggaactagatgtcccagcaaggattctagggacttgtcaggactgacctttgatgatgggaaagccatgccatctccccttcccctttgatggtcgctggaggggtttgcctgggacagagatgtgtttggacacagatcaccgtgaagactggtcagtttcagtaccctgcccagcctgtggctgggaagggccaggggcccagatcttgtgggcagcctggggtagggccagcattccaggggcctgcctggcatgtggggaatgtcccaggagaagtctcagtcctccagaaactcaaagggaagtgttcttacgtggggtggtgtgtggtgggaggtgggaggtggtgtttgtgggaatgtccctctggtctggaaccctgaggggctgcagttaggaggtacattggggctgtgccattctagggagctgacctgcttttctgatgtcttcataaacagagaccactattcctgccttacctaccctgcttcctggtagaccagcaccccggggcttgagcatcaccacagtagggacttttgtgggccactgacttgggccacagttaccacaatttatttagagtcagcaaggtggctgtactctatgctgacccgggaatagaaatctcggtttctgctcaggaggcccaggctacaaggccttgaaaaaccctgaggcgggcggggcaggtagggctctgcatgcgcctctctagaaattaacctcctttctaccccagacccttctggcgtctctggcttcttcaaggaccggctctaaggctacttcctggtacaccctggaccctccctccatcctgaagggatcattatcttaaacctggtccttcccatcgactgggtttgggggtaggggtgtttcaggatggcctcagagagcaggagaaagttggagatcagccaactactgcagagcacgactgtggaggaacagttaaatggactagcaaacacgaacgggccagaggcagaaggactgctatgagttcgagtccagcctgagccacacagatacttcaagcctagtctgagttacagagtgagacccggtcttaaaccccagaaaaacactccggggaagcgcaggggaccgggcgcgcgctgcagagccccctccccggcaggcccgggtaggggcgtggccacggtgacgtcatcctcctataaaaccctgggcgccgccgggctggctttgtggagaactgcagcgggctaagccgtgttgaacaaaggaggtcgggcacagctatccaagctcccggggccaccgggccgccctccgccaccatgaccgccaacggcacggcagaggctgtgcagattcagttcgggctcatcagctgcggcaacaagtacctgacagccgaggcgttcgggttcaaggtgaacgcatccgctagtagcttgaaaaagaagcagatctggacgctggagcaacctcccgatgaggcgggcagcgcggccgtgtgtctgcgcagccacctgggtcgctacctggccgccgacaaggacggcaacgtgacctgcgagcgcgaggtgcccgacggcgactgccgctttctcgtcgtggcgcacgacgacggccgctggtcgctgcagtccgaggctcaccggcgctactttggcggcaccgaggaccgcctgtcctgcttcgcgcagagcgtgtcgccggccgagaagtggagcgtgcacatcgccatgcacccgcaggttaacatctacagcgttacccgcaagcgctacgcgcatctgagcgcgcggccggccgacgagatcgcggtagaccgcgacgtgccttggggcgtcgactcgctcatcaccttggccttccaggaccaacgctacagtgtgcagacgtccgaccaccgcttcctgcgccacgacgggcgccttgtggcacggccggagcccgccacgggcttcacgctggagttccgctccggcaaggtggcctttcgcgactgcgaaggtcgctacctggctccgtccgggcccagcggcaccctcaaggctggcaaggccaccaaggtgggcaaagatgagctcttcgccctggaacagagctgcgctcaggtggtgctgcaggcggccaacgagaggaacgtgtccacgcgccagggtgagttggggacatgtcccctcccttgggtcctgacccagtgcacaaaagcatctctgcactccttctatttccctatttcctcctgggctccctttaggctcacaggcctctgggctccgccatggggaggtgggcttctattttgaaagacctgatctcaccagatagccttggctatcctggaactcgctatgtagactgggctggccccgaactcgcagaaatcttccttcctgtctcttgtgctgggaataaaggcatgtaccacccctctgttcaggacgtaggcttcttctgctgggagaaggtgacgtggggaagtgggtaaggcctaacacattctaaagcaatactgtccaccaccacccccccacccccccacccccccggctgggggcgtgggactccatagacctagcttagatcttctccgtttcctcttccttcccagtctgagccatccccattcatgagccgattctttaggataggctgtcccaggtcttggagaggaagggttccccctacacccccccttgttcatttcctcgtgcgtcctctcccgtttcgcgggcctttggctggagggccaggggacagtcacccctgccctccccgccttaaatggcgagatagaggaggttggaggggcttttgatcccggcggggtgtgctgggcggggtcggccctgcgactcttggtggtggtggggttgtccgtaggggcttcccctcccccactccatctcccctcgctaaggcctggcgctccgggccgcggcctttgtgagcaggggggcgggtcgccacggctgggccctccctcgtcccctttgtcctgctaaggctctgcagatgggaaaaccagatgcggcggagctgggggaggggatcggcttaggcgggtccctctgcggaagagccacccccaaccctccaggcgttgtccctggtccagggttcattgagaaggcgcggagtgaagccgcctggctcttccttcgcaccccggctggcaggcggcgtggcgcgggtggctgcgcgccaggcgccctccctgccctcctatgcacgccttgcggtccggcactcggcggagtgtccctccaaaagcctctactctcgagtgaaccggtccccaaggcctctctggctgggaacaaccgtttgcagctctatttgtccccatccagggcctccagcaggctggcaggccatttccgaccggcatgggcatggtacaagtaggcgcctcctttctggcgtacccccgactcttcaaagggtctttgctgcctgctggtaggggcttgtgagatctcgcttccttggttgggaaactgaaccccaggctttggagatagctggatgggagccagtctgtggggaggaagacccccctcccccaatgcagagggcaaagccttgggtggggcctgcttgagtttggctgaataacgctcagaaaagtgcgaccatttgcttactgttacacagtaagtcagcaccatgctgaactgggtgtacttgatgccagaatgttctctcattatacacacacacacacacacacacacacacacacacacacaccaatgaaccatggcctctcttgtttcacagtgctgggcgagggggtcagagttcccacctgtttagcaaacattgagatacgagctgcggtaaacgtctcttgggaatgtgactggtatgtaaagcagaagattgggggtacaggatcggggtagtagattataaagatctggggtcccttctgaggacccaggagctgccccaggagagtgaatagaaatgagcatgcaccaagtttatggactggttttgcaggcaggggcctcagcaaaggcccggaggcagggagttgcaaatagagaagccctgcatagctaggaggaaggctgggattggagggaatcctgcagatgacgggtactccagagcctagagagaccagctctctgcttacagagctgtggccgaggcttgtgccctggggaaggttaggcaaggcacaggtgacttgggcccttggggcctgaaaggagctagagggtgtgttttgcgagcctggacaggtacccttttctgagggtgccatgattgtgcatgattcacactgatgcggcaggagggggcgggaattgaaggggtgagaatctgacgggaacttggggtcacacacagtcagacctcttctgccctcctatgtctgggtccaagtctcattcccgagtcagccaactcctcccccggctttttgagggtgagctgttgggtgggtgtgccggggaggccattttgggcaggcttgcgtggcagggaggcggggctgggcttcggggaaacacgtgttgaactgctagccaggagtagggagagggaaggctcaatctggtctggggttgtgaatcttccatgcagatttgctgcttccggcttcctggcctcagtttccccatctgaaagcacagaggtacattgagccaggatcttcctgggaggtggagatcctatgagagtaggatggggggtagtgggtagggtcttttcctccttgcttctcatgaccctcccaagcccctgctggctcaaggagaccccgtgctatgtctccccacactgcccaccctggcttacttgttgggttctaatgctttcaaagaattttgtccccatcatttctagggcggctggctaagaatgagtgacaggtgaggctgggctttgtagggtatccttttgacggcttccctcttgggtcgaggaatggcttagttttgagcactgtacgactttgggcggtgaagtcctggagggttctaaactaagccgccttctgggttgtgaggattgcttatttcgaacaacaacgctagggagtctggcaaacagctaagcccaggaagggggttgcgggttagaggaccctctgagtcaccgcagagacgcctaggaagctggaagacagccacgccccctccgtgggctcctaggagccagtgactcaggttttctgtgctgctgctgctgaaaaaaaaaaaaatcccacagaaaacctgttaccatagcaacgcagctccaatatgattccaaggccaagtggggcctttccccctggctgagccttagagggcccattctggaagggggctaacttccctttccggctgaggtgggagggcccaccatctccttggcaacaggccctcacgtcctttcacggtcccaacagaattgagaggcgattctttttggcaagggagggaaactgaggcagagagcggagaagacattccccgaagggtgcctggagtccacctttggtgccttggtggcctctttattaaaaagtggttgcacaggcccctttgttccagtacctggagatgagacccacatggtgaggccctttttgttctctgtctggacgtctcatttttcagaggtactgggaggttgaaggttggtgtatgtccacagcactgtgctgtcttgaactcagtgcgcatgacatcttgggccagggcctctcctttgtgtgagggaagctagcatgctgggaaactccgactcctttagtccacccactttagttgtagtttttgtcttgtagcccatctggcttccaactctccatcctcctgcctcagtctccagggtgcggcgatgacaggcataggtcaccacaggcttctggcctccacttgatggttgccggagtggctgggagtggcttttcttttcttttcttttcttttctttactttcaggcagggtttatctgtgtagtccggctgttctggaactatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagattgggactgactggtcccagttctggctttccctgactgttccattccccgcagtgggcacggttagatcaggtggggtcacttaggctcgctagcattgggtgtggctcttttctgcccagtatgctgtgctaactcagctgtccctgcacgtggcaggtcaattacaggtaggctgaggggacagtgggtgacaccctgtatatgtgtagccaattgttctcttaatatttagccatccctagtgtgggccaggggcaggagagccatttctgcctgagaaggttgaacagactacagcccagagctgtggccttggggtggctgtctagcctgggatggccctcctactctcctctgtgcttcagtggtagatcctgtggaggcactgggccagggtccttggggacccatcatggaagccatgtctgctgatccatatgtctagaaggggaggcatctgtccatccccactcctgaagtcaagggaccccttggtcttgcagggtgaccttgggccaaggccagccacctctgagctccatcttctgctttgtgaggtagaggtaagagcctttggcattgacaacacagatagagactcggttgggtcagggtggcattggctggcatactcttgggtgtagtgtcaactaaggatgagttcctaggggcaaggctgaaggtggcatctaccatcccataccacgttctgctgcctaaggacgcctgaagacaactgtgagactggcagtgtacactgcttccaagctgaggacattgttagaatcccagatccttgaaacaatgagtttatcttgttaggacccaagatcccactcctaggtggagtcaaagccttgggagcggcaccttattggggctcagtgaggtcatgtgacatggaaaccatgtagtgttactatgtagcaagaagttagaaagccatgcaacaaacctgtaattccaactcctgaggcagaggcaggtggatctctgatttcaaaggtagctccagatacactgtgagaccttctcaaaacaagacaagcagactggagagatagctcagaggttaagagcactggctactcttctagaggtcctgagttcaattcccagcaaccagttggtggtcacaaccatctgtaatgggattcgataccctcttctggggtgtctgaggagaatgacagtgtagtcacatacgtaaaataaataaatctttaaaaaaagaaaagaaaaatgaaaagggaggggggtgatggagacatggctcagacagttttttgtttgttttggctttttggtgtcttttcttctttctttctttctttctttctttctctctctctctctctctctctctctctctctctctctctctctctctttctctatcttttctcttcttgtcttgtcttgtatctgtgtagcagccctggctaccctggaactcacctataggtcaggctagccttgaactcagagatcagcctgcctttgccttccaatgctgggttaaaggtgtgctccagcactgtccactctggaccacttgttcttgtattcacctagttctcacagggtggctcatgacagttccaggcgacctgacctcttagggcaccaggcacatgtgcgcatattcatacacacaggcaagacgttcacacacgatacatacaatacaagacgtatctttctaaaaattaaagaaaataaatgagaagcgagagggaaaggagggagagccactgtttggactggaccaccactggcagggaaatgccagaaggttcagacagcattcagggtttgtggctggtgggggcagggataaaggaggagttttctaaaggaacatgtggtctgtgcgtgtgtgtgtgtgtgtgtgtgtgtgtgtgtgtgtgtgtgtgttactaggggtagactccagggccttccaccatgctgggcaaacaatttacactgagctatattttcgaccccctctttattttatttttattttattttatatatagctctgactggcctagaactcattatgtaaactaaggtgacctcaaactcacccatactcaaatgagattcacctgcctctgcctcctgagtgctagagacagtcatgaagcaccacgcccaccttctctttaaaaaaaaaaaaaagcctattgcttttgtttttatttttgtctgtggagggtggtgcccacacccagtggtgccagtttggaatcagttctcctgccctattctacctagggatcgaacgcaggtgggtaggtttggcagcagctgcttttaccccacgagccatctcgctggcctgtagccctttgtgtgtctgtctgtctgtctgtctgtctgcatggagtggagtctcatgtagctcaggctggcctgcgagttatgatcttcctgaccctggtatccaagtgcggagactgcaggctcactctgccacgcccttttacacagttctgggatggactctgcatgtcaagtgagttatagccacggccctattttattttattatttttgagatcgggccccactcatcatggaggctaaggtcggcctcctgagtggtgggatgacaggcgtgggtcgatgtgcctggctcctactctattcttttactttcacacatacccactacaggaagcgagtagcgagcccccttttaccagcaccccgccatgtgacattccgcagaaccagcgccatctgtgtgtttattcaatggttttggttgtatttaaagcaaattccccacactggtgcttcttacccggaaacgcctccatctgtagctacaaaaccaggccattccttacataacggcagcgttgcctaactggaaccgatctttaagacccaatccaggcccacgggagagttctgctaggccttagaacatctttgtgggtggttcgtttgaagtttgatggcttccttcctcccctgctcccctttctccttgccattttgggcactagagtttaaagaaacccgcctgccactgaactaaatccccagatttttttttttttaagttttttttcgagacagggtttctctgtgtagccctggctgtcctggaactcactctgtagaccaggctggcctcgaactcagaaatccacctgcctctgcctcccgagtgctgggattaatgtcttatgtatcccagactggtcttgaacttgtggtcatgcctggagtatcctattttgattgtttatgtgtatacccctaatatggatgtcagagattcatatcatatgtgccgtctttggtcatcctccatacttttgggggatgtatgggggcagggatggagtctagcctgggctgtggtaacacacgcttttcattccagcattaaagcagagataggtcgatctctgagttctaggacagcctgggctacacagggaaattctgtctcaaaaaaaaaaaaaaacaaaaagaaagaaagaaaggaaaagaaataagagtctccctatatagccctggctgtcctagaacttattatgtagaccacgctggtcttggactcacaacagagatccatctgcctctgcctcctgaatgtccactctctgcttggagacaagaatcgctcagtggcccggattcagggattcagctaagctggctggtccctgagctccaggcctccatctgtcttggcttccctgtgacaggattatcggctcatgccaccgcgcctggctcttacaccattcctagcgatctgaatttaatactctatggtcaagccatccttcaatgctccctcccctcctgttgagacagagtcttactcactcggtagcctggggtcccagaactcacagttagtctcccgtttgtttcctgagtggtgagatcgttcctggctagccttggctgctgatttggtagcctggtcccgcccactgcttaggattatcactgaggagtttaagccacacttcaggaagccctgtggatcctggaatctgagtgagacaagggtcacacagtggcctgaccggctctggtctctctctgcaggaatggacctgtcagccaatcaggatgaagagaccgatcaggagaccttccagctggagatcgaccgcgacacaagaaagtgtgcctttcgcacccacacgggcaagtactggacactgacggcgaccggaggtgtgcaatccactgcgtccaccaagtgagtgacaccctacaccccttcatcacctggcctggctcttcccccaggactgggcagcctgctcgatgcccccacgttgccagcccctcttctcttccccaggaacgccagctgctactttgacatcgagtggtgtgaccgccggatcactctgagagcctccaacggcaagtttgtgaccgccaagaaaaatggccagctggccgcctcggtggagacagcaggtagtcacttgggggcacgtaccctaagcctgtttccctagtaccccgtggtcaaccatcagtcccacctggacctctctgtgtgttcagggaatccctgtaagctggtgtaccctcaggccagcagcctgtgacccttagcttcttggtatccctctctgctgagccattccctgactggcccatctttgttgctgtgaagctcactggctccctttccctgtggcaggggactcggaactcttcctcatgaagctgattaaccgccccatcatcgtgttccggggggaacacgggttcattggctgccgcaaggtcacgggcactctggatgccaaccgttccagttacgatgtcttccagttggaattcaatgacggcgcctacaacatcaaaggtgggttcactgggtgaggatgcacctggccattcaaagccgacattagggaacgggtgtcctatgaccgcctggggtagcccctccccccttgtcttagaactttcctggcccaacctgggcagacagcgaaggtgggaagcagctagggagagtggtcgtggctccaatctgggaatcggagacaggagaattatcttttttttttttttggtgttgaggacagaacccagggctttgagcttattaggcaagcattctactgctgagttaaatccccaaccccaagaatcatctcaaaaagaaagaaagaaaagggaaaaagaaggtggagcctggtggtggtggtggcggcggcggcggcacacgcctttagtcccagcactcaagaggcagaggcaggtgggtctctgagttcttgccagcctgctctacagaatacattctaagacagccagagctatgcagagaaaccctgtctcaaaaacaaacaaaaaaagggggtggggagagaagatagaagataaggatattccttcttagctagctgtgggaccaaaaccagtgagaggacacagcaatccagaggtgtcagtcagaatcagagccctgtgctgtgtgtggccttagcaaggcaaacgggactcctttcttacagtgctgaggactggactcagagctaagatccagcccctccctgggggattctaggcaggggctctaccactgagccacgcccccagcccctcactgggggattctaggcaggtgttctaccactgagccacgcccccagcccctcactgggggattctaggcaggggctctaccactgagccacacccccagcccctcactgggggattctaggcaggggctctgctgctgatatatgtcctttttgtttgtttacttgtttgtttgtttgtcttattgtggccctagctgtcctagaacttgctttgtagaccagagatatacctgtctctgcctcccaaatgttggatttaaaggcatgtgccaccatgccccaccctagcctagccctcttatgttttgtagtttgagatggcatgtcagtagatttcccaggatggccttgaatctaggtaatcctcctgcctcagtttcttgagtatttgaattatgggactgtaccttacatccagctgagcccactcagttctggaagctgacagcgggagggagtgttaatcctttggggactgacaaggtggggttaacatgtagtctccctcctcagactccacgggcaagtactggacggtgggtagtgattcctcggtcaccagcagcagcgacacccctgtggatttcttccttgagttctgtgactacaataaggtggctctcaaggtgggcggccgctacctgaagggggaccacgctggggtcctgaaggcctgcgcggagactatcgaccccgcctcactctgggagtactagggccacctgccctctgcaggccgctctcgtcagtccctcctgttatccttactcatcgggtggccctgcagcaggtggcaaaccccttgcctttcaaactggaaacccaagagaaaacggtgcccttgctgtcaccctctgtggaccccttttccctaactcactgctccccatgggtcggtggctgcagactgtccccaggagggactctggttccctctgtccccttctttccatggggaactctggcacctttcttctgacctcagtcaactctgagccttatttccccccaggaagtggcctaggagaagctacagggcctagggacttaccctgagcttgtaactggaagaccccgtccctatccccgctcccgcccccaccccaccccacccctgctctggccccagcctctggaggccagccttttggcgggactgaagccgggcatggccaaccttgcccacaagtgtttttctggatcttggctggaaggcagtctgtcccatcctgcagtgtttgggcctggctctttgactcaaagctagctaggtggcactccgtgtcgctcctgcacattctggaaggggcgggcctctcacccacctcattccttttccccctggcctgactggaagcagaaaaatgaccaaatcagtattttttttttttttctttaaggaaatgttactgttgaaaggccctaggcaagcctgccctgttggttgtagtcgtgagtggtcttggggggagatgcttggctcctgtccctgcctccccagcgggttccctccctccctcctgcctgaccaccccagctctggctctgtgattggtgctccacgtcttcccagacacctcggggctcctgggcgggagaaagccggatgtgcccctccctgggagccctggagtaaacctcagggggccctttcccaatcacccccttccaccgacccctcaacaccatgcatctcactctgggtgtctcgctcctttatttttttgtaactgtcatttctataactctgaagacccatgatagtaagctttgaactggaaaataaagtaaaatcaagtctgcggcccgtgtgtgtctcaggggaagtggatgctggagtgggcagagggccggctgggagggaggcagcgctgattgattggcagcccgcagactcttgtttcggtctcggaccctagcggcttcagcatatgccttagtaactctggactgagaaatggctgacacgaggttcccgagccttacaagctgggcaggctagagggttcagcaggtaaagttgtgtgctgtcaagcttgatcagactgagtccccagcaccgtgtgaaaagttgggcacaacggtgtacacccaccccagggcctctggcaagcacagagacaagaggatccttggagcctgctggcggcccaaccttgcccaatctgtgattcccattgagtgagccataaggtggagatgggttttggaagataccccacataggcctgcggccccccacacccggaaataaaaacaagccaggcttgtcatcccagttattcggggagctgaggcaggaggatcacagatttaagactgcccaggttgaagagtaagttcaagggcagcctggacatcttgctagattgtttttttgttggttggttggtttttgttttgttctttttttcgagacagggtttctctgtgtagccctggctgtcctggaactcactctgttgaccaggctggcctcgaactcagaaatccgcctgcctttgcctcccgagtgctaggattaaaggtgtgcgccaccatgccaggcttagatgttttaaatgaagggctgtggagtgtggttcacgggtagcctcgctcagacaggctggggcaggagaaatggatggctcagcattggctgctgccttagggtttccattgctgtgaacagacaccatgacctggcagctcttctgaaggacattggactggggctggcttacaggttcatcaaggcaggaagcaaagcacaggcatggtgcaggaggggctcaagtctacgacccgggtctcaaagcccacccccacagtgacagactttctccaacaaggccacacccactccatcaaggccacacctcctagtagtgccactccttgagccaagcttattcaaaccaccaatcacaactgcttttctagaggacccaggttcaattcccagcatccacatgacagcttacaattgtaactacaattccaggggatccaacacccttacacaggcacacttacaggaaaagcaccaatcagtgcacataaaaatacataaatcgttagagagaagagaccattagctaccttcacccttaacaggcaagctgaggtcctgggagtgtgttagaggtccgcagcttggagtctatagggtagtggcatcgtctatacgttccttccttgacaggtaggtacttagctgagacctctggggtatcccagagacccattttacagagggaggcactgaggcggagggaaaagacaaccttgtttgctggctcagaagagtgccagtggggtacccacccacaaggctcagcatcccgaggcactgtggaggcagttacaaagccgcattgattggctgctgatgacgaaatgaagagccccgcggtgtgattggcggtcccagagggaaggcatgtggggagattgacaggggcagatggccacaaagggtccagtgacttcccgcagggtggaagctctgggcccaagccagtaaagtgtcaatgacatggagagacagatgaatccttcccagttgaattctcaggctctggtggggccgcgctggggagaaaagacaccctgtccgttacaaccaccaagcgcagccaggctacgtgatgactgggggaagtcccagacgtgacttcctgcagcactggaggggagggtccgacggaggaggctgagagtctgttggaggcagccgaggatcggagggaagaggcacaggtcttacatgggaggcataaagtctggtgggagtccaagggaggacggatgtagggtgatgggaagaaaggacctaatccagaaaaaggaacagaagagccacctacctggttaggggacgctggccctccgcagggaaagctgtcaaagaaaggcctggctaatgagaccatgtcgtggggggcccaggcaactgtggaggcatcagacaccttggggcaaggagggcacccatgagctagtacacaccactaagtatctcagagtcctgcacacacactcattgacacaggtgggtgagcagcacccacgggcagctgaagctgagtatcctgcccgcccctttgtttcttccaactgagcagggacaagaaggatccctatgaatatggctttttttgtttgtttgtttggttggttgggtttttgacttggtttggtttttccagacagggagtaaagacatacaccaccataacccagctttgtaaatctggtttttgtgtgtgaacctatgaattccactcctgttgcactgatgggaaattgaggcaaagtctcaaagaagctgacagcacaggctagtgtgttcattttctctctacaaaaagaggaaaaattggggctggtgagatggctcagcggttaagagcattgactgctcttccaaagcaggtcccgagttcaaatcccagcaaccacatggtggctcacaaccatctataatgagatctgagaccctcttctggggtatctgaagacagctacagtgtacttagatataataaataaataaatctttaaaaaaaggaaaaattatttattattttattattaaattaattgttgtatttatttattttattaatctatatttaatttatttttttattttgtgtgcatgagtgttttgcctgcatgtgtgtgcactacctgtgtgtccactgcctatggaggtcagaagaaggcgttgggtccgggaactggggttgtatggttgttagccgccgcgttcatgctggttctctgcgaggcggcacttagtcctgagccatcttctgtcagctcctctactttcttttagacagggtctcctgtagctcaggctgggcttcagcttgcctggtggttaagggtgactaagttaaatcatcttacatttctgcctcacttccacctcctgagtgctgggcttgcaggcatgtgccactgggatgggttttgtttcctgctggcttctcaccccgtagctccgtgtgttgggtcagggccagccctgtgcccactgagccattaaccctactgagcccactgtagggaaaaaccatagaggagcttctatgaccctcatgggtccctccaggtctgtcagagttcaggaggcatggatctctctggcagggagctgttgactttagccttggaatttcccaaccaagtctacactgagcaccctgtcgacgacctgcttctgactcctcctgtgaggctcttttggagtgatcttagtccccacagggcccccatcttctccagagctgagtggcctctcctactggacagagaagagctgtcctgacttggttaaaatgttgaatgcaaggagcggaggaaacggcccagctggtgaagtgtttggctcgatccccagagctgtggagttcccaacaggatggggctcactggctgccctgatcagcaagctcagaaaccaagatggatagctcctaaggactggaattggaggatgacccctggtgacagacacacttgcatatgcatctgtctgcacacatacacatatgcatgtaaaaccctgatccacgtggtagtgcctgactgtaatcccagtacttgggagacaggaacagagaatcaccttcagtttgaggccaacctcgtctacatatccagcaccttaggagactctgtttccaactcttcagggtggctcacatctctaatctcaaccctcaagaagccaagactggaagatgcctagagaggaaggtttgcttgggttcagtgccagcctccagaggcagaggcaagcagatttctgagttcgaggccagcctctacagagtgagttccaggacagccaggcagccagggctatacagagcaaccctgtctcaaacaacaacaataacaacaacaacacaacaagaaaacttgagtgtgcgtgtgcgtgtgcgtgtgcgtgtgtgtgtgtgtgtgtgtgtgtgtgtgtttactatttacagtaaacgagtctttggggaggcagccaaagtaggcgaggaactccttgtcccctgctgggctctctgggttgagatcttgtcttgatggggagataggaagggattctctgtccctcagggtgctatcagcagtgggaacagatggggtcgggagagagactgggggaggggagaatcagggtggaggagggctgtgatttaggtttaccatgaaaccggagtcatcaccggtgggagaggctggtcagagttcctcttttttcctcttctttccctaggacccaggcctgatccggtggggaggggaatgattggaaaatgctgccttctagagtccctagcgagagccacaccccaggcctcagccatcaatgacaacctttctgttctcactgaaagcaattaaagatctgtaagatgagtcagtgttacccattgtaagctgctgactgccttggtcccatccctgggacccacatggtggaaggaaagaatggactgatgcccttggacccccacgtgtgtgctgtggcacacacacacacgcatgcacacaaaaataagtaatgtagttcaaaatttagaataaatcaggcgtggtggtgcacacctttaatcccagtactcgggaggcagaagcaagtagatctctgtgagtttgagaccagcctggtctacagagtgagtttcaagccagccatagatagctacatagccagatcttgtgttagcctcctccttctaccaacagaaattaagatcacaaataaacaggaaagagggtggaagagacaactcagtggctatgaacatttgctgttcttgcagagaaaccaggattgagtcccggcacccacatagtgggtaaacattatctctagctcaaattccagaggacctggcttctgagagcacggtacacatggggtgttctctctctctctctctctctcacacacacacacacacacacacacacacacacacacacacgcaggaaaaacagaaaagcacataaaataaaaacaaatatataaaaatagaatccaaggggattcaacgatgtcatgagtccacagaaatcctatcctcccctttttcggggtgttacacgggcggatcaaacccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactgctcttccaaggtcttgagttcaatcccagcaaccacatggtggctcacaaccatccgtaatgagatctgacgccctcttctggtgtgtccgaagacagctacagtgtacttacatataataaataaataaatcttaaaaaaaaaagaaagaaagaaagaaagaaagagagagagaaagaaagaaagaggtgagggctgggtgtggtggcgcacacctttaatcccagcacttgggaggcagaggcaggtggatctctgtgagtctgaggccagcttggtctacagagtgagttccaggacagccagggctacacagagaaaccctgtcttgaaagaaagaaagaaagaaagaaagaaagaaagaaagaaagaaagaaagaaagaaagaaagaaagaaagaaaggaaggaaggaaggaaggaagaggtgaataggataaaatgaggtccaataggttgggggcatggctcagtgttagagggcttgcctagcaagtgagaggcctgggttcaacctctggcactgaagagggatggtaggtaggtaggtaggtaggtaggtaggtatctagatagatagatgataaataggtagatggatggtagatatatagataatagatgtgggatagatagatgatagagatatacatagatgatagattatagatagatagatagatagatagatagatagatagatagatagatagacagacaaatggtaggtatatagatgatagaaagatgagggataaatagatggtagataagtagatgatagtaggtagatgagagggagagagagagagagcgagagagagcgagaaaggatataataaggtcattaggctaatttgatccaaagacagattggggttcttataagacaagtgatcaagcaggccagatatggggggaactgatctgtaattctagcacctggggtgggagatggaggcaggaggaaggggaggtcgagggtatccgcagatacttagtgagtttgaggctatccccagccacgtgagactctggcaaatccttccgcactaacaacaaaaattctgaaaggcaaacctcccttaactcataaagcatgaattggggcgtatgcgggccttcagagccatgtggtgtgtttgggaacagacgacaggaaacactgttgagaggactcagacccagagaggaagggacagcagagtcaccatgtggacaggcgttggggcttgctgggccgctcacaggaagcagcgcacaccagagccatccgcctaggagctgggccacagtttcctgcagagtgggccctgacacacccggccaaagcaagcactggcctgtggacagaaagcagacacaggacggagcccgttccggggtcagctcactgtacttgaagatgtgagcccaaagaagtggggggtgccacggcgtcttttgcagatgttactatgccagttggtgttagacacttagatatatttttaagaagagcagtcggtactcttaactactgaaccatctctccagccccacaatgacattcttcaaagagcagagcttagaggcacaggcacttgtcaccaagcagcaacatgagtcagatccctgaaaatccacaggcagaaggagagagctgactcctgtccgttgaccttcatgtgaatacagtggtgtgtggtggtgtgtgtgtgtgtgtgtgtgtgtgtgtgtgtgtgtgtgcatttatgccatgtgtgtcaagagtgtgaggaggacccaagagagttcctagacttaaagctggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 954 - DNA, 2634 bp, Mus musculus
gagctaagccgtgttgaacaaaggaggtcgggcacagctatccaagctcccggggccaccgggccgccctccgccaccatgaccgccaacggcacggcagaggctgtgcagattcagttcgggctcatcagctgcggcaacaagtacctgacagccgaggcgttcgggttcaaggtgaacgcatccgctagtagcttgaaaaagaagcagatctggacgctggagcaacctcccgatgaggcgggcagcgcggccgtgtgtctgcgcacgcacctgggtcgctacctggccgccgacaaggacggcaacgtgacctgcgagcgcgaggtgcccgacggcgactgccgctttctcgtcgtggcgcacgacgacggccgctggtcgctgcagtccgaggctcaccggcgctactttggcggcaccgaggaccgcctgtcctgcttcgcgcagagcgtgtcgccggccgagaagtggagcgtgcacatcgccatgcacccgcaggttaacatctacagcgttacccgcaagcgctacgcgcatctgagcgcgcggccggccgacgagatcgcggtagaccgcgacgtgccttggggcgtcgactcgctcatcaccttggccttccaggaccaacgctacagtgtgcagacgtccgaccaccgcttcctgcgccacgacgggcgccttgtggcacggccggagcccgccacgggcttcacgctggagttccgctccggcaaggtggcctttcgcgactgcgaaggtcgctacctggctccgtccgggcccagcggcaccctcaaggctggcaaggccaccaaggtgggcaaagatgagctcttcgccctggaacagagctgcgctgaggtggtgctgcaggcggccaacgaggggaacgtgtccacgcgccagggaatggacctgtcagccaatcaggatgaagagaccgatcaggagaccttccagctggagatcgaccgcgacacaagaaagtgtgcctttcgcacccacacgggcaagtactggacactgacggcgaccggaggtgtgcaatccactgcgtccaccaagaacgccagctgctactttgacatcgagtggtgtgaccgccggatcactctgagagcctccaacggcaagtttgtgaccgccaagaaaaatggccacgtggccgcctcggtggagacagcaggggactcggaactcttcctcatgaagctgattaaccgccccatcattgcgttccggggggaacacgggttcattgcgtgccgcaaggtcacgggcactctggatgccaaccgttccagttacgatgtcttccagttggaattcaatgacggcgcctacaacatcaaagactccacgggcaagtactggacggtgggtagtgattcctcggtcaccagcagcagcgacacccctgtggatttcttccttgagttctgtgactacaataaggtggctctcaaggtgggcggccgctacctgaagggggaccacgctggggtcctgaaggcctgcgcggagactatcgaccccgcctcactctgggagtactagggccacctgcctctgcagccgctctcgtcagtcctcctgttatccttactcatcgggtggcctgcagcaggtggcaaaccccttgcctttcaaactggaaacccaagagaaaacggtgcccttgctgtcaccctctgtggaccccttttccctaactcactgctccccatgggtcggtggctgcagactgtccccaggaggactctggttccctctgtccccttctttccatggggaactctggcacctttcttctgacctcagtcaactctgagccttatttccccccaggaagtggcctaggagaagctacagggcctagggacttaccctgagcttgtaactggaagaccccgtccctatccccgctcccgcccccaccccaccccacccctgctctggccccagcctctggaggccagccttttggcgggactgaagccgggcatggccaaccttgcccacaagtgtttttctggatcttggctggaaggcagtctgtcccatcctgcagtgtttgggcctggctctttgactcaaagctagctaggtggcactccgtgtcgctcctgcacattctggaaggggcgggcctctcacccacctcattccttttccccctggcctgactggaagcagaaaaatgaccaaatcagtattttttttttttctttaaggaaatgttactgttgaaaggccctaggcaagcctgccctgttggttgtagtcgtgagtggtcttggggggagatgcttggctcctgtccctgcctccccagcggttccctccctccctcctgcctgaccaccccagctctggctctgtgattggtgctccacgtctccagacacctcggggctcctgggcggagaaagccgatgtgcccctccctgggagccctgagtaaacctcagggggccctttcccaatcacccctccaccgacccctcaacaccatgcatctcactctgggtgtactcgctcacatttatttttttgtaactgtcatttctataactctgaagacccatgatagtaagctttgaactggaaaataaagtaaaatcaagtctg

SEQ ID NO: 955 - DNA, 1482 bp, Mus musculus
atgaccgccaacggcacggcagaggctgtgcagattcagttcgggctcatcagctgcggcaacaagtacctgacagccgaggcgttcgggttcaaggtgaacgcatccgctagtagcttgaaaaagaagcagatctggacgctggagcaacctcccgatgaggcgggcagcgcggccgtgtgtctgcgcacgcacctgggtcgctacctggccgccgacaaggacggcaacgtgacctgcgagcgcgaggtgcccgacggcgactgccgctttctcgtcgtggcgcacgacgacggccgctggtcgctgcagtccgaggctcaccggcgctactttggcggcaccgaggaccgcctgtcctgcttcgcgcagagcgtgtcgccggccgagaagtggagcgtgcacatcgccatgcacccgcaggttaacatctacagcgttacccgcaagcgctacgcgcatctgagcgcgcggccggccgacgagatcgcggtagaccgcgacgtgccttggggcgtcgactcgctcatcaccttggccttccaggaccaacgctacagtgtgcagacgtccgaccaccgcttcctgcgccacgacgggcgccttgtggcacggccggagcccgccacgggcttcacgctggagttccgctccggcaaggtggcctttcgcgactgcgaaggtcgctacctggctccgtccgggcccagcggcaccctcaaggctggcaaggccaccaaggtgggcaaagatgagctcttcgccctggaacagagctgcgctgaggtggtgctgcaggcggccaacgaggggaacgtgtccacgcgccagggaatggacctgtcagccaatcaggatgaagagaccgatcaggagaccttccagctggagatcgaccgcgacacaagaaagtgtgcctttcgcacccacacgggcaagtactggacactgacggcgaccggaggtgtgcaatccactgcgtccaccaagaacgccagctgctactttgacatcgagtggtgtgaccgccggatcactctgagagcctccaacggcaagtttgtgaccgccaagaaaaatggccacgtggccgcctcggtggagacagcaggggactcggaactcttcctcatgaagctgattaaccgccccatcattgcgttccggggggaacacgggttcattgcgtgccgcaaggtcacgggcactctggatgccaaccgttccagttacgatgtcttccagttggaattcaatgacggcgcctacaacatcaaagactccacgggcaagtactggacggtgggtagtgattcctcggtcaccagcagcagcgacacccctgtggatttcttccttgagttctgtgactacaataaggtggctctcaaggtgggcggccgctacctgaagggggaccacgctggggtcctgaaggcctgcgcggagactatcgaccccgcctcactctgggagtactag

SEQ ID NO: 956 - DNA, 32767 bp, Homo sapiens
ttgcatttgaagctaccatgactgcaagagggagttcccgaaggggtctgggaatggcccagggaaataggggtgaggtgagactccactgccccgacagtgcccatgtatgaattagaaaaagtgggccaggcgtggtggctcacacctgtaatcccagcattttgggaggctgagtgggcagatcatgaggtcaggagttcgaaaccagcctggccaacatggtgaaaccccatctctactaaaaatacaaaaattagctgggcttggtggcacacatctgtagtcccagctactcaggaggctgaggcagaagaatcgcttgaacctgggaggtggaggttgcagtgagccgaggtcatgccactgcactccagcctgggtgacagagtgagactttgtctcaaaaaaaaaaaaaaaaaaaaaaagaaaagaaagaaagaaaaagaaaaaaagtgggccaggtgtggtggctcatacctgtaatcccagcactttgggaggctgaggtgggaggattgcttacagccaggagtttgagaccaggttggacaacatggtgagaccttgtctttacaaaaaaatacaaaaacctatctgggcatggtgttgcattcctttagtcccagctacttaggaggttgaggtggaaggatcacttgagttaagggaggagaccacccctcatattgtcttatgcccaatttctgcctccaaagaaagaaaaagtaaaaactaaaaggcagaaatgaaaaccacaggcagacagcccagcgccacaccctgggcctcgtagttaaagatcgacccctgatctaatcggtgatgttatctatagactacagacattgtatagaaatgcactgtgaaaatccctatctggttttgttctgatctaattaccggtgcatgcagcccccagtcacgtaccccctgcttgctcaatcacgaccctctcacgtgcacccccttagagttgtgagcccttaaaagggacaggaattgctcactcggggagcttggctcttgagacaggagtcttgctgatgcccctggccaaataaaccccttccttctttaactcggtgtctgagttttgtctgcggctcatcctgctacagagtctaggaggcagaggttgcagtaagccaaattcacgccactgcactccagcctgggtgacagagcaagaccccaccaaaaaaagaaaagaggccaggcgcagtggctcacgcccagctaatttttgtacttttagtagagacggggtttcaccatgttggccaggctgatctcaaactcctgtcctcaggtgatccgcccaccttggcctcccaaagtgctgcgataacaggagtggaggctcaactttttaaagaagaaaaggacgaatcaggacaggagacaattacaagctctgttcattcggaattctcattggcttacagaaataactttggctagtgattggttatatgttgtagacagacccacagggtggatggcgtctgtggccacttgggcattagctggtccagagcccagagtccatgtagcaagtagcttcaggacgtaattatttagctcaatagaaagtgagatgtgactgctgttacttttttttttttttgagacggagtttcactcttgttgcccaagctggagtgcaatggcgcgatctcggctcactgcaacctctgtctcccaggttcaagtgattctcctgcctcagcctcccgagtagctgggattacaggcgtgtgccaccaagcccggctaatttttgtatttttagtagagacagggtttcactatgttagccaggatggtctcgaactcctgaccttgtcatccaccggcctcggcctctcaaggtgctaggattacaggcatgagccaccacgcccggccttttaactgctgttacttttttttttttaatcatttttattctgctagttccataaaagcaatgtaaacaccagcattctatacatcttgctggtgaactcacataatgcttagttccctgatcctttgacctccttgtcttctccagttattttctgtttggaccactggccacaggaatggagtggggttggggcttaggagagagcaatgtggctttttggtatgacttgtttcattgactgctgttacattttaaatgcctttctgggcctgataatttaagggggctggcatttctcacatcaaagggcaaagggtttttttgtttgtttctcactattgctcaaaagccacatgtgtcaaggacagctcttgttaacgggcagagaagcttatagaacctttccagggctggcgcggttgttcatgtctgggggacaagagcgaaactccatctcaaaaagaaaaaaaaaaaaaagaacatttccaggccaggcacagtggctcacacctgtaagtcccagcactttgggagattgaggtgggaggatcacttgaggccaggagtttgagaccagcataggccacatggcaagaacccagtttctacaaaaacattttttttttaaattagctgggctcggtggtgcacacttgtggtcccagctactcgggaggctgaggtgggagaatcgcttgagcctgggaggcggaggttgcagtgagctgtgatcgcaccactgcatttcagcctgggcaacagagggagactctgtctcaaaaaaaatcaaataaagaaaaaagaacatttccattattgcagaatgttctattggacggcgctgggccagatgcctgccccaagccctgggacacccaaacctggtgaaagtgccaagctcccatctgggggtgctcacggaaggggccgggagctgggattacaagcgtggaggcaggcgccaccccagaggaggtgggtgatgtctgagccagagtctttgggatgagcagggctttggcaggcagctttgttgggcaggcaacaggcacagcaggtgcaatggcatcgaggttggagaggtggactggcggggagaagagaagggagggtggcaggagagatgggcagaggccccccaggagcccagagccttcagggctttgggccctcttggggcactggggagccacgggagaagtgtggggtggagaggggcgccctggatttgaccaccttcaggaacctaccttggctgcccgggtgggtgggatggaggtgatgaaggtggaggtcgtagcattgtcactgagagcgatgcttattctgatttttgcccccgtgagcctcagaaatcggtcagaacagtgctcgggctgggcgtggtggctcacgcctggaatcccagcactttgggaggccgaggcgggcggatcacctgaggtcaggagtttgagaccagcctggccaacatggcaaaaccccgtctctactaaaaacacaaaaattagctgggtgtagtggtgcatgcctgtaatccagctactccagaggctgaggcctccctgggaggcggagtgcagtgagccaagattgtaccaccgcccctccagcctgggtaacagagtgagactctgtctcaaaacaaacaaaaaagaacaaaccaaaaccagtgctccaattcaccttgctgaattggagaagaacaggtgcctgggtcctcccggctgacggtgacgtcactatgagccaccacgcctggcccggtgggtgtttacagcagaggtggttcagggaggagtgagtggcagatggtgcaggctcagggaggagtgagtggcaggtggggcctgaggccagaggcaggaggaccgttcaagactgaggtgtcttgggcactggtgccggggccggggagagccctggcatgccgggccccggccctcagtgaaagcaggatgaggtggcggccaagcagggaggccaaggcctggcagcagccggcagcccctctcctggcagggacatcttggcaggagccgggctctgcccagggcgctaatgtcctcttaattagccaggcacttgccaagcacttgccgctgcggcctcactttgcagaacgcacttgggtttggagcaggaccagcatcggccaccgggtgagtaggggggatggccaggtgagtaccatggccagaaggtgcggcctctgagtccccactgaagccaatccaggccccgacctctggtcatcatcaacagaagagtgacagaaacagaaaagatatcaaggaacacgttttcagggccagattccaggtcccccacctattttcctttgctcctgccttgcctggctctgcccccttgaactcttattcacccagtgtaggcatcacctcctcctgaaggccctcctggactgcacagttaactctggagcctcccctgcacagggcagctcatgtatggatccacaggtgagttcctgtctttgaagggttacagtttaggtcctggagcagtggtggggaggtcacacctccacccacatccctctttgcaaatcccatgggaactatgagcctgggtcccccaaactgcatgttccccacttaaagctgggccagatcctgtttgctgtatccaggcctcagtttccctgcttgtaaccagaagtccatgcagccagaaattgtcagggagctgggcacggtggctcatgcctgtaatcccagcactttcagaggctgaggcaggaggttcacttgtgatcaggagtttgggaccccagcctgggcaatacaatgagatccctgcctctaccaaaaaattaaaaacaattagccaggcctggaggcatacacttgtagtcctagctattcaagggaggctgaggtgggaggatcacttgagtccaggagtttgtggctggggtgagctctgattgtaccactgcactccagcctgggtaagagaatgagaccttgttttattttattttatttttatttattttgagatggagtctcactctgtcacccaggctggagtgcagtggtgcaatgtcggttcactgcaacctctgcttcccggcttcaagagattctcccgcctcagcctcccaagtagctgggattacaggcgtgtgccaccacgcctggctaattttttgtgtttttagtagagacagggtttcaccatgtttgccaggctggacttgaactcctgaccttaggtgatccatgcccccttggcctcctaaattgctgggattataggcatgagccaccgggcctggccgagaccctgttttaaaaaaattaatcaggtccagtgcggtggctcacgcctgtaatcccagcactttgggaggccgaggagggcagatcacctgagatcgggagttcgagaccagcctgaccaacatgcagaaaccccgtctctactaaaaatacaaaattagcagggcgtggtggcgcacacctgtaatcccagctacttgggaggctgaggcaggagaatcacttggacctgggaagcagagcttgtggtgagccgagattgcaccattccactccagcctgggcaaaaagagtgaaactccatctcaaataataataataataataataataataataataataataattggtagagatgttggtagaggcaggacagtgggagtgacagcctggtcctgtcctcccgggctctggctgaccatgctgtagtgtggctcagggccctggagggcacagctgtcctgtggccctgtggtcagccgggaagccaggcctggcaggactcctgccctagaatcagctcctcccactccccagggtcccatgcagggcgctggccgtaccaggcctcctcgcgggtgccacagagccagcggctgcacagcaacagagacgccattcacaggctctcggccacgaggccgctcatttacagagggctgagccgctgacatctgtgcgtttgtaacatggacagcatttctggtcccatacagacgcctgggccagccacatttatctccccttgagagaagggaaacgaggctcgggagggaatgagggattggcttggggtcacacaactttaatgatgaccctgggcaggaagctcccaggatggcaacagagactcagggcaggctgggcatggtggctcacacttgtcatcccagccctttgggaggcagaggtgcaaggatcactcgagcccaggagctcaaggccagcctggggaatatagtgagaacccatctctaaaaaaaaaaaaaataggccggtcgcggtgactcacgcctgtaatcccagcactttgggaggctgaggcgggtggatcacgaggtcaggagattgagaccatcctggctaacacggtgaaaccccgtctctactaaaaatacaaaaaataggccgggcgtggtggctcatgcctgtaatcccagcactttgggaggctgaggccggcggatcacgaggtcaggagttcgagatcagcctgacaaacatgacgaaaccctgtctctactaaaaatacaaaaattagccgggcgtggtgacacgcgcctgtagtcccagctactcaggaggctgaggcaggagaatcgcttgaaccatcgaggtggaggttgcggtgagccgagatcgcactactgcactccagtctgggagacagagtgagactccgtctcaaaaaaaaaaaaaaaaattagccgggcgtggtggcgggcgcctgtagtcccagctactcgggaggctgaggtaggagaatggcgtgaacccgggaggcggagcttgcagtgagccgagatcgcgccactgcactaaagcctgggcaacagagcgagactctatctcaaaaaaaaaaaaaaaaatttagccgggcatggtggtgcatgtctgtacccccagcaatttgggaagctgaggtgggaggattgcttaagcccaggagtttgaggcgggagtgagctgtgatggcaccactgcactccagcctgggtgacagagtgagaccccgtctctccctatcccccgcaaaaaaaaaaaaacaactcagggctttcccacccctgtccttgcacagatgaagaaccgaagcttctagaaggggtatattttgcccccaggccccaaatcctggtctttggactacagtcaagacctagcacagggctcaggcctaaaaaaaagctgttgaggagggtgtgaggctgcaacgttgcggtgagaagggggtccccagggagggcgcagcaggaagccccagggaagtgcctgggagagggaggttgtgcagccagaaggagcagcccgcagcctttggttgttgactcctgctttgtaagtggcagtctggttgggtaggacagggtccgagtcctcactcagggaactgagtccagggtgagctgagcagcccttcctggtggcctcactttcccctgcagagcctgctgcatggtgtccagtggccagcctgggaggagctcaggactggcctcacctcgtgccacgccctcgtaccaaggtggctcagatggcacctgggttcccgaagggcccaggaacacagcgtccatgtccccatccttccccggagggacttggggtggggcctgcaggaaggatcatgtgacttgttcaagggcagcttgtcctgccccggacacagaggtgcccatcgtaagcgagatgcaggcaaggtgaggacagggcatggtgccgagcaggaatgattttcgaaaatgctactctgtggtcgggcacggtggctcactcctgtaatcccagtactttgggaggcccaggcgggcagatcatgaggtcaggagttcaagaccagcctggccaacatggtgaaaccccttctctactgaaaatacaaaaaactacccgggcgtggtggtggatgcctgtaatcccagctactcaggaggctgaggcaggagaatcgcttgaaccctggaggtgaaggttgcaatgagccgagattgcaccactgcactccgacctgggcgacagagaaagactccgtctgaaaaacaaacaaacaaaaccccgagattctcttttcccccgtccggagctctatggccatctggagctcgttctgtccacaaggacacatttcctggcagcagctgtggaccagggctcactcactcacatctgtacccaatctagagcaggacaaacacctatcacctgcactggcaatggacagaggacagtggcagccccatcaccagaggcattcaagccaaggcattttctatcgtctatttatctatctatctatctatctatctatctatctatctatctatctagatgagatcttgctatgttgcccaggttgaactcctggcctcaagcgatcctcctgcttcagcctcccaaagtgttgggatttcaggtgtgaaccactgtacctggctggagtgcagtggcactgtcatagctcactgcagcctccacctcctgggctcaaggaatcctctttcctcagcctcctgagtagctgggaccacaggcatgcaccatcacacccagctaaaccttgattttttccatagtatatggctcagggcagagcaaagaagcacaaaaacatgttggcttgcggttgagggctgatgggagggggttctggccaaagcccaaaattaacagccacaacgtcagtgtctgtgggaggggttgccaggggcgtgcgggttctggggctcaaggccctgccggtaaacccatttgaagcaggatggcaagaaggtgacaccatcttcccccgcgcactgaaagcccctggctgggattgcctggggcagacacaggctcggaccagccccagcaatcccagtttatcagcgagccggctgagggcccggagttatctcagtgcccggcctgagaccttgtgggcagcctgtggtcatgctggcattccaggggccttttggcatgtggggaatgtccaggaaaagcctcagccttcggtgaggcgcagaaaagggaagtgtccctagagggggtgggtgagggcgtgggaggtggtgtctgcagggaatgtcccctttgggggaggaggatggagggttgggattctgaggatgggggggggggctgtagccagcaccatgtccctcctgtgtgaccagctcagagtcccatgaaattggggcttgggaggggaagggacactggcctgggaaccagagacctgggctggtctggctcacagttgctggacctctgtgatccgtgtcaaaaaacgagaacaccaattcctgtcctgcccactcaccaccaggtgggacctgaaccctggcatcgccagcattgggaatgtcggccactgactcaaccactctcccggagacctatttgggccacccgaggcgggtgcctgggccacacggaggggtcctggtggtcttcagggcagcggctgtggggctgaagcctcaaggaaccacatctctgcataggagggccaggctgcagggcctcggagacaacctagttgggcgtgttggggtctgtgggtcccaggtcctggcctcaccgggtccccaccgcgctgtcagctcccagcctctttccctcgtctgcctctgggcttctgtaaggctatgtgctccaaggccacctcctccaggcagccctcagacccccaccttcgcccagtaccgatctgcaccgtggtctctgaagtctccatcgtgacctcaaacctcgctcgtccttgctcctagcgaggcttggggtcggggtgtccgaggtgggggacatccgggggggttaggtggctggcgcggggagccggggttgtgaggggtgatgtcctcaggcggcggcgctgcggggtgcggcgaggacaccggtggggtgagagcaccggcggggcagcagcgggggccgcagcgccgggtccctcggcccggggcccctcccgcgcggagccaggggcgggacaggggggcgtggcctggtggcgctgacgtcacctcgcctataaaatgtccggggcgccgctagctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtgagtggggacgctgcccccgcctctcctggtccgtgcacaaagcgcaccccacccgcgcccctccagcctcccgccctttctcgctcgcggcgccgctgcggtccggagcactgcccattgcgcccccgctaggcacgcgggctaccccgcctggagggggcgaggagtggggctttgcccatcctcgggtgccgctgcccacctcccaccccgggctgggatcatgggctcccctaggccccgcggagtcgcaaccgtacgtgcaccctcctaacccccccccccgcccaatcttggctctccccacgcgcgctgatccctcggatcagctgtcccagctcttgcggagtgggagcccctcacccatttcctcgtgcccctccccccgccggctgtcctggagctcgggggtccgaggcaagggtcgccacccgcaagggcgcgcctccacccccaccggcagcctttcgcgggcgagatgggggaggttagccaggcctttgatcccggcggggcgcgcctccacctccccgtctgcccggccttcctccacctcctcccgctgccgggcggggtcggcctccgctggtgggggggggcgcggggtgtcagcccttccccccagcccctcctcccgcgtctgccccgcgctcgaggccgcggcctttgtgagcaggggggcgggtcgcctcgactgggtcctccctcgccccctttgtcctgctccatctctgcagatgggaaaaccagatgcggcggggcgggggaggggatcggcttttgcggttcacccctgcagaggagccccccgcgccgcccccgggcccagggctcgggtcccgaggttccccaggaggcggtctccctcctcgcgccgcggcccgggaacggcgtggcgcggatggcggccctccaggcaccccgcccttcgcccgccgcgcgcgtctccaggccggtgcgctgagctccgctccgcgggcgaccgagggcggcttcagcgcgagccgggagaccccaggccagctccctcgggaagcccctaccctctggtgaacccatcccctagggcgctcgccgggaacaattgactgcaactcgatccgtcccctccggggcctcctgcaggcacggctatttgcgaccggcctgtgcgccactctttcccttctttctcagattctccccgaggggctttctcttccttttggcgtcctcttccactcctggcggagaagctgttccttgcttgcagacagaggccccgctggagggaggggcgtggggggatctttttccctggataggaagtcggaccccaggccttggagatggctggacgggagcccagtttgtgtcctcatccctcctcttggaaggagccctcctgacggcccccctcttggctgtgggctctgcaggagggggaaagaccccccatggcagtgggggtgagggtggaggcctgggtggggtaatggccattttgtgcctgaagtttgctaccttaagtcccagagaggtgaagctgcttgtcatgggtcacacagcaagtgaccacaaggaagcagcatgcagaagtgggtgcatttggctccagaaaccccgtttcctgtttcccacagcgcatggcgggcagagctcctcacctgatcagcaggcattgagccctactaaggggacctgctgagccatgagtgaaccagtggggttcacgttctcttggggacattacgaagtgtcaaggaaaaggcagcgggtacaggttattagatggctgagtcctttctgagcaggacatttgagctggcctgaaggatgaatagaaggtggcaggtatggggggggtgctgtgtggaccagcgttgtaggctgtgggtgtctcctgtgcaaaggtcttatggcaggaaggtacagagaaagcccagtgtggctgggaggaagcttgtgaggtctgggccacgggaccttgggtgagagcttagtgcagggctatggtccttgccttggggttgcagccacagcctcccgtggggaagaagtcgcagaagtaggtggccttggccctgggggccaggaagttgcagagagcctgagggtgtttttggcgagcctgggcagataactcccctctcctgagaagcttgctgggggcgtctggtgtgtgattcaggctgatagggtgggaggaaccagaaattgcagccaggagaggtggtggtgatggctcagcttggagttgaaagggatgtgggacggcgcgggggtgggggtacttgggggccgaggttggggctcctctggcctcagatcttggggtccttatctcgtttctatgtcagccaactcccggggggcttttgggaactggagtctgcaggggtgggcgtggggggcgtgtctgcagaggccattttggacgggcctgcgtggcaagggggaggcgtctgcttccgacacacatgctggggaacgccagccaggaaggggaggatccggacttagctggcaggggggatgtgaatcatctctgcaggcctgcacgggcgggcccggtgggggcagggtgctcccctttgaaaaacgctgcgccctgctcttcagcctcagtttccccatctgtaaagtgtgcattccaggcctccttgggctggcccagagctgccctgggcaggggctttcagcccttcacaccagaggctgggtcagctgagtgagtgctcctttgtcctcccgccatgccccaggctcctccctgctccccaggatccacacctaccctggccccgaccctgggccatgcctcaccacacttcctgtcttctctcacatctctcacatctgggagtcctctcccgccagcctgtgcttgcatctggggatccatgccagggataggacctgtcctccctgctggcttgggacatgccctctcccagccactctgaggagggctgactgaggaagggctcgtcaagctgggctttgcaggatgtgtaagagttctccccacgaggcgcagggcattctgagcccagggaatggcttgtataaggatgcagaggcatttgaaatggccaagtagttgcaggaatcgactggaaaccggggtggtaaggtgaagccatagaacattccaggccccctcccctaaatgagatggaaggagtgcctgttttgaacaagccaggggcatctggggaccgttaaggcctgggggtggtgatggggactggagggtgtgaggcaaccagggggtgcccctctgagccaccacagacagaatggttcagaaggccaggcacactggctctcgcctgtaatccaagcactttgggaggccaaggagggaagatggcttcggccaaggagggaagatggcttcagcccaggagttcaaggccagcctggaaaacatggcaaaacctctgtctacaaaaaatacaaaaaattagccaggcatggtgatgcacgcctgtcgtcccagctactcaggaggcttagatgggaggatcacttgagccggggagtttgaggctgcagtgagccgagatcgtgccactgcactccagcctgggcaacagaacgagaccctgtcttaaaaaaattttttttggcctggtgcggtggctcacgcctgtaatgccagcactttgggagtccaaggtgggtggatcacctggaggtcgggagtttgagaccagtctgaccaacatggagaaaccccatctctactaaaaacacaaaaattagccgggcgtggtggcgcatgcctgtaatcccagctactctggaggctgaggcaggagaatcccttgaacccgggaggcggaagttgcagtgagccgagatcgcaccattgcactccagcctgggcaacaagagtgaaactccatctcaaaaaacaaaacaaaacaaaaaaaacaaccaaaacaaacaaacaaaaaactgtaattaaaataattaaaagaaaaaagttaaaaaaaaaaaaaagagaggatggctcaaaggctggaaacagggaaggccactgtgaggggaggacaggcagggctagacctctctggaaggaggagggagaggtacccgtgggcccggcacaggagactcttaatctcctggctcccgggggcttctgtgggcctgtgactcaggatttctgtgcctctgttgatgaaaagaaaaatcctgaagaaaacactgttcccatagtaacacagctctaattagagactccaaggccaagcgagggccttggagccaggaggggccctgctctactggggggacgacacccctttcccctatccctccctgctggggtgtggcctgatgtctacgtggcaccaggcccctaaatcctttcaacatcctggcggagcggagaggctgggcccttttgacaggtggggaaactgaggaaggttgcagggaaggcactcatccaagggtgcctggccccccgcggtgggtgcctcactggctggcctaaacctttgcatcaaaccagttccaggattgaacgcaacaggctgatggggactgagtcgtggtacagatggcggcagttgtgtggccctgggcccaggaatggctgggaagctccctttcttctctggcttgggggatgaggttagtgtaaatttcatggagttgccaggaggattaaggccgacgtgcattcacacgtggccccgtggctgccgccagttaagccctgcgcagccattggaagtctcattgagaaggagcctcccggcttcctgcatttgttccaggcgggctggtaagcgccctgcttatttgcaaggctgtgtgaggacgagccctgtaaaccctaggacgaggctgtgctaatgtggtttctgttccactgtctccccttctccttttgcccctctttctggggaacctggagcccctgatgccctctgttttttcctgctgctggggtggacctagaacctctccctccatcctttctgctgctggggtgggcctgcaggaggctgtcctcttacctggtccctaacttccctccgatcagcggggcttcagcggagccccagcgcattggacaggtggtgctctgtggccggcacaggccagggcccagggtgcggcccctgcctgtaggtagacatgcaggcccttctgagcagaatgagggggcggtgagggcagctgtgcgggtgtggctggcctgacggctccctgcagccctgcggcttctgtgcagtgggggtggggcgggccagacctttgcagggcctcttggctggtggagggctgagtgagcagaggccccagccctcgtgttccctggggtgtggccttaggatggtcccggcaccctggggacccagcccctgctcaccttatcctcctcccgtgcttggctggggtgtggtggctgagccagcccacccagtgcggtggatgctcgtcggagggcagagggtgggctaccggcttaaggggccccagggaacctggggggtggagcccaaggggttccaagaaggggcggggccaggaacccatagacaagagggtggggcagggaaagggcgtggcaagagggccacccacctccggtccagagagccagccagacccttactttctcttgctgtgtgaccttaggcaaggacatgccaccaccggccttagtctccctctttgtgaagtaggatgaagatccccacctgtggagcagatgtggggctgcatggttgggtcaggatggaacaggatggggaggccgggcgtggtggcttacccctgtaatcccagcactttgggaggcaaaggtgggaggactgcttgagtcctggagtttgggcaacatagcgagaccacccccatctctacaaaataatgttaaagttagccaggtgtagtggtgagtgcctgtggtcccacctactggggagactgaggcaagaggatcctttgagcccaggaggtggaggctgtagagagccatgcttgggccacttgcactccagcctgggcaacagagcaagaccctatctctaaaaaaaaaatggaattgaggatgtgtcctctgggtgtgggctctaccacccaccagcctccctctcctgtgggtgctgcctgccacccaccgctgaggtccctgcagcatcaaggtgcccaaacgaagacactctccagctctgagccaggcacccatacagagcccggcagacgcctctgctgctgcagttcttagaatccagagcgcgtggggaatgtgaatttgtgctgctggagccaaacatcccacctccaggttttagctggaggaatccatgtggatatgcaaagcaatgtagttataatgaatagcaattgtgggctgggcgcagtggctcatacctgtaatcccagcactttgggaggctgaggtgggtggatcacctgaggtcaggagtttgagaccggcctggccaacataatgaaactccgtctctactaaaaatacaaaaaaattagccgggcatagtggcgggtgcctgtaatcccagctactcaggaggctgaggcaggagaatcacttgaacccaggaggcagaggtttcagtgaggcgagatcgtgccattgcactccagcccgggagacacagcgagactctctttctcaaaaaaagaatagcagctttgctatagcttaggggagcaaaacccgaaagccaccttaagtttcccgaagatagagatccctggggtcctattctgagacagagtcttgctctgtcgcccaggctggagtgcagtggcggatctcagctcactgcagcctccgcctcctgggttcaagcaattctcctgcgtcagcctcccgagcagctgggattacaggcgcccggcaccacccccagctaatttttttttttttgagacagagtctcgcattgtcgcccaggctggagtgcagtggcgcgatcttggctcactgcaagctccacctcccgggttcacgccattctcctgcctcagcctcccgagtagcagggactacaggcgcccgccaccgtgcccggctaattttttttttttgtattattaatagagacgggtttcaccgtgttaggatgatctcgatctcctgacctcgtgatccgcctgcctcggcctcccaaagtgctgggattacaggcatgagccaccttgcctggtccttttttttgtatttttagtagagatgaggtttcaccatgttggccaggctggtctcaaactcctgacctcatgatccgcccgcctcggcctcccaaagtgctgggattacaggtgtgggccactgtgcccggccagtcccattctactttttagggacatggaatcatgtaaagatgccatacagaaaacagtatgcaaatccagagacagaggacatctgtgcatgtttctttctttcttcctttttttttttttttttttttttgagatggattcttgctctgtcgcccaggctggagtgcagtggtgcaatctcagctcactgcaacctctgcctcccaggttcaagtgattctcctgcctcagacttccaagtagctgggattacaggcatgccccaccatgcccagctaatttttgtatttttagtagaggcggggtttcaccatgttggcaaggctggtcttgaactcatgacctcaggtgatccacccgcctcagcttcccaaagtgctgggattacaggcgtgagccgccgtggcaacccgcatgcttcttatgtataagaaaaaaacagctagaaagttgtgggttcactggctgggcacatggtggcttgtgtctgtaacctcagcactttgggaggctgagttaggaggatcatgtgaggccgggagttcaagaccatcctaggcaacatagccagaccctgtctgtaccaaatagaaaaaaaaattaacttgatgtggtggtgtgtgcctgtagtctcagctatttgggaggctgaggtgggaggatcacttgagcccaggaagtcgaggctacagtgagctatgattgtgccactgcactccaacctgggcaacagagcaagaccctgaatcaaaaagaaagagatgtatttgccaacacaggggtgttctgcagtggggtgggaaggggacgtgtaggacttcatagtttccttttttttgttttagagacagggtttaaaaaaaaattttttttttttttttgaggcggaatttcattcttgttgcccaggctggagtgatctcggctcactgccatctccgcctcccaggttgaagtgattctcctgcctcagcctcaggcaattttgtatttttagtagagacggggtgactccatgttggtcaggctggtctcaaactcccgacctcgggtgatctgcctgccttggcctcccaaactgctgggattacaggtgtgagccactgtgcctggccccttttttttttttttaagtagggtcttgctaagttgtccaggctggtcttgaactcctggtctcaaatgatcctcctgacttggcctcccaaaaggctgggattgcaggagatatgagccaccgcacccggcccttttataagttttctaaaggaaaggaacatgtaccatcgtgttttattttaatttttacatagaagcaggaacaatagcatgaacccccagacacggccccccaagatgcgctgttccgctgtgctgcagccccatttgtccttttctataccatttttggttgtatttgaagcaaatccctgacatcagggcatttcatcccaaaatacttccatctgtgtttctaaaaaaacgaggccattttcttatgtaaccacaacgtgatcaacagtaatcaatgcttaacatctaattctgggccacgttaagaccctcctgattggctcaagaatgtcttttgtgcagttggtttcttgattctttttgttttttttgagacagggtctcactgtgtcacccaggctggagtgcagtggtgcaatcacggctcactgcagcctcagcctcctgcctcagcgatcctcctgcctcagcctcccaagtagctgggaccacaggtttgcaccaccactcccagctaattaaaaaaagtaatttgtagagacgggggtggggtgggggtcttgctatgttgcccaggctggtctcaaactcctagactcaaacaatcctcctgccttggcctcccaaagtgttgcgatcacaggcatgagcccctgtccctggcccctattatttctctaactggggaaagtcatgtgggaacagatgtagcttgccttggcctctgaccggccctgcctgcgttcctgggtgctctctgctgcttctcatgtgtgccactgtggggactcggccgcccaccccaccccgtggtgttaccttgcgtgtgtagttctgtgagctcagggctatggtctgccagaactagggggcgtggggccccagtaccagcccaaggcctcctctctgcaggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagtgagtgcctcgctcccacctgtcaccgcccccaccaccttgcctgggctaccccgcctgaccctgtcccgccatcccccaggaatgccagctgctactttgacatcgagtggcgtgaccggcgcatcacactgagggcgtccaatggcaagtttgtgacctccaagaagaatgggcagctggccgcctcggtggagacagcaggtaacactaaagccccagttccctggagccgtcctggagtcctggagggtctggccatgccgtggtcacttggtagccccagccaaggcctgctctgtgctgggcatccccccggactggccccgcactgtcctaccctggggctgactgctgtgtgaccccagctcctggccctccctctctggtcaccccagcctccaccccactccctgccaggaggctcactgactcccctctttctgggacaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaaggcaggttctcctgtgggcagctgctgggcagggaacccctcggtcggggctggggtcagtgctgcggggagcgccctctgcatccacactggaccctggcttggctcagggccattccaggccctaaagggacaggtgtctgatggccaccaggggctctgggatgcaagcagcccctttccctcttgtctgtgtggttggggggacttaccttgcccacctgacagagaggtgtgtggaggggagagcagggaggggaaggagagcagggaaggggagggaggagagcaggggaggggagagccgggaaggagaggagagcaggggtggggaggttctggaaagggtgtgcaggggaggacgcgcctcggttatgggactggagccccttcccaggaggacccccaacaatccagaggtgcctgttaggattcagaacatggtttttttgtttgtttttttgagactcactccctcaccctggctggactgcagtggcgttatctcggctcactgcaacctctgcctcctgggttcaagtgattctcctgcctcagcctcccaagtagctgggattacaggtgtgcaccaccacgcctggctaatttttatatttttaaaatttattatttatttattttgagacccagtctggagtgcagtggcgttatctcggctctctgcaacctctgcctcctgggttcaagcgattctcctgcctcagcctcccgagtagctgggactatgtgtgggagccaccatgcctggctaatttttttgtatttttcatagagacgggtttcaccatgttgtccaggctggtcttgaattcgtggcctcaagtgatccgcccacctcagcctcccacagtgctgggtttataggtgtgagccaccacacccggctaattgttttgtatttttagtagagacggagcttcactatgttggcaaggctggctcgaactcctgacctcaagtgatccgcccacctcagcctcccaaagtgctgggattacaggcgtgagccactgcggccgagcagaacacgttctaggacccttgttcatgtgtccatcatggacaggaggacgtgcgggccatagggaccctggctcattccggagccgggactggagggtggggcgtcacccttgggaacacccgtgcccaccctccgctgcccagggtaggggtggggagccaggctttgggccccacttgataaagtcccctccccagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagccccaggccggcctgtgtgtgtcttggggctgaggtgggtgggggggctgaggtgggtgggagggctggcgggacaggtaggcgccctggctccccagctcagtgctgggagtgtgcagtgggagggaggccgtggctccagtgggtgctccggagctcgtgggcccagcacacctccttaagcgggggatggagcgctgggagggggtggactgtggcccatgcgacccccagagccattaggaggagttctgtggtgagaagtggctgtggctcctcgtaggctacgtccaccatgcgggggacctcgggggtgtctggcggtggcacgctggatgttgagaaggcgcagcccagggaacactcaaaccaggagaccccacattatcctctagttgacatgtgcccttcgactaggggacttggtggtaggggcagctccgcccccatactgcgaggatccgggccttccacttccccagacacagcaggttggggtgcccctggggctgggagatgctgccctgggcccctcagggggcggccgtggtaggatggaccgggccgagcgtgcagaccctgggcaggtccctacatcggaaccagcagccctggggatatctggcatatcagaggctgaggactgtttccagactttaccaaggccacagtcagggcgacctgggttctgagcctccctttgcatcctaggctgcagggacaggggctgggcagaggctcgcggacctcgtgcagcttcattcactcccaggtgcccctaaggatagcagctgcgagaagactgaggggaggagcagtaaggcgcagcctggagcggagggacctggcgtccagtcattgtgcgctgggaaggcggtgatggcgacggaatttgggacacgcggggcgtcccgggggcagccagggcactgcaggccggagccccctgttcccccgcatcctccccgccgtcggcagcagagcaagcgctgattggctgctgatgacgcaactgggagggctgcgctgtgataggtggtccctcgggggcgtggggcgcaagtcttgagattggcaggggcaggtggctgctgcagagggaagtcggggtcacctcagcgaggttccggcggccacccctctcccctcccccatgaaagccaggctggaagccagaaaaatcccagtgactggaagggacagattaatcctccggaaccaaactctttgagacctggggaggagggtgggaggcactgggaagggggattggggggagcctggctcatttccacccatggagctgacctagaatgaccctaaggtccccggagccaccagctgattccgaattccattcattctgcaaaatttggcgcctaccacgtggccgagattcccgaggctgcagccaatgagcagcatagtccgatgggggaggctggaagggccgttcacgagatctctcgggaggaatcggtaggagctgcccaactgaaagggacgggggaataacccggggcgagggacctgcccaggccctgccctctggggggaagccaggccaggggccgggggcatctctggggtcccaggtgagatgcgggtcgagggagccaggccacggttctccagactcgcgtggaggccacgagcgtcttctggaggagcgggcactgcgcggaccggcagactctggggcgctcgtgctccccatctcctgaccttttcctaccttcagttccctcctgtcaggacaggttctggggctcgccggggcagggagccagggcagagggtgcagtttccgctcctgcctgagtcaccttcgctttctcagcgattcttcattcacaagggcgtggcccatcacacgcactcacacacttgtgaacttgcacgcacacacacatatggacctgtgcaaagagccccatgcacaggcaggtacacgtgcatgtaggcgtgcacacagacacgcacagatgcaggcagaccaactcccaggaatctgtctccagcctacagggattcagcactcagggtaccagcctctgtcccgtgcacccccattcccggcagttctcccaggtgggtcgggggccactagggaccccataccccgagggtggctcctccattaagcctgccatggggttgggagtgagagtcccacctcccacttgagagtccccagtgagtcaaggcaagtgcagccagggctccaagatccttgttgggattcactgtgatccccaaagatcacgacttaagggaaaacattcaattaaacttgttagagcaaagaaaggagagactgggctgggagcagtggctaacgcctatatagttcagctactcaggaggcccaggtgtgaggattgcttgagtccaggaggctgaggctgcagtgagctatgatggcaccacccactgcactccagcctgggtgacaaagcaagaccctgtctcaaaaaaaaaaaaaaaaaaaaaaaaaaaggaaaaagaggccgggcacagtggctcacacctgtaatctactaaaaataagaaaattagccagacatggtggtgggtgcctgtaatctcagctacttgggaggctggggcaggagaatcgcttgaacccaggaggcggaggttgtgtgagccgagattacaccactgcactccagcctgggcgacagagtgagactctgtctccaaataataataataataataataaaataaaaagaaaaaagaaagaaagaaaggagagactgagctatattgcccagtccaggcatgtgggcagtctgggggacagtggggcatactcggtgtctcagggtcccagccctgggtgcccccactgctgtctgctgtgacctcctcaggaggcctcattgggagggaccctgagtcctgcggggggctgtggagctgtcaccagccccaggaggactcaggcaagtccctctggtggtcgaggcctctgagcttcccagtgtgtctccacgggacaccccccctccagaccttctgccccagctcagcctcttccaattcattatcagggggtgggggaggggacaggaagccccagacccagctgggccccatttcctccagggccacagtggcctctcccagagtcacgaggatgggggctgatctcactcttttttttttttgagacggactctcactctgtcgcttttttttttttttttttttttgagacggagtctcactctgtcgcccaggctggagcgcagtggcgtgatctcggctcactgcaatctccacctcccacgttcaagcgattctcctgcctcagcctcctgagtagctgggactacaggtacgtgccaccacacctaactaatttttgtattttttagtagagatggggcttcaccatattagcctcccaaagtgctgggattacaggcatgagccaccatgcccggccttgacttcactcttttaaaaaagtcaaatacttggtgcttgaaatcccagcactttgggaggctgaggcaggagaactgcttgagctcaggagtttgagaccagcctgggcaacatggtgagactcctgtctctgtaaaaactacgaaaattagtcaggcatggtggtgcgtgtctgtcgtcccagctgctcaggaggctgaggtgggaggatggtttgatcctggaaggttgagactgcagtgagctgtgattccaccactgcagtccagcctgggccgcagagcaagactctctctcaaaaataaataaaataaaataaaaagtctaaaacttttctttcaaacgacggcttttggggctcataaggtgcgtgaagatggaaagggggcccggcagtgcccatttcggctcccttgggaccccggcttccctgaagacccctgagcaatggttggctgggtgcctggtctccctgaacgggctgtgggcaacaaggttgtctggatgggggaggggctctgagacccttgggggcagcagagggagaagggaacagatggggtctcccaggcagagaggcctggaggggtggggcggggcagggcatttggcgtgaaacccaagccccttaacggggccctagcttaaaccgggaggaggggcctctgtgatgtgcaaataattaacacagaagccttcactgtgctcccctcctcatcccaggacccaggtctgaccctcaggaggggaggaggtgagcaaggggggaacccaccttccagggaacccccagatagtgccaggcaccaggcaagtgctctaaaaggctttactaatattatttgaagaaactaagctaataaataaatacggtataaaatcaaagggtacccacagatataaacaaaaatccacagctaacccggccccagccctctttcctttggaggtaactgtgttaatggttttttacacccctctggaattttttttttttttttttttttttttttttttttgggaaggagtctggctctgtcgcccatgcagcgcagtagcgtgatctcggctcactgcaacttccacatcccgggttaaaacgattctcctgcctcaaccgcctgagtagctgggactacaggggcgcaccaccatgcccggctaattttttttttttttttttttttttttgagctggagtcttgctctgtcgcccaggcgggagtgcagtggcgcaatctcggctcacttgcaagctctgcctcccgggttcacgccattctcctgcctcagcctcctgagtgggtgggactacaggctccagccaccacgcccggctaattttttgtatttattttttaatagagatggggtttcactgtgttcgccaggatggtctcgatctccctttttttttttttttttttagacggagtctcgctctgtcgcccaggctggagtgcagtggcatgatcgtgactcactgcaaactccacctcccgggttcacgccattctcccgcctcagcctcccgagtagctgggactacaggcgcccaccaccacacccggctatttttttgtatttttagtagagacaggggtttcaccatgttagccaggatggtctcgatctcctgaccttgtgatcctcctgcctcggcctcccgaagtgctgggattacaggcgtgagccaccgcgcccggcctcttgtttttttttttttttttttttatagacttctaaggaaagcaacactaagaaaatatatttttaagaaattattcagccaggcgtggtggctcacgcctgtaatcccaacactttgggaggctgaggcgggtggatcacttgaggccaggagtttgagaccagcctggctcacatggtgaaaccctgactctactaaaaatacaaaaaattagccgggcacagtggcatgctcctgcaatgccagctacttgggaggctgaggcaggagaatcccttgaactggggaggcagaggtttcagtgaaccaagatcgagccactgcactccagcgtgggtgacagactgaaactgtgtctcaaaaaaaaatttttgtttttggagatggggtcttgctctgtcacccaggctggagtacaatggggtgatctaggctcactgcaacctcaaactcctgggctcaggtgatcttcctgcctcagcccctggagtaactggcactacaggtgcatgtcagaacacctggctagtttttaacttttttgtgtgtagacagggtcttgatatgttgcccaggctggtctccatcaccttctgggctcagtgatcctcctgcttcagcctcccaaaatgctgggattacaggtgtgagccaccatgcccgaccctgagggataccttaatgtttatttctcacatttcttctagaacaaacattgccagcgcatcccagactctgaactgtggctggggactgcagcatggaggtctttgcaggcactctgggaaacatgccacaagcagggtattaacccaagacagtcagtccctccaatgagaaaaaggagccgagggactgtgcatgcctcagagccagatgcagcagaactggtgggttgagggggcactgagcgcctggtgcctcctgctgccccccaccagctccgacagtcctcgtccttgtcctccccatcagaagggaagagtgaattgtctgtgggatgtgccagtgtccccggttctgaggttgggcaggctggggagccccagacatggcttgctgcccactgtggagcctcctggacttagttccaggctctgcccgatcctctgagggtgtggcttcaaagccctgcttgggcctaaggccatcccagggcagtgactgagggtagactgagatgtcccttgggcaccagtcctagggtacctgggctgggggtcttcagctcaggccccctagtgcccgtcctttgggctgtgggcaggtttccacagcactggccctttctgaccttacacccctgtgcatcctcactggggctctgtgaaggtgaaagtcacactaaggactgtgcctatggtggccagggcaccccaccggcagcacacctcagaggcctcatcctaggcgctgctcacttttttttcttttttttcctttttttttttttttttttttccgagacagagtcttgctctgtcacctaggctggagtgcagtggcatgatctcggctcactgcgacctcctcctcctcctgggtttaagcaattctcttgcctcagcctcctgagtagctggcattacaggtgcccgccaccacgcccggctatttttgtagttttagtagagacggggtttcaccatgttggccaggctggtctcaaactcctgaccttgtgctctgcccgccttggcctcccaaactgctgggattacaggcgtgagccactgtgcgtggccctgctcattttcttaccacagctttccagaaataaagttaggatggaaagagagagagagagattgagagagagagagagcaccacattcagatagagacaggagagttctcagcaagaagagaactcagctcagagttgagaatgtctcaactcagctgtctccctgctgagacgtcctgggctgaagtgtcccctcacccctgcggggctgtgactgcacactgcacacatgggtcacagcagggcttggcgtttggagcaggccgggttggtggcttgtcctcatctcttgcctggagctgtgctggcctgtggtttgctttggctgctaccatgtggagggagaggtgcttgtgtccatgcctggcctcttggaaggccaccactgtgatggagagaggaaggccaccactgtgatggagagaagccggggccagaccgatgagggctgagagcccatgggcaggggttgtggtctcggccaaaccccagctggcagctgatggcagccaccccggggtcctcagatatggcacagctgcctggctgagcctcggcaaagggaagccttgtggaaaatagcaactcagggatgttgtgagtagtgggctgagctgtggtttattttttagagacagggtcttgctctgtcacccaggctagagtccagtggtgtaatcatagctcactgcagccttgaccccccaggctcaagtgatccttgtgtcttggcctcctgagtagctaggactataggtgcataccaccatgcctcgcttgttttttgttttgatagagatgggggtcttgctaggttgcccaggctggtctgtaactcctgggctcaagtgatcctcctgctttggcctcccaaagtgctgggattacaggcgtgagccactgtgctggccttggggtgtggttttatgtggccatagatgactgagatgggtgagaagcgggacctaggggaatatacagggcagggggatccgacagggggacaggagggcagacagctcctggaaggcctgggaaagagatatcagggctggaccctggagaagtgaggctttgagggaggggaggagatggggcctggcggggtacgggcgctgctcctaggtctgagggcatcggcggtctgagagcttgcgggagggagggctgcctcccggtgctcggtgccctggctctcctccttgctgctggctggcctcctcctcctcatgcatctgtgtgtcctggaacacagggcactgtccctctgcctgtccagaaaagcacgtgctccttggggcctggcctgctcagccctatgtcccacccgctccctgctgctattcccaggccttcgggcctcactgcctggggtggccgtgctcagccccaccctgtggtgccatggcctccccacccctgccccgaactgcccctgggaccagttccttcagctcccaggacagggcctggccatccctgtggattctccctgttcgtggacccccattggtgcccagtctccttggactgtcttctgagcctctctcagatgtacccccaactgtaccctttcacccagaggccatttggcagcgtcctccaggactcctgccgtgggggaagtctccaccaaggccaacgcgtgactgcatcccgaggagctgatttaagatctggttctcaggaacacctggaactggccagtcagcatccccggccctgcggtctgcacttggacaagggtcaggcaatgaggatgagcagcaggcggggcttctcctggaagccttcccagcctcctgggccactccagtgggtcccctccacagactcagcctgttccctgccacctggtgccggtttctctgtggcacctactaggggccgagtgccccgggactgcccagctgagcagcgccgtccaggtctgcacccagctacactcagggcacgtgcacaggtgagcagccgggcacgcaggcacctgccaggtgtgggtgtggactaggtgctcccgg

SEQ ID NO: 957 - DNA, 2767 bp, Homo sapiens
gcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagtgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggagggctaggactgacccttgtggtgtttttttgggtggtggctggaaacagcccctctcccacgtgggagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgc

SEQ ID NO: 958 - DNA, 1482 bp, Homo sapiens
atgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagtgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactag

SEQ ID NO: 959 - DNA, 32069 bp, Mus musculus
  misc_feature (6372)..(6556): "n" at positions 6372 to 6556 can be any base
  misc_feature (8664)..(8683): "n" at positions 8664 thru 8683 can be any base
  misc_feature (27710)..(28786): "n" at positions 27710 thru 28786 can be any base
gggctggaccttcacagagaggcagagctacacaaggcaataccaattctctggggcctgagggaggaaatgccccaaaccctgctggctccagttgaggtggtgtgcctctgggagacaatggggagaagtcttgcttcaagttatttcccccacagcctgatccatctatgctggcacccccctctagtagaccctacaagatgggtctactatgagccctactgttctagctgctcctatttaaagggctgcctgcctgagggtacagggtcaccccagctgcccatgtagggtcctacaaatgctcaccacatcaaccactcattctctcctcatctcaagaagcagggtgagagagtttggtaatctggccttttcatgtaaatttatgtaaataggatataaatatcacaacatatgtaaataggatataaataccacagaacctcagcatctcaggaggtcctgatatctagaatctaggaggtagaaggaatggcagaaaagtctggaggagatatgttcgccctgtgcccgttggccctgtgtttccatgtagaacccagggagctggagctggagctggaagccagcaaagtggtccccctgcccagttattcaggtgtcccaagaagtcctagagagaagagatctgtaggttctcaaggtaagggatgtcagggacctggcagagagggctctcgaggtagcctgtagaggctggatgtggctgcttgggtaagaatggctctcataggctcatatatttaaatgcttagttattaaggagtggtactatttaagaaggattaagaggtgtggccttgttagaggaggtgtgtcactgggggtgggctctgaagtttcaaaaacccaactctgtcttccctctgcatgcctttgtgtgtatctttctgtcttaggatcaggatgtagccggaaactacttctccagcagcatccctgcctctgtgacctcgtgctccccactatggtgattgtggactaaacctctgaaactgtaaacaatcccccagttaaatgattctctacaggagttgctgccttcgtgcccagcactcaggaggcagaggcaggtggatctctgtggggtcaaggccagcctggtctacagagtgagttctgggacagccagggatatacagaaaagcctgtctcaacaaacaaacaaacaaataggaaaggtagtcatggtcattgtgtcccctcccagcaatagaacactgactaagacactggggtgcaggtgctgagtgtggacaatgacgacgtgggaaccacctctgcaccaggctccaagtgggagagtgccaggatcctggggtgtaccaggtagattgcattgttcatgttttactgcagaggactgtgaggctcagaaaggaacaattgcttgtccccaatacagagccagaaaaggatgctaataggtgagaacaccaaattctgtttcctcctcttcctcttcttccttctcctcctcctcttcctcttcttccttcttctcctcctcttccttttgtcttgagcactgggcaggacacaggacatctgcctctggaattccagggctaccttggctccctaggcaagatggatcccaagggagagtctaccctctgactttactttttgcacagactagggctgggccctctcagctacttagggctgtaagtgccctcggaggagccagcattggaaggagtagtaagaatttggaggagcgggggctggagaggtggcccagtggttaagagcactggctgcttttccagaggtcctgagttcaattcccagcaaccacatggtggctcacagccatctgtattgagatctgacgccctcttctggtgtgtctgaagacagctagagtgtgctcatatacataaaataaataaatcttaaaaataataatttggagaagggctggctctgccccatgctggctcatggggcctcccttagggtactcagacctcagagtcagttgacacctggtcctttatctctgggcaggacatcagccacctgctctgccactaagaggctaaggaggcgtccacgggagtgaggaacttggaatcaggccagacgggggtggtggaagtttccaggcatgtaagcctctcctcgtagctctatagtgcgcacctcttccccaggtcccaggatctgagaggactgctcggtcccttacttgttccagaatctgggtggaggcttttgggaaacaacttgggggcctttctcaatccaccacccccccccctttcccaggtctcaagaacttttccagtctttcccattttttggacactccagggggtaagaaaaaaaagaggcaacaggcaaagcccggtggtgacttctctctaactccctagggggagccagagtccactgaagccaggcatacctgacaggacagctcctacagggccagaagtctgagaaggcttcatggaggaggtgttatttggaggaaagtaaaggctctgtgaacattctctaggtctgtgagtgcagagtactttgcgggtagaaataaaggcgagcaggaggaggtgggagagaggaaaggctaaggaaagtaagctgggggtcgtgggagagccaaacatgaacccagaatctttgcaaaggccacttcatagaggacattgcattactgacatggagggcaaaggggagccatggaagaattttaggcagaaaagggtctgggtcagacttagttttagaaagataagtcaagaggctggagagatggctcagcggttaagagcactggctactcttccagaggtcctgagttcaattcccagcaaccccacatggggcgactcacaaccatctgtaatgtgatccagtgccctcttctggtgtgtctgaagacagctacagtgtactcatatacataaaaaaataagagaaagataagtgaggcgtggaagtgcttgcctgtaaccctaacacttgggaggccgggggcagaggtattgaaattaggggcctggagtgggcccagggaggccctgtctcaataacaagcgacatggggttggagagtgactttatggttaaaagcaagcattgactgcggagcgcccccactggatagctcataactgcccctacctccagctgcagcagatctgacgtgcttgtctagagtcctcgagcatctgcgcactgatgcacacacattctctctgttagacacatgacacctatactcacacgtgcatacacacacacacacactctactctctccctctctcacctatttttaatctaaaaacataacaaaacaataacaggctgcaccctagaagagacactggatggggcaaggcagaaggtggagacagaggttaggaatggacaaggcagaagaccagaagaccgtgggaagtgacatccacagtattggacatatgtcatctgaaagatactggaagagcagcaagcaccacccccaccccaccccacccccctaagatttccctgcatagcgatggaacttgctctgtagaccaggctggcctccaactcccagagatcccatctcccgagtgctgggattggggagcttgccacaccactgggctgtcctaagagcagagctccagagctggaggacgacttggcttgggagagggagaaaaggccacgggaaaaggctaggaatccagctgaggcctctgggggcaacatctatgctctaaatatcttggtggttcttcttcttcttcttcttcttcttcttcttcttcttcttcttcttcttcttcttcttcttcttcttcttcttcttcttcttttccttcttttccttcttttccttcttttccttcttttccttcttctccttcttttccttcttctccttcttctccttcttctccttcttctccttctcctccttctcctccttctcctccttctccttcttctccttcttcttctccttcttctccttcttctccctcttctccttcttctccttctccttcttctctcctcctcctcctcctccttctgtaagtatatatatatatatatatatatatatataccatagctgtacagatgtttgtgagccttcgtgtggttgatgggagttggacctctgcttgctccagtcaaccctactcactcaggtcatcagctcatctctgctcacccagtccctgcttgctccagtccaaagatttatttattataatacataagtacactgtagctgtcttcagacgccagaagagggcatcagatctcactacgggtggttgtaagccaccatgtggttgctgggatttgaacttgaactcaggaccttcagaagagcagtcagtgctcttacccactgagccatttcgccagtccctaatacctgggttcttaacctgcaaattaaatgggtaactggcgacagtatatatatatatatattcattccaatcttccctggagcttacgagatttttgtcatgagttgagtgtcaacaaaagttaatgaagaaactggatttatcattcattattcataggctaaactcactcagaggagtcacatttgagccgtaagccccctccccacaatgcaaagagaagggaagggtccagccagccctcacacccatccagcccctcgctgcacttccctggcttcccctgccccaggccagtttggattggcagcaggtgcaggggtggatttcttccactcctgactgctacagagcagtggggagacaggagtctgcgttctggcatgggaatgaaaatttacaggagcttcctcggtagggtgaattccaagtgagagggctgggccagcccaaacccctaccatctcagtctcctcttcctcccaggtatctgggaaggtcctgtagagtctgaagacttcagcagtagctgcatctttgtttattatgctaccttctgcctcctcagggaggaggagcgctggaagagtacatgctgggtaaattctcagagggcgctgcaggtgagtggcctacagggggtcctggtgtaactttaattttttatttttttaaatcttatttttaatgatttcttttaatgttttaacccgtttttttgtaacccaccagaggtagtggaaaagaaagaaaacgggagaaatggacctatttagaaaggttttttggaacaacagatgtctgtgttatctggaaatcagcagttcagttcacaggttagcaggcatcgatggcttgatccactagcaaacacctcacagacacaccagcaggccagttcagtacagtcgggttagcaacggtggtgacacgacctagtagagacagccaggcctcagcctcagcttcagtcagcaagaacgacactgggagaagttctcaactgtgcctctctcaaggaaagccacgatcagcaaagactcaagacccacaagcggtgtgtagctagctctatacgcaaatctagctctgtctccatcactccgtggcgtcctatttataccctccaaacatcacgtgtcctccatatgccttgtcttgcctcagcacaggcatccaatcagccccagtccttagaagcaacaaacaaactgcagcacaccacaagagttttggtgtgtttctctttatggagttccgacaaaggcagttcaactacacagtataaggcagaccaatacatgcacgttgttagcaaaaaaatccttcatcacgtgacttttcacattcttgctttagcagaacatcctctctcctgtgtctgcttcagcgaaacgttccttcctgagtctgccttagttagcctttcacacctgtgtccactttaacaaactgttccttcacgtgtttgccgagcaaaacaccatccgaccgacctttcaaagaacccttaagtttccacttcacccggggattggggggggggcagtggcagaggaacaggaaggctggctattctctatattggcccaacattcatgaatgagctcagctaacttcttctcttctgtgggcctcagtttcctcatctgagaaatggcagtcttgagacagggtggggcccgaggaaaaggactcggttctggggaggaacagcttcagagtgcagagttactgtgtatttactgtgggtctctgggcacagcatcagttttgccttacacaaaattgatgggggtggtgcacgcagtgtaggagtggggggcacacagtgcaggggctgggggcacacagtgcaggggtgggggaatgcagtgcaggggtgggggaatgcagtgcagtgctggggggcatgcagtgcagtgctggggggcatgcagtgcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggggggcacgcagtgcaggggtggggggaatgcagtgctgggggcatgcagtgcaggggtggggctgttatctgctgctttggtgtgtgtgcaccagtgtggtctgctccaggagaggaaccggcagacttctttcagagaagcagtgttaggagataactgaaaggggaagtggttatggcggggtgcctctaaggagccccctttcctgcccaggcccaagaggttcctctcagctctccctggcaatgttgctcaggctgcttgctgggactgagagtagacaaagggactggagagaagctgggaactctggaggggataagacttgggtcaaggggggagggtataggggtctttcgggatagcatttgaaatgtaaatgaagaaaatatctaataaaaaaaaaagacttgctgggcgtggtggcgcacacctttaatcccagcactcgggaggcagaggcaggcggatttctgagttcgaggccagcctggtcttcaaagtgagttccaggacagccagggatatacagagaaacccctgtcttgaaaaaacaaaacaaaacaaaacaaaacaaaagacttgggtcaaactgatggcttggaacaaaaaagtcccacttccactgtgactagctgaatgaccatagacaaacaaaccaacaaaaattggctccttggtgctgttggctctcatggggcctgataacattcacctcattactgattggaggctgccttggggtaatatctgtaagggcttcaggcatcctgtagggtgccaaggtgtcttccactccttgctgcaggggactctcatcttccacagtgggaagacttttttttttaagattaatttattattacatgtaactacactgtagctgtcttcagacacatcagaagagggtgtcagatctcattatgggtggttgtgagtcaccatgtggttgctgggatttgaactcaggaccttcaggagagcagtcagtgcccttaactgctgatccacctctccagcccagtggaaagacttctaccactgatggtgcagagccttattcaagatgggacaactgtgcagtaactgtccctggtgctgggttgtacagatcctgcaactgaaccaatctcaaggggcattatgctgcatctgaggccactgcccacatgtatggcattgactggacctcagaaaaaggcgtgggtcacccctactgtgggattacacataatgctttgctagagcactcaattgtcagtatcgttgtcacttcttacagcttccatctcttggccacctcactgccaactgcctctgcttccagggccactttgtaacactttacaaatcttttcttactcaggagaaaacctatagaaaacggggcagggacacaagcttcagttccattcaaggaagaacttctaatcaggaagatgaagggttgaacttctcagggcttcagaccctagaaggatacaagaaatgctagggggcagtgaggtgagagattcaaccacccactcgcaatcctcctgggcccccgagcccaaagtggatgcatctgaggacagctttctctcaccctttgtttgctgtttggttggttggttgattttgtgagacagggtttcactcagcaggcagccctggctgtcctagaaactctgtagaccaggttggccttgaactcagagattcacatgcctctgcctcctgagtgctgggcttaaagacatgtgccatcaccacttggttcccatttgtttcttgtaaagtgtgttttctttttttctttttttttcattttttattaggtatttagctcatttacatttccaatgctataccaaaagtccctgatagtgatgatcagaacattgtctccctgattgaagaggacactgggattgggctctgctataaaccagacccccccatcccgagacccccaaatctcctgatattacatcctgagcctctatgagtgtaaaggagctcgtgtctgatcttccacagacgtgactttttcgcctttaagggacctctttaataggtcccccaccctctgccaaagtgtgctctctcccaccattannnnnnnnnnnnnnnnnnnntccccctttttggccctggcgttcccctgtactggggcatataaggtttgcgtgtccaatgggcctctctttccagtgatggccgactaggccatcttttgatacatatgcagctagagtcaagagctccggggtactggttagttcataaggttgttccacctatagggttgcagatccctttagctccttggattctttctctacctcctccattgggagctaaagtgtgttttctacccaaacctctgtaatgggccacattctccctttctgttgctcgtctatcccattggttcaaacctaggaagatatatttttttccttccatgagacaagaaggctgtgaaacagaggcttcctaccgtttgttgaaaggtcaatttgtccaaagccccaacatattattttataaagttttagttttatttcatgtgcatcttttgcctgtaattatatatgtgcaccaagtatgtgctgggcgcctatgcaggtcaggagagtgccaggaatcccctgggcctacagttacagatgatggtgagccaccatgtgggtgctgggaaccaaaccagggccctctgaaagagcagcaagtggtctttacagctgtgctgtctctcatgcccaagccctaccataataaacaattatgaaacatggccctaacctcagagtctcaaagtctcatttctaagttcagggccctctaaggtttatagcaacttagattcatactaggatgttaaagcttcttggtgaatttgaagccgggataaccttgtaacccaaaaagcggagacttctggagttccttcaaagggtagataggaagtttaccgtagaagtgcttttcagctccatggtcaagtttcgggtggaccaataaggtccacaaggtttcactacaagagaggctctgaggaaagcgcttgtcaacattctgacccctaccagcaggaacattacatgtgccgcctacacaatgttttgctcccccgtcctttccccgcccagtgtccattcatttaccaggtcccagcagggcggggctgtcctgttttctatccctgggctgggcacacgtcttacgagcgcctgcagtaagcagtcaacagtgtttggcccgaataggggcacaggctgttccggaagtggacagtgtcagaggttctagccggagaggagggagggagagccgctggggagcctcattgccccagggccgagggtggagcctttcccagtcgggaaagggctgggcccagcctacatgtgagggcaggacagagtgactgccagcgctcccttgagaagtctgggtgtagcacgctggcggttgacttcccaggactcttctgtgacctgtgagccgaggattactgggtaccccagattcccagaacccagtcctggattgcagatctgtaaggaccgcgaaagattgagcaaagaagtctttctggacttaagagttccggaacaggacgtccagcccatctccggatcccgactggatccacaccttcagcctcgtgccctgtcccgggttccccgcgcccggggccccgcgcttgagcgcccccgcatggcggggccatgtcctagggccggggttctagaacgggcgggcagctgctggcaggacccgctggcggaggcgctgagccggggccgctcgtctcctgcggtcacgggtcggggctgcgcgcggagccggcctctcagtgtggtctacgtgctgacccgggagccggggcccggggtggagcccgggtcgggaaccgaggcagagccgctgccgttgcgatgcctgcgcgaagcctgcgctcagctccagggcacacggccacccccgcagctgcgcagcctaccctttgcgacgctggcgctaggcgacaccgctgcgctggactccttctacaacgcgggtgagcgacttggggcggggcttgagtctaggcggagcaaggggtggagctttagaaccctgacggggcgggtgtgggtaccaggtctagggaatttacggtaaactaaagccgaacttgagacaaggcagtaacgacagggcatttagtggattatggatgtgatgggcttgaggctggatctggggattcaggcctggctccggagtttaagtatctttcggtgagcgtggtgccaagcaggtggggcggagcaggcgaactctaagggcggggctggggagggacggggctgagggaggggcagagctgcgcttccctgcgtaagcgggagaactctttttcaggatgatctctcgttggacttttgagggtgaatcaggcctgagacggaagttcggtctatggcaaggggccatctctgcaggattggggttgataagtcctagcatactacatcccacatgggactaaaggggcgggaaaggaagtactgaggcaactcttcgggactggattataggagaaagggattgtatttggagactaggagtcgaaagaaaatgggtggggcaggggtgggtctagaggagacacagggagtccaagggtgaggttggaagatagctattcctctctttcccacctaccggatgctccacctcatccctatttgtttatctccgagtcagagagccttgtatcctggacatctgctaaattgtagcttaaaaatgaaggctgacccggtcagaccacagataaagtggaatcatctgcgttgactcatacagtccctcccttgcggacattgtcacttaaagatggctggatacagtaagctacacaaacacacataaaagcacgacgttgtcttcacacacgatgatgcagatcaccctcaggaccctggcttcaagattggagagatggttctgaggttaagagcacttgctgctcgcccagaggacccgaggttcccagcatgcacacggggtgtgcatgctcacaaccacctgtaactttatctccagaggatcctgatgccgctttctatcatacactcacaccaacacacacatacatataaataaaacaagagagagaggagagagagagacagagaaagagacagagaatgggacttctttttgcaaagttcctgtctcctacataacctggaagtgctcagtgggatgaaggtccctgggcatctcctgtaacaccaccaataagagtactgtgaaaaccccgggaagctctcgagagcagcaccgactttggcatgaggtgcaggcaaggcacttgacgtgacatgcatctccaggctccttcgccactgagctgggcttccacactcaggcctacacttctgtgtccacagatgtagtggtgctggaggtgagcagctccctggcacagccttccttgttctaccacctcggtgtgcgtgagagcttcagcatgaccaacaacgtgctcctctgttcccaggcagagctccctgatctgcaggcccttcgtgtaagtggccagggggctgggggctgggaagacaggtgcagggttggggtgaggccaccccagaatgccagtatctgattgtctgcctcctgcaggaggatgttttccagaagaactcggtgagcagaatctacccctcatgccaacgttataacctctgacccctactaaccttcctagcttcctcctttgtctctgacatcagtgtgaccctcagcaccatgtagcatccttttgtgacgtgcggctcttttcttctattcctatcttcaccagtactaaccgccagtccgtctctaaccctgtgctgacctatgtgtgacctccactaattgctgccttcttcccaccaggattgtgttggcagctacacactgattccttatgtggtgacagccactggccgggtcttatgtggcgatgcaggcctcctgaggggcatagccgatgggctagtacaggctggggcgggcactgaagccctcctcactcccctggtgggccggcttgtccgtctgttggaggctacacccacagactcttggtaatggggctcagggggaggcggtactaggtagagactgatgaaggtaaagtgtgctggggctgaggggcaggctcatctctctctctctctctctctctctctctctctctctctctctctctctctctctctggtctctgggcatcagcggctatttccgggagaccattcgtcaggatatccggcaggctcgggagcgattcagtgggcagcagctgaggcaggagctggctcgcctgcagcggaggctggacagcgtggagctgctgagccctgacattgtcatgaatctgctgctgtcgtaccgcgatgtccaggtgtgtggcgttcggagaggccatgacataggatataactccagcactcaagtgcttgtgtcaggaggggcaggagtctgaggtcatcctgtttacaagcaagtctaaggccaacctgggcttcaaggaatcttgtgtgtaaacctaagaaagagaccattgtatgacagacagatacaagtgcagctcctggctgagcctcactagtggctttaagtaaattgtctgagcctcaattttcttatttgtttcatcatcattattattttttaaacatggtctcactgtgcattcctggctggcctggaactcaatatgtagaccaggctggcctacatatccacctgtttctgccttctaagccttgtgccaccacacctggctttattgttttttttttttaaagatgcattttatttttttaattgtgtgtatatatgtgtgtctgagttagggtttgtaccttgtgtgtgcagttacctgtggaagacaggagagagtgttggatcctttgggactggagttaaaagaggttgtgaacttcctgttgtgagttctggaccccaaactgcagtcttctggaagagcagcctgcactcttaactgctgctagttatctcttcagcccatatttccttcttttttgagggatgatgtggtcattgcctcacagggcattggtgaggttagaaacacccaatgtggggtgcatagtgggttctccaggaaggtgtggtctgtaaatctgcttggcccgagggaggtgtgcaaagtcttcaggttgtgggtagtagaaatttccttcaaactgacagtagttacccctgtcttaaatcccagcactcagtaagcagaggcaggcagatatctgagagttcaagggtagcctggtctacagggtgaattccaggacacccagggctatgtagaaaaacctcatctcaaaaaaacaagcagaaaaaatgatttctgctggcagtgatggtgcgggtctttagtcccagcactcgggaggcagtagcaggtggatctgtgagcttgaggccagcctggtctacagagagagttccagggcagccagggctaccgatctttcctcgctgtcaagggctcatcgagatgctgcacgctgtctcccacaggactactcggccatcattgagctggtggagacgctgcaggctttgcccacctgtgatgtggctgaacagcacaatgtctgctttcactacacatttgccctcaacaggtgggtaatggggcacggcttgagtcagagtcttggaagtctctgtgacctgccaagcaagagcactgcaatctggaaccactgctcctcgggtatcttgctaacctgggtcctaatgtcacaaggttcctgttggtctgggctaaggatgcatggtggggacagaggacgtgggatccccttgatagggtcatagctgtccaaggtcgctactccttagagttgtttgcaactagaaatcccttccatctggagtcactaactctagagatcaatgcttcccggggttagtgtcatttgaggctcattaatagtaagcccccagaagggtcccttccgtttatggtctattgggtcccaggactgggtgggtcagagccatcagacaggtcttcagtgtatgttcctccgccttaggaggaacaggcctggggaccgggagaaagccctggctgtcctgctgccattggtgaagtatgaaggtcccgtggctccggatctgtactgcatgtgtggtcgtatctacaaggacatgttcttcacttctggcttccaaaatgccgggcacctggagcaggcctatcactggtaattcacataagagtaaagagagggcttagcgatgggactgaagggtggggttgcgggcatccattcagcctggcatcccctgcccgacccgactccaggtaccgcaaggcgtttgatgtggagcccagcctgcactcaggcatcaatgcagctgttctcctcattgcagccgggcagcatttcgaagactctgaggagctccggctgattggtgaggcctgctgttagcccacagcaccctgcacaggctccaaagggcaaggaaagggccccaggcgggaaaaagcgctgactcaaagtgggcttcgagactgatcggtgcctgaggtctgaggtctcaggagcctttgagtgcctctcttcccaagcccacacttccggttgtcacactttatcccacatctatttgtgccctagctctcccctgtgctaggctcttagcgctgagatcttgccacacctaccagatctacattcatatccacactcctgtgcgtgagggccacagtgggacccacacttgagccttactcactccgggacctacactggattgagcccacgccaccctcccccaggcatgaagctggcctgcctgctagcccgcaaaggctgtgtggagaagatgcagtactactgggatgtgggattctacctgggagcccagattcttgccaacgaccccatccaggtggtgctggctgcagagcaactgtacaagcttaatgcccccatttggtaggtggccccttcttcagccctgcacccatgcccgttggcacccctccccaagccatgaccccaatactttgatgtcactacgatagatagacagtgcccgtgttcccctctgttcgtggtatgtgatgcccgtatcctgactacatgcagctgagtggcaccagccggctcctaggctgagctgaggccaaggctgtctgtgcatttaggtacttggtctccgtgatggagaccttcctactgtaccagcatttcagacccacaccagagccctcaggaggacccccgcttcgagctcacttctggctccactttctgctacaatcctgccagcctttcaagatggctcctcctcaggaggaccagtgcctggtaagggcagtggggcctagggacccaggggcccagggacaagcacattatgaccgatccctttccccgctactgcttacaggtactggtgctggagataaacaaggtcctgctgcctgccaggcttgagattcagggaacagaccccatgagcgcagtgaccctaagcttgctggagccagagactcaggtgagctctgagacccattactcaccgatccacctttctttctcctatcctctctagtcccagcgcctccacaacctccacccctttcttctcacaggaggatccttccagctggaccttcccagtcacctccatctgtgggatcaggtgagagctgaaccttccggcaagctcctgtgccaccaagcctggcattcagtagcctctcttcttccctagcacctccaagctggaccagcgctgctgcttccctgtacgtacttcctccggcccaggacgtccagctgtgctttcccagtgtggagcgctgccagcggtgcgctcaacctttctgagttggggatgggacgcccaggggacggaacggaccaggtgctcctgggggatggttcctggctgttccccttccagctgtttccccctcttcaggttctgtggcctaattcaggtcttggtgatgaatccggattcctccgcgcccactgaggaggcagaaggcgcaagggaagtgctggaggtgaggctgcagaaatgggggggttggaggagagcgaggggtgaagggtccctgctaagcgggtgctctgggttccacagtttgattatgaatactcggagaccggtgagcggctggtgctgggcagaggcacatatggggtggtgtatgctggccgagacaggcacacgagggtacgaatcgccatcaaggagatcccagagagagatagcaggtggggtgcattggtcgatgaaggtctggggtctcgggagggtatatgcaaacagggtgtgtgtgtgtgtgtgtgtgtgtgtctgtctgtctgttgaggaaacgtgagaactgactgattgtgggcatggaaagagctctttagtggctggactaggggtggtggcccttacagtagataagagaggtctgtgggcggggtgttggatctgggggcatggtttcatggtacaggaccatgggaggttatctctgctcacatctgcccattgctctctcctcgacactcccagattctctcagcctctgcatgaagagatcgctcttcacaaacgacttcgtcataagaatattgtgcgttatctgggctcagccagccagggcggctacctcaagatcttcatggaggaagtgcctggaggtaccagccctgcgtgggaggggagtgaaacctgaggtgtggggcgtgggaatggagccagaccagggtggcaacccctgaggggaaatgaactctagcgtgcgtgggtatcacctagaattagctgacagggctcactgggtgatggaagtctgggtcatgggaatgggtgtgtttgggctttgatcagagggatgtaggtagagtaagcggacatcaattataaacttggtttgtctctgcccaggcagcctgtcctccttgcttaggtcagtgtggggacccctaaaggacaatgagagcactattagcttctatacacgtcagatcctacaaggactcagctacctccatgagaaccgcatcgttcacagagacatcaaggtcagccctgtggctgctccgggtgtgtggagacacagtaccaaactgaagctgacagtaatggtgggagagagcacactttggcagagggtgggggacctattaaagaggtcccttaaaggcgaaaaagtcacgtctgtggaagatcagacacgagctcctttacactcatagaggctcaggatgtaatatcaggagatttgggggtctcgggatgggggggtctggtttatagcagagcccaatcccagtgtcctcttcaatcagggagacaatgttttgatcaacaccttcagtgggctgctcaagatttctgactttggcacctctaagcggctggcaggcatcacaccgtgcacggagactttcacaggtaatggggggtgggggtggggtgagggtgtcaagctcttggagacttctggggaatggagttttttttcttggcacagagttacaattttaaagatttatttatttattttatgtatatgagtacactgtagctgtatagatggttgtgagccttcatgtggttgttgggaattgaatttaggacctctgctctctctagtcggcccagcttgctcagtccctgactgctctggcccaaagatttatttattattataaataagtacattgtagctgtcttcagacacaccagaagagggtgtcagatctcattaagggtggttgtgagccaccatgtggttgctgggaattggactcgggaccttcggaagagcagtcagtgctcttacccgatgagccatctcaccagcccttgaattacagttttaatggtgaatggaaggaatctggctggagacaggtgactggatccaggaaccgctggtaaaatctatactccaaggttgggtaactaatgagaaagacctcagcatcgaaaacggatgcaaggccgcgtgtgttgggggtgtgagacgggttggtagaatttgaagggaggacgatgtagcgtcacgtacaagccagaaccctcctgatggttgaacgctatgcagcctagaatgaaggacggaagcttggcaggtgacggggcctaggtgtgcacatggccagtggatgatggggacttgatgcctacctggcattgttgttcctatttgtggtctagggactctgcagtatatggccccggaaatcatcgaccagggcccgcgaggatatgggaaggcagctgacatctggtctctgggctgcactgtaatcgagatggcaacaggtcgaccgcccttccatgaactagggagccctcaggctgcgatgtttcaggcgagtctctctggggtgtggcctacggagggtgggcggagccagatggggccagtggggttatctatcccatctgccccacctccgcaggtgggcatgtacaaggtacatccacccgtgcccggttccctgtcagctgaggcccaagccttcctcctccgaacttttgagccagatccccgcctccgagccagtgcccaagagctgctgggagaccccttccttcagccagggaagaggagccgcagcccgggctctcctcggcatactccccggccctcaggtgctatgggggtggagggggacaacctagtgaaggggagaggggctgatgaggcgaaaagactaacagcttgttcctccctcaggcgccccttccggtccttccagtccttcagctgactcagccacacagtctcagacattcccaaggccccaggcaccctctcagcacccacccagccccccaaagcgctgccttagttatggggacaccagtcagctccggtgagcgcctagggtcctggagtgggttctcttcatctttttttgccgttgtattaatttcctccagaaaaaaaaagcctccctgggtcgcaaacaccctgaccacttccaaggaccgtatctactacctcctgccctctcccagatgccggtggcattcactctgccaacccccagatgggcttaatttctattatccccgtgaagtaggcataaaagagccaagattcaaaccctgcaacataggtggttggttgcatggtgttgcccaccctccatctaatgcccctcattgtgcccagtgtgcccgaggagcccgctgccgaggaacccgcgtccccagaagagagttcaggcctgagtctgctgcaccaggagagcaagcgccgggccatgctggctgcggtgctggaacaggaggtgcccacactagcagagaatctcctggaacaggaacaggtgggcggcccgccccagcgccccctggtggtcgagctgggataagaatttatagtgcaccggcgagcatctctgttgactgcggatgcgaacatccacggacgtcccctctttttaggactctcgactcagcaagattcatgtggaacttctgcttcggtgccttggggcacaaatccacactcctaaccgccggcagctggcccaggagctgcggaccctgcaagctcagctgcgggcccagagcctgggccctgcgcttttgaaggggccgctcttcgcctttccagacgcggtgaggaagctatctcgaagttagggctatgcaataacaggtcgcgagcaagatcttgatgttccaggattctatgatttccaggaagacgcatgtccagtcctggcttccctgtcccacccttgaccccaagtccgcccacctcttttagactgcagccgactttctagggctttgcaactcaagccccacctctgtttgagattcaactgtctcaaccgcgccttccttccctccccaggtgaagcagatcctccgcagacgccagatccgcccacactggatgttcgtgttggactcgctgctcagccgtgcagtccgggcggcgctggcggtgctggacgcgggtaggtggggttggatcccgccggccggccggggcggggtgcgtggccctgggggcgtggcgaacataaaattggtacttcgcggccctcccttctccctgaccgtctggggtcctaaacgggcgcggcgcccacctggagctcagtctactcaaattggtagagtcggagaagaaagcggtcttaccgaggtcagaagagtcgagtaaagaggagtcccagcagaaacctcaggagagccaggcgctgcagagccagctcccaccagagcagggacccccatcgttgatggtggagttgggccttttgcgagccgagactgacaggtgaagccttttggaatcactcggataacctgcagaggcttcaatctgcaggcccttccattctaccacccctaccttcccacaggcttcgggaccttctggctgagaaggaacgtgagtgccaggcgctggtgcaacaggccctgcatcgggtgcatgcagagaccaggaagtatgccccagcttccgagaccccaggtgagccgacttgactgggaaatggtgaaggtaaggccacagaggacacctttgccctccctcatcacctgcctttttgacagccactctcccaaaggaccagaacctggtgcggtggctacaggaactgagtgtagatccagccactatccaaacggtgagtaagtgtgagctggctcccaccacccacccaccaaaggcatctcctctgtcttccagctattcaaactttgtcattgctgcaaagatgctcaatactgaaagagcccttagtatgcacctctcctctcattatagggatggggaaactcaggccacaagggggccgcctgcctgagagttctgttagaagcaagaacccgagtttctagttgaatttctgtgcaacttgatctttctctgtttctgtggttctcggttcataaccagctcctgagtcatagcttcacccttcaaaccctgctcacctgtgccactcaagatgatctagtctacaccagaatcaggtatgtcttgggccttccaggggtgagtcatgtagcacttgctagcaatttcaggacatccccttccctatgggcctggcctgcctttgattcctccctgaaaaccatagtggttcctaaagagagagcatgggctgccttctggctgaattacattgatccctgatgtccccaggggagggatggtatgccggatttggagagccatcttggcacagcgagcaggagccacatcggtcaccccagtaccccgggacgctgagtgatgacatcaaaggacacagatacggatggatgaacagagaagacacaaacagctttggacacacctgtcctagaacccaggagcaactacagggaccaggcccaaccccaatgggtggaactaactagggaggcacccaaaggacactacatacaatcatagactattaaacagaacacttgctaccatgcttgtcttggcaacttcagaagggtgttggggggagtgaggagtgtccaaggagaagccccttgaggtctccatgtctgagtgaccctttttcatttcctgggctttcaagctagtgccttactacccagacttcatacccagttaagcagtcagtagctctgtaaacagactttattgattccggccatgggtgtgctttaggtggggggtccacagaggggtttgacaaggctatgccctggggaccaggttggttctgaggggcagaaggccatccacccactcacagggccgctccaggagtgtctgccacagctgcttctcctccggtgtggaatccatccagggcacctgaagcccataactgctgcctggatgtgggtgagccaaagtggaagctactgttaccttggagacctcgggtcccaagagcaactttctggtcccagattatgcattgtgcccaagcatcccgaacctcccagcttggctcccctcaagggcctgctctgctcacctgtaccaaggctgaggcgtgtgccccccagctggcgactggccagggccccatggtcccacagggagagctcggcacaggcttggcgtaggtcagcaggcccgaagccgtcataaaccatggtgtggttgaacacagggctgagacttcttcgaaccactcttgtgcgttggcggctggcccgactgtcatcaggcagcactgagctgcgacagggtaataaaggagggctagtcttaggcaatcaccctctgacactccctccctgagccagccaggcaccatgtcctgtcctttcatatggccgtgttccctgaccgttccctggccctggcctgagatcaggtctctagccctcttacactaatcttttcttaaggcttcgtacgtgaagctaactgttcacaggattccagagagaagtctctgaaatgcaattctgctattttctggcccagtaaccttcagtattccctgccctcccctttagtttccaaagcctcaaccactctgtagagtagaataatattactctgatatagagtaatagaaaggaagccaggacgggagccccaactcagagcagtctactctgtttcactcctggagggtgcggtaacaacacctgaagcacccagaaacacttttagaggttctgtaaaaacttactttgtaaaccacagagctggggtgtagcttagtggtagagccatatatgtgtgtatgtatatatatgcatgcatgcttagggtgactgaagcattacggtcagttcgcagcatgttaaaagacaactacaatcaccaaccattgactcacaagttcagagccaagccccatagcttgtccctccaagagttccaaggaggacccttgtggcctttgcatcatagtgcgtgcatagtaggtgcacagcctctgcagactgcagcctatgctggctaatgtcaacttgacacaaacttgagcagtggttctcaacctccctaaggctgtggtcctttaagacccccaaccatgaaattatttcattgcttctttgtaactgtaattttgctactgttatgacttgtactgtaaatatctgatgtttgccacccacaggttgagaaccactgagctagagtcctctgagaggagggaataagctaagcaaatgcctccataagatgggtcatgccgtggccaagcctgtagagcatttccttaagtactgattgagcaaggctaagcaagccttggagagcaacccatgaggagccaggcagtcagcagccctcctctgtggcctctgcatcagctcctgccttcaggtccctgccctgtttgagttgctgccctggcttccttcagtgatggactacagcgtggaagtgtagaaccctttcctccccaacctgctttctggtcgtggtgtttcatcaaaataatagaaaccctaaccacatagagccccttagttccccaactcagattttgttgttacacaaggtctcactatgtagcttgggctgacctggaactagcaatgtagaccaggctgtcctggaactcagagacacacctgcctttgcctccccagtgctgggattaaaaatgcacaccaccaccaggcagtggtgacgtatgcctttaatcctagcactcgggaggcagaggcaggtggatttctgagttccaggccagcctggtccacagagtgagttccaggacagccaaggctacacagagaaaccctgtctcgaaaacaaacaaaaaaataaaacccaaaaacatgccaccggacctagcctaagcttttattttgagacagggatcttgtgtatcccatgtagccttaatgaccttgaactaatcctcctgcctccaatcctagtttatgtaggttgttagagatcaacccagagcctcttgcatgctaagccagcaactccaccaacggatacccagccccagcccccaactccaaccccctgcctggcttatcacctctgccctgctgatcttggctggggggacaggtggatcagaggtcaagagcagaagggactaacaccttaggcggcctctcaccattgaatgtaagtgtccagggatcctggtcgcagtggtaccaggctctgagcttcctttacccagaagtgtaactccccactctgaggctgtcctcctcctgtggggacactccagttcagactaccacctcacagagtgggtgggtctcccacctccatgggccagtccagcttaagctctctcttggcagtcacttaccctctgagccggcagggacatacttaagggacagagacagcagtccacggctgggaagctcatctggagatggaggaacctgaaaaggcggggagtggagagaaacaggattatgtgtgagaagggtgttggggacagggcctctactgaggagcccaatggcaacgttccccagaagaggcgccctggctggcaagcctggcctaatggtatcagtatgaggctaagtgaggctctgcaaaccggtccgttgggtgtttggtccagtgggcctgtgggaatatcagtgactgcacaccagcccttacccgaggctgcagggggagccaggtagcctcagagtcccagttccacgtgtctaggggcacttctacttctcccagaaagatgttgcgacccagactttcccggtgccacacggacaggctcagcacgcggcctgggagatcagcctgctggacagagtgctggggacaggaggtgagtttcagaggcatgccctggcatcgctgtggctcacctgttagctggagatggtctcccaggttcctttctaggatgggctcctgaggcagggttaactggggtcctagcacaagttgtggggcttcagattgcaagaccactagctgtcttgtcattactcttctggggccgtcaggaaaattaaggaacccggcagcccctgccactcaccccactgaaaatggtaccctgtttatttgcagggatgacagaacccttgatgcctcacccgcagagtctcgttgaagatcgggttcagattccgtttcttcactgacgtcttacgcttgctctgcttatccgggaggaggtagcttttcacgtagctgggcaagggatgtgaaggctggaggtaaggaagagcccttccagagctttgtccagctctggggtcttctctagtcaccatccataacacagcgtgcccatgtggatgttaattaacaggcatccaatttaagacgcttcccaatcatattgttgtgcccattttgaagaagagaaaactgaggccgaggcagttaagtggtaggctgggtgatggagccccgcccctcaggccccctgcagcccacctgtgacgtaggcactcacggatcggagcggcgtcgccgggcagcggccaggccctggcactgaatcacctgtactcgcagctcagaggtgccaggctcgtagtgcagcgagaagagcacggagcctcgcacctgcaccgtgcctgcctcctctccggataggctcatcaggctgccgctcagctgtgggcggggcgggtggatgatcagggtccccatagggaagcttcccactgtggggtttgcctgggctttcccagctcccagcccctccctagctcttcaccgtagaggaattgaggctggacacagaggagctgctgctgagcatgcggtcaagagaggggccgagccccggggcctcttctccattctccaggatcttggaggtcgccttggactggagaggggagaagcgacaggggcgccctcttacttccctggaccttgcaggggagttgggggtaaggggtcattcaccgacggttcccacccccagggcaggtacactctcagtctggaatccgctcccggtcttgagaacagccagtggctactcccgcctacctgggctggagttggctgggactcctgctccgccttctgctcaggatccagctctgggtccgcctctgccacctgcacacccccttcgccaggggctggaatggggtacaagttgctgaaagagcccctctcctatgtgtccctaagcaaacctggagggttcacctgtcagcttcaggccccaggggtgacctagagttgtccccgaaggccaagttggggtcccaggaagaagaggaaggtggacatgatggttgtgggggcagtcattaaaaatggcctctgatcccctcaacctcttaggttccccagcttaccctccagctcacattcctggtcctggggctcctcctcctgaccttcggaagcctttgagggtacatatggtgaggacaaatcaggcccctgaagaaagcagagggtagaggtcacggtgggggttaatgagaaagggatcaagggttatgctggggtcagaggtcaaagactccagcctgctcaccttgcttggtctgagttagagtagggctgccctcagggcagggctacctaccagctgcaggaccagtcaagcctgtacttcacaccctggcatcccaggcctgtctctcctgccgggcctgcctgactcctaggctcagctggtgggggccccaacatctgagtccctggcctcacccgcctcagtccaaccccacctttgctggcgacacctcgtgtgtggttgacaatgaccttggactcctgtttctacctcctgagtgccaggatctgaggtgttcaccacaatgccgggtttatgtggtggctggggaccaaacccagagcgtcatgcgtgttaagccagcactctatcaactgagctacatcctttgtgtttgtttttcaaggcggcgtagggcggggttccctgtgtagccctggccttctgaaactctagagttgttaaaaattggaggctggcctcaaactcacagagatccacctgtctctgcctcccaagtgctgggattaaaggggcaacctgccccacaaccacagccctgcgtgtatccttattctttggttttgttgtttatttagacttatttgttttatgtaagtacagacacaccaaaagagagcatctgaccccactacagatggttgtgagccaccatgtggttgctgggaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttaaggaataacttgggattctccaggttgagcagcatagtaatcactgttcattaagtgcttattgtgggccatgcctgatagtttattttgcacattacatgtcatgtgtgcgtggtatgcatgcctgtatgctcccatgtatgtggtcatacgcatgtggaggtcagagtatgaacttgctcatcttcagctctctccatcctatatactgaggcaaggtctctcacataagctctaagctcagtgctttggtgagtctagctagccagcttactccagcaatgccctagcaccattgccggagtgctgggacagtgagtgggccaccttacccctggcatttatgtgggtgctggggatatgaactccatttctcaagcctatgcagcaagtgttttacccacggaaccatctccctgaccccttagctgatgttttagtggagaaaggggaggttcaaggtcaaagtaactgcccaaggttacacagctgttcccagacactgcttgtcactcttgaggtcctctgcccttctgctcctctggggagacgaaatatcttcgtcttggaagtcaaaagtactcaaggattaggggacatgctcatggctatatcaggtttatatatatctgggagctgccaggaaccgatcagggtgacctatgggcacacttaaaggctttgacactaggttctaagggctgagggagggtccagaagggtagtactaaggacaggcagtatctgttcaccaaagtatcctgtcccaaggtggcggccagagtagaaaaacccaaagacatggaggctagggagggacctgtcacaggtttgagagaagtgaagagctctgagctagccaaggtcaatggagaccaaaaggtagcaccaagaaccacccagacccaaccaccagcatccaaggaccccgaatcccttccttctatctgatggctgtcctgtctcacctgacccgcccttcctccagctggcgcaggtgggcatctcgtttgaggacatcagagatggcctcctgttcctcctctgtcaggaagctgaggtccagcaacccctcaacttcagatcctggtccatgtgccatggggagggagggcagggcccaaagcctctcctgagatgggtggcctctctggggcatcagctggggttgtgccccagctgggcatatgtagcttcctgtggataaaccaagggctgatcagtatctctcaaatgcacagcacacatcctgaagccagctgccggctgtctcccaagcatatacaggagtaataaggaccaatcaaaggaaggccaggtcaaggtgaggtggggcgtaagtgatgcactgcaagagatgcacatatgcgcatgctcctaaggatgaatgacagagtattgcaagacagtacacgctgatacacatacccactgttctacacacattccagatacctagacaaagacagttacatgcacacacatccccatgaaggaactgtgcgcacacatacatcatgaagggactgtgcacacatacccagagtcctatgcccaagagctgtgcagcacagtaattcttaaacctgcacacagtatgcccactcgaggacaagtgtgcactcacaagaataagtccctgcatctccacagatctctctggatttcctcacacactgtctaacctgctgcatactactagaaactaaggatagctcactcccctcaaagctagtattttgcacacaacataacctgagtcttaatgaaatgcaaaaatatacctgcataaacatgtggatgcatgcacagccctccccaccgctcatgtttatcccctacctagcctgcctctgcccttgcctccctccaccctgccctggcccatttggccttcctgtctgaggcaacctcctccccaaccctcaccccaacttcctccccccactcccatagcacccagttccactgaggccacctgcctgagattcctccccaccagccctttctctaggcggagcttctgagccccttgggtctgacccccgggctccccaacctccagacttggctggaagcctcagctggcaaaacaactcatgcccaggtaccacagccactccggaaggaaaacattgccagccgagaggggcatgtggacatggcaggggacctgcactcagtagtggccctggtctgggcccgctgggcagtctctctctttcccagcccctcctatgccaggcccccagctggggttgaaaagggaggagggcagctcaggggcaggtcctggcttgtgcctgtctcctgccttggtctcctcccagctgagtcagtatctaagcacagcaagcaagcgagcctcctctcctaccccactttccctccgggggtttctgcatctccatcgccatagccctgggcccgatgcctgctcactgacagtgactctttctctgtacttgaggtgctggtatcaagctagcttgggacttttctatggcggggtgtatgagcatcgccgtgtcctgttgtcctgctgcattagtagacatgtctgcaagccagggtaaaacatagcatctgtccctgagtgctgtgttgccttatgatactacagagtcttacaggagtgtcgctgctgtgggcagtgacttgctgggagccagtgccgtgtgggtatgtgcatttcttcctgtgtggtcagccagcccaggctggctggcttgtggtgtgtatgctagtaccccggggggccaccagatatgggagtgaaggtggaagacatttggcaaaattgcctggctttgtctgacaggttggcttggtctgggctgtgggcctatacaaggccaggatctctctacctcaagttgtatctctttcagaggtagattaaggatcaggtgtcccttgccctgtactaacactgtgggacagggaccctttagtgatagaaagtctgtatgtgtatctgggcaggccagagtcataatcttgcttacacctcacccccactccgcccaaactcctgaggtaccagaatgtggtcaggacaccaggtggcagtgcctgtcccttagaccactgggtgtgttacctgtaagggtccagtagggacgacaacttcaaaggcgactccagctctccaggaagacagttcagagactagaaaggctgtggggactaaagctgactcgcccagcagctgctgccccagtcccgaggaggtggaggaggaggagacacctcagcagggcctggtgcaaaaccg

SEQ ID NO: 960 - DNA, 4325 bp, Mus musculus
tctgggtgtagcacgctggcggttgactcccaggactcttctgtgacctgtgagccgaggattactgggtaccccagattcccagaacccagtcctggattgcagatctgtaaggaccgcgaaagattgagcaaagaagtctttctggacttaagagttccggaacaggacgtccagcccatctccggatcccgactggatccacaccttcagcctcgtgccctgtcccgggttccccgcgcccggggccccgcgcttgagcgccccgcatggcggggccatgtcctagggccggggttctagaacgggcgggcagctgctggcaggacccgctggcggaggcgctgagccggggccgctcgtctcctgcggtcacgggtcggggctgcgcgcggagccggcctctcagtgtggtctacgtgctgaccgggagccggggcccggggtggagcccgggtcgggaaccgaggcagagccgctgccgttgcgatgcctgcgcgaagcctgcgctcagctccaggcacacggccacccccgcacgtgcgcagcctaccctttgcgacgtggcgctaggcgacaccgcgctggactccttctacaacgcggatgtagtggtgctggaggtgagcagctccctggcacagccttccttgttctaccacctcggcgtgcgtgagagcttcagcatgaccaacaacgtgctcctctgttcccaggcagagctccctgatctgcaggcccttcgtgaggatgttttccagaagaactcggattgtgttggcagctacacactgattccttatgtggtgacagccactggccgggtcttatgtggcgatgcaggcctcctgaggggcatagccgatgggctagtacaggctggggcgggcactgaagccctcctcactcccctggtgggccggcttgtccgtctgttggaggctacacccacagactcttgcggctatttccgggagaccattcgtcaggatatccggcaggctcgggagcgattcagtgggcagcagctgaggcaggagctggctcgcctgcagcggaggctggacagcgtggagctgctgagccctgacattgtcatgaatctgctgctgtcgtaccgcgatgtccaggactactcggccatcattgagctggtggagacgctgcagcttttgcccacctgtgatgtggctgaacagcacaatgtctgctttcactacacatttgccctcaacaggaggaacaggcctggggaccgggagaaagccctggctgtcctgctgccattggtgaagtatgaaggtcccgtggctccggatctgtactgcatgtgtggtcgtatctacaaggacatgttcttcacttctggcttccaaaatgccgggcacctggagcaggcctatcactggtaccgcaaggcgtttgatgtggagcccagcctgcactcaggcatcaatgcagctgttctcctcattgcagccgggcagcatttcgaagactctgaggagctccggctgattggcatgaagctggcctgcctgctagcccgcaaaggctgtgtagagaagatgcagtactactgggatgtgggattctacctgggagcccagattcttgccaacgaccccatccaggtggtgctggctgcagagcaactgtacaagcttaatgcccccatttggtacttggtctccgtgatggagaccttcctactgtaccagcatttcagacccacaccagagccctcaggaggacccccgcttcgagctcacttctggctccactttctgctacaatcctgccagcctttcaagatggctcctcctcaggaggaccagtgcctggtactggtgctggagataaacaaggtcctgctgcctgccaggcttgagattcagggaacagaccccatgagcgcagtgaccctaagcttgctggagccagagactcaggaggatccttccagctggaccttcccagtcacctccatctgtgggatcagcacctccaagctggaccagcgctgctgcttcctgtacgcacttcctccggcccaggacgtccagctgtgctttcccagtgtggagcgctgccagcggttctgtggcctaattcaggtcttggtgatgaatccagattcctccgcgcccactgaggaggcagaaggcgcaagggaggtgctggagtttgattatgaatactcggagaccggtgagcggctggtgctgggcagaggcacatatggggtggtgtatgccggccgagacaggcacacgagggtacgaatcgccatcaaggagatcccagagagagatagcagattctctcagcctctgcatgaagagatcgctcttcacaaacgacttcgtcataagaatattgtgcgttatctgggctcagccagccagggcggctacctcaagatcttcatggaggaagtgcctggaggcagcctgtcctccttgcttaggtcagtgtggggacccctaaaggacaatgagagcactattagcttctatacacgtcagatcctacaaggactcagctacctccatgagaaccgcatcgttcacagagacatcaagggagacaatgttttgatcaacaccttcagtgggctgctcaagatttctgactttggcacctctaagcggctggcaggcatcacaccgtgcacggagactttcacagggactctgcagtatatggccccggaaatcatcgaccagggcccgcgaggatatgggaaggcagctgacatctggtctctgggctgcactgtaatcgagatggcaacaggtcgaccgcccttccatgaactagggagccctcaggctgcgatgtttcaggtgggcatgtacaaggtacatccacccgtgcccggttccctgtcagctgaggcccaagccttcctcctccgaacttttgagccagatccccgcctccgagccagtgcccaagagctgctgggagaccccttccttcagccagggaagaggagccgcagcccgggctctcctcggcatactccccggccctcaggcgccccttccggtccttccagtccttcagctgactcagccacacagtctcagacattcccaaggccccaggcaccctctcagcacccacccagccccccaaagcgctgccttagttatggggacaccagtcagctccgtgtgcccgaggagcccgctgccgaggaacccgcgtccccagaagagagttcaggcctgagtctgctgcaccaggagagcaagcgccggcgcatgctggctgcggtgctggaacaggaggtgcccacactagcagagaatctcctggaacaggaacaggactctcgactcagcaagattcatgtggaacttctgcttcgtggccttggggcacaaatccacactcctaaccgccggcagctggcccaggagctgcggaccctgcaagctcagctgcgggcccagagcctgggccctgcgcttttgaaggggccgctcttcgcctttccagacgcggtgaagcagatcctccgcagacgccagatccgcccacactggatgttcgtgttggactcgctgctcagccgtgcagtccgggcggcgctggcggtgctggacgcggagtcggagaagaaagcggtcttaccgaggtcagaagagtcgagtaaagaggagtcccagcagaaacctcaggagagccaggcgctgcagagccagctcccaccagagcagggacccccatcgttgatggtggagttgggccttttgcgagccgagactgacaggcttcgggaccttctggctgagaaggaacgtgagtgccaggcgctggtgcaacaggccctgcatcgggtgcatgcagagaccaggaagtatgccccagcttccgagaccccagccactctcccaaaggaccagaacctggtgcggtggctacaggaactgagtgtagatccagccactatccaaacgctcctgagtcatagcttcacccttcaaaccctgctcacctgtgccactcaagatgatctagtctacaccagaatcaggggagggatggtatgccggatttggagagccatcttggcacagcgagcaggagccacatcggtcaccccagtaccccgggacgctgagtgatgacatcaaaggacacagatacggatggatgaacagagaagacacaaacagctttggacacacctgtcctagaacccaggagcaactacagggaccaggcccaaccccaatgggtggaactaactaggcaggcacccaaaggacactacatacaatcatagactattaaacagaacacttgctacc

SEQ ID NO: 961 - DNA, 3867 bp, Mus musculus
gcggggccatgtcctagggccggggttctagaacgggcgggcagctgctggcaggacccgctggcggaggcgctgagccggggccgctcgtctcctgcggtcacgggtcggggctgcgcgcggagccggcctctcagtgtggtctacgtgctgaccgggagccggggcccggggtggagcccgggtcgggaaccgaggcagagccgctgccgttgcgatgcctgcgcgaagcctgcgctcagctccaggcacacggccacccccgcacgtgcgcagcctaccctttgcgacgtggcgctaggcgacaccgcgctggactccttctacaacgcggatgtagtggtgctggaggtgagcagctccctggcacagccttccttgttctaccacctcggcgtgcgtgagagcttcagcatgaccaacaacgtgctcctctgttcccaggcagagctccctgatctgcaggcccttcgtgaggatgttttccagaagaactcggattgtgttggcagctacacactgattccttatgtggtgacagccactggccgggtcttatgtggcgatgcaggcctcctgaggggcatagccgatgggctagtacaggctggggcgggcactgaagccctcctcactcccctggtgggccggcttgtccgtctgttggaggctacacccacagactcttgcggctatttccgggagaccattcgtcaggatatccggcaggctcgggagcgattcagtgggcagcagctgaggcaggagctggctcgcctgcagcggaggctggacagcgtggagctgctgagccctgacattgtcatgaatctgctgctgtcgtaccgcgatgtccaggactactcggccatcattgagctggtggagacgctgcagcttttgcccacctgtgatgtggctgaacagcacaatgtctgctttcactacacatttgccctcaacaggaggaacaggcctggggaccgggagaaagccctggctgtcctgctgccattggtgaagtatgaaggtcccgtggctccggatctgtactgcatgtgtggtcgtatctacaaggacatgttcttcacttctggcttccaaaatgccgggcacctggagcaggcctatcactggtaccgcaaggcgtttgatgtggagcccagcctgcactcaggcatcaatgcagctgttctcctcattgcagccgggcagcatttcgaagactctgaggagctccggctgattggcatgaagctggcctgcctgctagcccgcaaaggctgtgtagagaagatgcagtactactgggatgtgggattctacctgggagcccagattcttgccaacgaccccatccaggtggtgctggctgcagagcaactgtacaagcttaatgcccccatttggtacttggtctccgtgatggagaccttcctactgtaccagcatttcagacccacaccagagccctcaggaggacccccgcttcgagctcacttctggctccactttctgctacaatcctgccagcctttcaagatggctcctcctcaggaggaccagtgcctggtactggtgctggagataaacaaggtcctgctgcctgccaggcttgagattcagggaacagaccccatgagcgcagtgaccctaagcttgctggagccagagactcaggaggatccttccagctggaccttcccagtcacctccatctgtgggatcagcacctccaagctggaccagcgctgctgcttcctgtacgcacttcctccggcccaggacgtccagctgtgctttcccagtgtggagcgctgccagcggttctgtggcctaattcaggtcttggtgatgaatccagattcctccgcgcccactgaggaggcagaaggcgcaagggaggtgctggagtttgattatgaatactcggagaccggtgagcggctggtgctgggcagaggcacatatggggtggtgtatgccggccgagacaggcacacgagggtacgaatcgccatcaaggagatcccagagagagatagcagattctctcagcctctgcatgaagagatcgctcttcacaaacgacttcgtcataagaatattgtgcgttatctgggctcagccagccagggcggctacctcaagatcttcatggaggaagtgcctggaggcagcctgtcctccttgcttaggtcagtgtggggacccctaaaggacaatgagagcactattagcttctatacacgtcagatcctacaaggactcagctacctccatgagaaccgcatcgttcacagagacatcaagggagacaatgttttgatcaacaccttcagtgggctgctcaagatttctgactttggcacctctaagcggctggcaggcatcacaccgtgcacggagactttcacagggactctgcagtatatggccccggaaatcatcgaccagggcccgcgaggatatgggaaggcagctgacatctggtctctgggctgcactgtaatcgagatggcaacaggtcgaccgcccttccatgaactagggagccctcaggctgcgatgtttcaggtgggcatgtacaaggtacatccacccgtgcccggttccctgtcagctgaggcccaagccttcctcctccgaacttttgagccagatccccgcctccgagccagtgcccaagagctgctgggagaccccttccttcagccagggaagaggagccgcagcccgggctctcctcggcatactccccggccctcaggcgccccttccggtccttccagtccttcagctgactcagccacacagtctcagacattcccaaggccccaggcaccctctcagcacccacccagccccccaaagcgctgccttagttatggggacaccagtcagctccgtgtgcccgaggagcccgctgccgaggaacccgcgtccccagaagagagttcaggcctgagtctgctgcaccaggagagcaagcgccggcgcatgctggctgcggtgctggaacaggaggtgcccacactagcagagaatctcctggaacaggaacaggactctcgactcagcaagattcatgtggaacttctgcttcgtggccttggggcacaaatccacactcctaaccgccggcagctggcccaggagctgcggaccctgcaagctcagctgcgggcccagagcctgggccctgcgcttttgaaggggccgctcttcgcctttccagacgcggtgaagcagatcctccgcagacgccagatccgcccacactggatgttcgtgttggactcgctgctcagccgtgcagtccgggcggcgctggcggtgctggacgcggagtcggagaagaaagcggtcttaccgaggtcagaagagtcgagtaaagaggagtcccagcagaaacctcaggagagccaggcgctgcagagccagctcccaccagagcagggacccccatcgttgatggtggagttgggccttttgcgagccgagactgacaggcttcgggaccttctggctgagaaggaacgtgagtgccaggcgctggtgcaacaggccctgcatcgggtgcatgcagagaccaggaagtatgccccagcttccgagaccccagccactctcccaaaggaccagaacctggtgcggtggctacaggaactgagtgtagatccagccactatccaaacgctcctgagtcatagcttcacccttcaaaccctgctcacctgtgccactcaagatgatctagtctacaccagaatcaggggagggatggtatgccggatttggagagccatcttggcacagcgagcaggagccacatcggtcaccccagtaccccgggacgctgagtga

SEQ ID NO: 962 - DNA, 29105 bp, Homo sapiens
  misc_feature (2150)..(2169): "n" at positions 2150 thru 2169 can be any base
  misc_feature (5556)..(7959): "n" at positions 5556 thru 7959 can be any base
  misc_feature (17084)..(17112): "n" at positions 17084 thru 17112 can be any base
  misc_feature (21770)..(21789): "n" at positions 21770 thru 21789 can be any base
  misc_feature (25555)..(25748): "n" at positions 25555 thru 25748 can be any base
accaccaggcaagatgggccccaagggtgagccaggtgagtaagtggggctggaggcctccccgctttctttgcctctgtccctggactctagggtgggatctctgcttggctgctgtgcctatgatggctctctcacaggggaatggatggctgggaggagtgggaaggattaggagaagggcctggctaccctatgatggccctcctattggggatggagggctgggaggagtggggaggattaggagaagggcctgggtaccctatgaaggccctcctacagggtttggaaggctgggaggagtggagaggattaggagaagggcctgggtaccctatgatggccctcctacagggtatggaaggctgggaggagtgggaaggattcggaaaagggcctgggtaccggctccactggtggctcagcgctggggtgctgagacatcagagccaacactcatcccttctctggggcaggagatccagtgaacctgctccggtgccaggaaggtgaggcagcccttgcaggagccaggaacttgggatcacatggtgttgggtgttggcagacccccaagtgtggccaagatcctccccacagcctcctcagaacccttcttcagggacctgaaggagccaagagggtccctagggtcccacacttgttccagtgcctgggggtgggggtcagggaataacctgggcaccaccccagtccatctcccctttcccaggccccagaaactgccgggagctgttgagccagggcgccaccttgagcggctggtaccatctgtgcctacctgagggcagggccctcccagtcttttgtgacatggacaccgaggggggcggctggctggtgagtgtctgagaaatgggctaacaggccaggcccactggtcacttctcccccttggcccctaggggagccagaacccaccagagcaaggcatttcctagaggaattcactgacaaatgtttagtgagcccccaatgggacctgaagaagtatgagggcttcacagaggaggtgccatttgaaaagaccttaagttgagtgcagtagctcacgcctgtaatcccagctacttgggaggctgaggcaagagaattgcctgaacccaggaggtggaggttgcagtgagccgagttcttgccattgcactccagcctgggtgaaaagagtgaaactctgtctcaaaaaaaaaaaaaaaaaaaaaaaaaatagggtagggaggggcattccagctagaagtaaagataaactcagggaggcagcagagtaaaaggtttgcagggaacgcgtgagtgagctgagagcaggcgtgggtgtcggctaaagtctgccggcactgacggaacatggattgaggacctctgtaaaggccagttcatggaaggcactaaatgatcaacttaagaagtgtgcagcgcgcccagacgcggtggttggctggacgtggtggctcacgcctatgatcccagcactttgggaggccaaggcgggcagatcacctgaggtcaagagttcgagatcagcctggccaacatggtgaaaccccatctttactaaaaatataaaaattagccaggcgtgatggtgggcgcctgtaatccaagttattcaggaggctgagctgggagaattgcttgaaccccggaggtggtggttgcagtgagccaagattgagtcactgcactccagcctgggcaacggagtgagactctgtcttaaaaaaaaaaaaaaaaaagaagagtgtgcagggcaatgggtagccccaggagagttttaagcaggggaggggccaagtagaacttctgttttaaaaagatgattcgggctacaccatgaaagatgcactgcattgggggaccagtggaggcagggacatggtttaggaagacagcaaggagccaggcagtaaagacagtggagcaggcctgacacagtagctcacacctgtaatcccagcaccttttgggaggccgaggtgggtggattgcctgagctcaggagttcaagaccagcctgggcaacatggcaaaaccccatctctactaaaaatacaaaaaattagctgggcgtggtggcaggtgcctgtaatcccagctatgcagaaagctaaggcacgagaattgcttgnnnnnnnnnnnnnnnnnnnnagccgagatcacaccactgtactccagcctggtaacagggggtgagactctatctcaaaaaaataaataaataaaataagacagtggagcaatggaaatagaagtacttaggttgacaactctataggacctcgggcctacttggcttggagggggaggtggaagacatcagggtaaggccaggggtccagcttgggctgtgggagtggcctctctaatgtaaaatatcttggtttttttgtttgtttgtttgttttgagacggagtcttgctctgctgcccaggctggagtgcagtggtgtgatctcggctcactgcaacctccacctcccaggttcaagcagttcttgtgcctcagcctcctgagtagctggaactacaggtgtgagccaccacacccggctaatatttgtatttttagtagagacgggatttcaccatgttggccaggctggtttcaaactcctgacctcaagtgatccacccgcctcggcctcccaaagtgctggaattacaggcatgagccaccaagcgtggccaaatatcttggttcttatagtaaatgaaattgggttattttgactgacacccagcagcgctggccatctcctgtgggtggggacagtgttttgtcaattcagtcttcccagggcttgcaaggctgtggcatgaagttgagtgtcagtaaaagttaacaagggaatgtagagttcatagaaatattcaaagctaacttgaaggatccccattttatcaacaggccccaatccaaagagagagtgggtatccacccacccctcacagttcctgcaccctcagctgccagtgcccagcctggagtaatagctgctgtgccccccctcccccaggtgtttcagaggcgccaggatggttctgtggatttcttccgctcttggtcctcctacagagcaggttttgggaaccaagagtctgaattctggctgggaaatgagaatttgcaccagcttactctccagggtgagttcccagcagggtcctggagtctgggggttactgtctgccatcctgaatccctgccccacccccaagaactgaggattcctccatccctgcctccccttctttccaggtaactgggagctgcgggtagagctggaagactttaatggtaaccgtactttcgcccactatgcgaccttccgcctcctcggtgaggtagaccactaccagctggcactgggcaagttctcagagggcactgcaggtgagtgagcctaaggggagcagaggaaggaggctggatcctttcccagtgctgccactgcccccatgaatgacccagggcaatcctgtctcctctgtgggccttagtttccgcatctgagaaatggcaatcatgaaacaggatggtgcaacagtgaagaatttgggatctggaggcaaacagacctgagtttgaatccatctctgccatttagtacttatgtgaccttgggcaagtcctacccctccactgagcctcagtttcctcctctataaaatgggcagggaggccgggcacggtggctcatgcctgtaaccctagcactctgggaggccgaggcgggcagataacttgaggtcaggagttcaaacccaacctggccaacatggtgaaaccccgtctctactaaaaatacaaaaaaattagccgggcgtggtggagggtgcctgtaatcccagctactcgggaggctgaggcaggagaatcacttaaatctgggaggcagaggttgcagcgagccaagagagtgtcactgcactctagcctgggcgacagagcgagactccatctcagaaaaaaaaaaaaggcggggggagcgcagggaggcaaggaggaagttttgggtgccgcctgaggctctgttgagtgttagtgttctctgctttggaagaggaaccacggaagtcttctttcagagaaacagtgactattggggagagatttaaaagagggaagtggttatgagggagtgcctcagggaaccacctttcctggccaggcacctaagaggttcctcccagcttttcctagcagagttgctcagactggatgggagctgagagaagacaaaggagctagaggggggccggggattctggagggggtaagacagggggaaaagctgggagctttggagccagacagtcccgagttcaagtcctgccgctgcttcaaccagccgagtaaccctgcgcaaacaacctggccccttggtgttgctcgtggggcctgataaaattcaactcttagttgctctgagactcccatggcattatatctccaaaggtgccaggcatggtgctgggcaccaaggtgctttccatcccttccctgctaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttcaagactcttccagttactgggaaaaaaccctagagggcagagcagggacacaagtttcagctccattcagggaagaatttccttccagtcaggaagatggaaaggacagcctctaaagtagtgaggcttctgtctctggaggtgtgcaagacaaggccagaggggcatatagtggaaggactggaggagattcaagcatccattgacaatttcctgaggctctctgggtcctgcaagtggatggctttgtggcaggaattgcacaattgcacagcttttttgtttgtttgtttgtttgtttgtttttgagacgcagtctcgctctgtcgcccaggctggagtgcagtggcaccatcctggctcactgcaagctctgcctcccaggttcacgccattctcctgcctcagcctcccgagtagctggaactacaggcacccgttaccacgcccggcgaattttttgtatttttagtagagacggggtttcatcatgttagccaggatggtctcaatctcctgacctcatgatctgccctcctcggcctcccaaagtgctgggattacaggtgtgagccactgcgcccggccgctttttttttttttttttttttgaaatggagtcttgctctgtcgccctgcccaggctggagtgcaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgcagctgcgcagcctgcccttcgggacgctggagctaggcgacaccgcggctctggatgccttctacaacgcgggtgagagcgctgggggcggggccggatccgggcgggactcagggtcctgggaggggaccaagccgggctcgaaggctcaagggaggggccgagaggggtaccgggtctaggggacttaaagtgagctaaagctgaagggcttgggacagggcccgtgaaaaaagtgggatttaggggatctggggcgcggccgggctcgggacgagacagggatccgggcgcggctctagggctcgaggttggggcttaggcacccttcagtcggagcggtgcccagccagcggggcaaggatggggaggggctttggaactctggggcggggcggggagcggcgcggggctgtggtgtctcaggggtggggttggagaactcagcctcaccctcaggagaatgtcacgcggatctcttgaggacaattactgggagaggagcttggacttagggaaaggggccgggaggctggagttcaggagtcctagcatactatttccaaggatcgggctaggagaggcaaaaagagaagcgaaggggcccgacgggactggatactgggtgagggagcttaggttaagtggcctcagcggcccagaaagaatgggcggggaaggggcggggaagtgggcgggaaaggatggctcaggggcggggccagaaggaggctattcccccgcgagtcactcctccctccagccagcccggatgctcggcccccatacttacttgcttatgctagagtccagtagctgtgcttcctggatgtccatgaaatcgtagcctaaaatgaaggctgacccgaccactcggacacaaagatacaattatcgacagacacaaatcgcatacatgttgactcatgcaggccctagcagacgctgtcacacacacagatacagtcagacatagtaagctatacatgtcacagatatacacatacatacatttaggcacagcgttgtctatgcacactgatggtagcccctttcaagagcctgtgctgaagaccaaagggaggggacttctatgtttgcgcaactcccacctcctaaatggcccgtaacagactcaactggtccacagcctcccttcccccatgccaggtgctcacaggctctgaaccgtggcctgagggtcccaacccagtgagcccaactcctctcctgcaacactacagagatcagttctgtgaaagtgccaggggaaccctaaaaagggccgactgaagcccaaagcagaaccagaccctactggagtcccacagcaaggcaggtcaagccaggatggaccccggctccttccccatcaagctgggcttcagggatcagcgccaccccctctgtgcctgcagatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggtaggtggcctggggctggtggaggcaggcacagggctggggtaaggcctacacagaacaccagtatctgactgtctgcctcctgcaggaggatgttttccagaagaactcggtgagcagaatccacctctcactcaaaagtgccctttgacttccgctatgacctctgacctccactaatccccctggcctcctcagtcacctaaccccccactgacatcccaagtattcctctgtttcctgttgcctcctctcatgacgggtgcccctttcctgcgattccaattcccactgatgctgacctttgatgctctcactccccttgtctagccctgtgctgacctctgacctcactgattcctgcctccctcccaccaggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttggtaatgaaggcccccagggagggtgctccaggagggggctggtgagggtacggtgggctggggctgaggtacaggccccaccattctctctccctgcctcccctaccctgggcatcagtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggtgcgtggtgttcagagaggcagtagggcagctggcatttgaggtcaggcaaacccaagttcagttcctggctgggccacttgctcactggtggctttgggcaaattatcaaatgtctctgagtgttggcctccttatttgttagagaggatgagcatgtcgctgcctcctggggcagttgtggggttgggaacgcccagcatggggcatacagtaggttctccctgtgaggtgtgtccgctgggcctgagggaggcgtgcagaagatggtggctgggtgggatgtcaggagtgggacaggaccctggctcaaggttccttggggcctggaggcccatgatgccagtgcttgccgttccctgatgcaggactactcggccatcattgagctggtggagacgctgcaggccttgcccacctgtgatgtggccgagcagcataatgtctgcttccactacacttttgccctcaaccggtgagtggcagagcaagggttaggtcatagccacataaaggtttccgaaacctaggtctctgcgtgcaaagccattgctgtctgggatcactgctgttcggggaatttgctgaccggggtcactgatgtcaataggtccctgttgttctgagttactgctgcctgggtcggggtgggggaggtggtgctgcctgtggtatggtcaccgctgtccaagatcactgctcctaagagtcatcgcatctaggaatcacttccatctgaggtcactagagaggtcagtgctggccagggtcattatcattttgaggtcattattgtcaggcccctggaagggtccctgctggttcagtgtctagaggtccctggacagagtaggccagggccatcagggagggcctgagcccatcttttccctaggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtaaagagcacagtgagtggccggtgggctaagctgtgagatgaggggtggtgctgtgggcatcagtccagccctgtgccccctacccccaccccaggtatcgcaaggcttttgacgtagagcccagccttcactcaggcatcaatgcagctgtgctcctcattgctgccgggcagcactttgaggattccaaagagctccggctaataggtgagcacagatcctggctcttgtctcgtcacccacaggggttccgaggggcctgggaagagggcagggagagagcacactgggcaagagctaggatgagctcatccattttggactgtcctgcccatacccacacctgggtcctcatacctgttctgggccctcaggagccctcaaacccacaaatgttcccaaactcacatctgcgtgtccattacatcctgaattccacatatacctgtgcctgagctcctgttcccacccgagatcttgccatactcaatgccatactcatatctatgttcatgtccacactcgggcccacagaaatggtgggcctcactcacccctgcacccacactcactggagcccatgcctctctcccccaggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtaggtggccccctctgcattcttggcctgacctgggctgtcagctcctgcacctatgtccattggcatgctagactgaaccctgagccaatgacctggctgcttttagaccagtgcccgtggcaccccatgccaacgttctagctatatccaggccagtttcctctccctggcagtgctggttggtgcctgggctgaactgaggatgtggctttgcatgcaggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgaggcctgtaggggtggtggacccgggaaaggggtaagccccttctgactgaccccactccccaactgcctgcaggtgctggtcctggagatgaacaaggtgctgctgcctgcaaagctcgaggttcggggtactgacccagtaagcacagtgaccctgagcctgctggagcctgagacccaggtgaagtcgctgctgaggcccctcactcacctttgctaggaccttttctgtggagcctttctcccatcctcagacccctctcctgtcaccagcactccccatcacaccccatttcttcttgcaggacattccctccagctggaccttcccagtcgcctccatatgcggagtcaggtgataggcgggacctggggtgactggaaagacgggaggtgagggtcgctgccacccagcctgacgcttactgggttcttcatcccttcccagcgcctcaaagcgcgacgagcgctgctgcttcctctatgcactccccccggctcaggacgtccagctgtgcttccccagcgtagggcactgccagtggtgcgcagcctttcatggtcggggtactctgagggccaggatgcccgggggggagtgggggaaagaaagggacgacgtccgttggatgctccggcttaggtggggaccaagatgcccctcccgcgggtctgacctcccccaccttcaggttctgcggcctgatccaggcctgggtgacgaacccggattccacggcgcccgcggaggaggcggagggcgcgggggagatgttggaggtgaggacgcgggactgggagctcgcggagggcgaggggccgcgggccctgctgaactcccatctcaccccgcgcccggcagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggtgcggtgcgtggcagcgcgggtggggctgagggctcgcgagggccgagtgagccgggccacgagcggagcggctcctgtgggcggggcctagtgggcgggctcgtaggacctgagagttcgagccctgtggactgggcccgtgggcggaacagccaggaccgtgcgggcgggattgaggtctggagggtcctgtgggcagggtagtaagggtggggaaggtcggagagggcttgtgggcggggcgggtccttggggcggggccaggctggcgtgggatgggcggggcttctctgcccacctcggtccctttcctctctcccttacctcccctcaggttctctcagcccctgcatgaagagatcgctcttcacagacgcctgcgccacaagaacatagtgcgctatctgggctcagctagccagggcggctaccttaagatcttcatggaggaagtgcctggaggtacctgccctgtgtgggatgggaatgaaaccgaggtgtgaagcatgggaccgaggcaggcaggggtagagagccctagggggaaatgcaccctagtgcgtgtgggtggtgtagcctagaattagctgaggagtggcgctgggtgatggagttgggctacaacatgggtgtgtctgggccttgagcagagagatgtgggctggagccagtgggtgggaagaatgaacttggactgtccccacccaggcagcctgtcctccttgctgcggtcggtgtggggacccctgaaggacaacgagagcaccatcagtttctacacccgccagatcctgcagggacttggctacttgcacgacaaccacatcgtgcacagggacataaaagtaagccctggggctggcccgccctcatctgctgagggtggcggggaaggaaacatggtcccagacgcaggctggcagtttagattaagtgagcagacctgttgcaaagggtagggaattcatcagggaggctccttagagaaggaggggaaaggttcagctctgaagccaaaccaattgtcagctcccagaggggcatataagtgggatggcaaggggagagtgttgacagaggcaggaccaggctgggatctccaggagatgggatcccagaaagagggtctagttctgctggcaggggcccagaccagtgtccactaatggctgtcaatcagggggacaatgtgctgatcaacaccttcagtgggctgctcaagatttctgacttcggcacctccaagcggctggcaggcatcacaccttgcactgagaccttcacaggtaacaaggtgtgggggtggtgagtggggatgctgacctggggcagaagatctcttggaactttccagggaagggggtttctcctaggcatggagttagagtcctaatggggaatgaaacccagggtgagtgattgggccagggctgaggtggtggcatctggaactggagcttggagaagtgatgaaattgactttagcacttgaggagtgttgatgcaggccaaggtgggagttggaggaaaaagcaggtgatggagttcagggggacgaggcaatccaggatgtgtgctggagcactactgtgggtgatggagtctgtgaatgtggtggagcccaggatgaatgacggaagccttggcaggcgatggagcccagggtggtgatggaactcaggatagatgtttgatgaccaggataggtgttgaggtatattttggatgataggttcagtatgggtgcagtcggcctgaggatgacggcattcccctccctgctccaaccccatgatgaagcctagatgggcattggtgctcctgtttctgtcctaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgagacctctttgggcctggcccatggaagtggcatagggccagcctgggccttggacacctctgaatgtcacccttgttcaccctccccccacaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcaggtgcttgcgggtggcgggatgggcacagtggagggcagaggagttgtggagctgtgagggtggaggagagcccagctgatggctctgtccctccctcagatgccccttctgccagtcccactccttcagccaactcaaccacccagtctcagacattcccgtgccctcaggcaccctctcagcacccacccagccccccgaagcgctgcctcagttatgggggcaccagccagctccggtgagaccaaggctcctgggatgggttccttttgcctggttttgcctttttctcctctcctacaaaagccctccctggggacctgggcaccttgaccacttgtgaatgtggcatttggtgcctccccatgccctgttctggcaactctaacttggacttgttgtgtcctctcagtgcggggtttatctatgttcatgcctgtgaggtaggcataaaagtaggagagccaggattcaaacccggcaacagaggtgactggccggttgctgcccgtcctcaatcagcagctcgcccttgtgcccagggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcaggtgggcggcccactctagcgccccctggtggtcgcaaagggtcaggacacctgttgatgtccccgccccctacctccgcggcagcgtctcttttggctggagcactcgctgacaacccctctcttccttctcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgagggcgccttctggtagttagagctgcccaacaacaggtagtgagttccccgtgcctggtgaggtgccaggacttgacgttcccagattccctgtctcctctgtgaagatcaggcctgcagcaaaaaaccgtctgcccagtcctagcttcccaggccttccctggacctcaagccctgcccaccnnnnnnnnnnnnnnnnnnnnnnnnnnnnnccctgcctctagttgaggctcagctgtctcagcggcgcctccctccccctgcaggtgaagcagatcctccgcaagcgccagatccgtccacactgggatgttcgttctggactcactgctcagccgtgctgtgcgggcagccctgggtgtgctaggaccgggtaggaggggaatgccacgggcctcctgccagcgagggtgtggtgcttgctgggcgcggtgaacatcgaatggggccggtgggggccaggcgggacaggggcaggcaggcgccggtgggggcgtgactaaatggacatctcccataccggcaccgcctggggcctgcccagagccgggcaccctaccccccgcactttggggtctggggttcccaaacgggcgttgtagccttgcctgagttcaccgcactgggctgcagaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggtaaagccccttggaatcgctcatagcctctgccgggcttcaacccactcaccactcaccgctccattctactcttctgcgccccacaggctgcgcgaaatcctggcggggaaggaacgggagtaccaggccctggtgcagcgggctctacagcggctgaatgaggaagcccggacctatgtcctggccccagagcctccaagtgagtgggccttggctggagaacattattggtgggttcaaggcagcttctagcacaaggcacccttgggctcatcacctgacttgggctcatcacctgagcgggccttggcgggagaacattattggtgggttcgaggcagcttctagcacaaggcacccttgggctcatcacctgacttgggctcatcacctgagtgggccttggctggagaacactattggtgggttcgaggcagcttctagcaggaggcactcttgggctcatcacctgactgcttcttgacagctgctctttcaacggaccagggcctggtgcagtggctacaggaactgaatgtggattcaggcaccatccaaatggtgagtcggggagtgcttggctatccctgacctcaccagccaaagcctccatctctgtccatcttcctgctcttctactgtgccctctgatgcagagaatctcactaccagaagaacacttagtattctcgtcccattgtatggatgagaaaactgaggcccagaagggtgtgatctgcctcattattttggcaacagagcagagctagtacctgggtctcgacacatctttctgtaatttcttatttccctctttctgcgggtctttgaccacatccagctgttgaaccatagcttcaccctccacactctgctcacctatgccactcgagatgacctcatctacacccgcatcaggtacatcctgggccccccaagtgtgaaccatgcatatggcctcatcctggccaactgcaggcctgcctaggttccttcctggaaaccaaaggggcacctgggtcccctagggacagagggggcactgggcagacagtgtgtgcaagatagagtccagggccaccttctggctgagccacactgagtccattacccccaggggagggatggtatgccgcatctggagggccatcttggcacagcgagcaggatccacaccagtcacctctggaccctgagagctgaatgagggcatcataggccagacaggccccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttgtcctggcaattttggaggtgtatggtgggaggggtatcctgggaagagccccctaggtcttttttaaaaaattttttttgttggccgggcatggtggctcatgcctgtaatcccagcactttgggaggccaaggtgggcagatcacgaggtcaggagatcaagactatcctggctaacatgctgaaaccctgtctctactaaaaatacaaaaaaattagctgggtgtgctggcgggcacctgtagtcccagctactcgggaggctgaggcaggagaatggtgtgaacctgcgaggcggagcttgcagtgagccgagattgcgccactgcactccagcctgggcaacagagcgagactttgtctcaaaaaaaataaataaataaatgaaaaaaaaatgtttttaggccgggtgcggtggctcatgcctgtaatccccgcactttgggaggccgaggtgggtggatcatgaggtcaggagttcgagaagagcctgaccaacatggtgaaacctcgtctctactaaaaatgcaaaaattagctaggcgtggtggtgcgtgcctataatcccagctactcaggtggctgaggcaggagaatcgcttgaacccaggaggcagaggttgcagtgagccgagatcgcgccattgcactccagagcgagactccgtctcaaaaaaaaaaaaaaaaaaaaccttttttagagacaaggtcttactctgtcatccaggctggagtgcagtggcatagtcatattcactgcagcctcaagcttctggattcaagcgatccttcctcctcagcctcctgagtagctgggaccacagctgtgcaccacccacacccacctaatttttaaacttttttttttgtagaaatagcatctcgctttgtggcatagctcactgcagccttgaactcctgggcacaagcaatctgcctgcctcagcctcctgagtagctgggactacaggcatgtgacaccaccacctgcagctaatttttaaaattttgtcgagatggggtctcattatgttgctcagactggtcttgaactcttgggctaaagcaatccttctgcctcagcctcccaaagcattgggattacaggcgtgaaccactgtgcctggtttctactgaagtctttgtggcagagtctgaagttccttaatctggcccctcttacttccctggctctttcctacaatcacctttcttcctccctgccccagcagacaccagccttttattgctcttagaatagactttattgactttagccaagggcaggccctgagatgggggtccagagagagaggcttggtggggctacgtcctgggggccaggttggttctgaggggtagaaggccatccacccactcgcacggctgctccaggagggcttgccacagctgcttctcctcaggtgtggaatccatccagggcacctgcagcccatagctgctgcctggatgtgggtgggcaggggttgagggcatgatcacactggacaccttggggcccccaaacacctgcctggtcccagattatgcactgtcccccgttaccaccctcagttctcagtagatatcaaagctcaggaaaggacagagaggtatccagggccacacactgagcccccatctcccagggcctgtcccagggcctgtctcagggtgctgtcccacttaccggtgcccaggctgaggcgtgtgccccccagctggcggttggccagggccccatggtcccagagggagagctcggcacaagcctggcgcaggtcagcaggcccaaagccatcgtacaccatggtgtgattgaacacagggctgaggctgcgtcgcacaacccttgtacgctggcggctggcccggctgtcatcaggcagcacgaagctgtgcgggaggtggcctggcatcaggtgacccccctcacactccctagagtcatccagtcaccacgtcccactcattctccctcacatatgtccatgtcccctggctcctgcctgcctggccttagaccctcactgccctgggacctttgcaccagcctcctctcaggtctcctggctttaaaagttacagctcctggccgggcgaggttgctcacgcctgtaatcccagcactttgggaggccgaggtgggtggatcacctgaggtcagaagttcgagaccagcctggccaacatggtgaaaccccatctctactaaaaatacaaaaattagctgggcatggtggcatgcacctgtaatcccagctacttgggaggctgaggcaggagaatcgttggagcccaggagactgcggctgcagtgagctgaaatcacaccactgcactccagcctaggcaacagagtgagactgcatcttaaaaaaattaataatagccgggcgcggtggctcatgcctgtaatcccagcactttgggaggccgaggcgggcggatcacgaggtcaggagattgagaccatcctggttaacatggtgaaaccccgtctctactaaaaatacaaaaaaattagctgggcgtggtagcgggcgcctgtagtcccagctactcaggaggctgaggcaggagaatggtgtgaacccaggaggcggagcttgcagtgcaccaagatggggccactgcactccagcctgggcaacagagcgagannnnnnnnnnnnnnnnnnnnaataataatgttacaactcctattcacagggactgcagagcaatgtctctgaaatgcagttctgctattctcgctggctcagtgacttttattatctccctgttgctccaccaccacccctcctcaagcagtttccaaggtttttttttattttttgagatcgagtctcgctctgttttgcccaggttggagtgcagtggcgtgatcttggttcactgcaaccttctgggttcgagtgattctcccgcctcagtctctcaagtagctgggattacaggcacccaccaccacgcccggataatttcttgtacttttgatagagatggggtttcaccatgttggtcaggctggtctcaaactcctgacctcaggtgatccacccgcctcagcctcttaaagtgctgggattacaggcataagccaccgtgcctggcctgtttccaaggttttcaaagcctgggaaccccctctgcaaaatacagtgttgctcagaagtacagtacctctgtactgcagcctctggctgcatcagagtggacacccagaagtgacccgcccacctccatttcactctctaacagtgggggcagcacctggaggcacccctagaagtcccctagaagcttacactgaactataagttcccagccaagccccacagcctggcctcccaggttctctatggaaggacccttgcagccctcagcctcagcttttcaacaagtcctataggcgccagtcacgctgaaatgcagctcctcaaaggtgtcctcaacttccctgactccaggcctttgctcaaaccgtccccttcacccctgctcagtggtgaaagcccaggctgcgtgatcaaaggttgattagtaagggtttgtggaggttgggcactccactgcaggcaaaagaatgggaagcccggagggccagcactcctcaccattgtacgtaagtgtccagggatcctgcccgcagcggcaggaggtcccgagcctccttcacccagaagtgcagctccccgctcgggggcagtcctgcgcctgcggagaggctcggctcaggcccgcacacggatggagtccaccgcccccaaacccggggactggagtctcccgcttttcagggcgtgtccagcttggcctctccggctgtcactcaccctcggagccggcggggacgtacttgagggacagggcgagtaacccgcggctcggaaggtcgtcgggagagggtgggacctgcgagaggcgggcttatcgtggagcaggggctaatggaaaggggcctcaggagggtggggtctgcagacccggatggggtgcggctagaagagacggcggggcctgcaggggcagaacctaggggtcctagcgccctcggggaaggggccgtggccggccgggcttcgcctggggccatgaggttaagaggttgaggggaggttctgtcgaaggcggggtgtgagggggctgcgggagagcctggtggggtaaatgcaggagacccgggccgcaggtctccccacgcggcctggctgcctcacccggggctgcagggggagccaggtgggctcagagccccagtcccacgtgtccaggggcacttcaacttcgcccagaaagatgttgcgacccaggctttcgcggtgccacacagacaggctcagcacgcggccctgaagctcggcctgcgggacggagtactgaggacaggaggtgagctttagtggagcactgctggtggcccgcgtagatgctgcgcgagttggctgaggcaggtcctaccgcgttcctaccatgatggaattctggggagcccctaagggcattaatggggacctgcactatcaccacgcccaccacgaggctgacaacactggataacgagttaatgggccccctccgccgatcctccgggcaatgacgttactggctgcccttgccacctagccccgcaggaagggggcgtccagttcattaacggggaaccgcatcgtggtcacagcctcacccggagagtctcgttgaaaaccggattcagattccgtttcttcaccgccgtcttgcgcttgctctgcttatccgggaggaggtagcttttgacgtagctggggaggtgagaacccgaggtgaggaggggccctcccagagccttctcccctgcctgtgggctcccccagccaccatcccgaacacgtgccaggcctcgtgctaagcgctttacagggattgtctcgcttaatcgcacgcctcccaataacgctgttgttcccattttgaagatgaggacgaggaggccgagaccctgtgaatggtgggctgggctgtgacagccgcgccccgcttggccggcggggcactcacgggtccgagcggcggcgccgggcggcggccaggccctggcactggatcacgtgcacgcgcagctcggcggcgcccggctcgtagtgcagcgcgaagtgcacggagccgcggacctgcaccgcctccgcgtcgcctgacaggctcatctggctgccgctcagctgcggacgggagtgggtgggagtcagggccgctcgcagggctcacgtcggggccgcgggcagcgcggaggcttcagacccgggtcataggtggcaggctggggggctgcagcggtgggtcccgcggcgagggaggggcaggcaggggctacgcatcggaacgggtccaccccccggccgcccgggtcccctccctcccgcctcaccgtggaggagttaaggctggacaccgaggagctgctgctgagcatgcggtcgagagaggggtcgggccccggggcctcctccccattctccaggatctgggacgcggccttggtctgcagagggggcaagtgacggggcgccccttctttccccacccctgccccgagcgccctgggtcgcgggcggctcgcagccctgggcaggagcgctccccgcccggagtccgctccggatgttgagagcagccacgggccactcccgcctacctgggcttgctggggccgcggctcctgctctccccccgacgcgggctccagctccgggtcagcctcctcggcacagacctgttggtctccttggccaggatctggggtggggcacgagatgctaagcgagccctctcctgccctcccctaagcaaatttgtaggaactggtttacaaccccagcgagctgcagattcaggccccggtgctgccctgggatcgtccccacctccgacgcggggtgggagtgggggtgacgagggtgaacacaggtggttggggccccttagagctgcctctgacccgcgaaacctctccgtgctccccaacaggcgctcccactcaccttcctgggcctgggacgcctcctcaggatctgaagcctttagggggacagaaggcgatgggaaatcaggtccctgaaggaagaaaggggtagaggtcacagtacgggggctggtgaggaagaggtcaaaggtcatattggggtcagaggtcatagggctccagccagctaccccagtttcaggtttagggcagccctccgggcagggctggcagccagctgcaggagcggtgagaccagtgcttcacagcccaccccgcagggcttgtgccgcctgactccctactcccattggtggggtcattcgtacctgagtcctccacctccgccaggccaggccagtcccattcctttctcactcctttttttatttttattttttatattgacccattggtagacaaccttttttgcttttttttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagcgattctcctgcctcagcctcccagtagctgagattccaggttatgcaccatcatgcccagctaattttgtatttttagtagagatggggtttctccatgttagtcaggctggtcttgagctcctgacctcaggtgatctcggcttcccaaagtgctgggattataggcgtgagctgccacgaccggccttttttttttatttattttttatagacatggggggcattttgctatgttgcccaggctggtcttgaactcctcggctcaagcgatcctcccacatcagcctcccaaaatgctgggattacaggcatgagccaccgtgcctggccccacttcaccccttaatagccagattcagaagttcccttagaggctgggtccatataccactcactgttcaccaccgttcaccactgtttaccaccattcaccaccgttccccaccgttcaccactgttccacccaggaggtgatgaggtgcagacacaggaaggaacatttccagggtctccccattcccaggctggggctctttcccccctgccccctgcacattccacctcccctccagggacactgtactcacatgttggctcattcacttacctcagtctccctgagcctctcctgaggggcctcatcaatggtgagcctaggagtagggagaggacgctctcagagggagggaccctggtgactggtgggcaccatctcccccttcctgagactcctcctcacctgggctctggcccctcttccttctctttcacagcagcctcagcctccctgtcgtggcctggagcctggtctcctgggcgcaggtgagaagttctgtgagcccccatgctcaggaagcctggctgtgactcgggagaggccctgggagatacccacccaccccatgcccacggaggggcattgcccactgaaagacacacagtactgggggcagccaggactggagccctagtggtcctctctccctgtccacatacagccagcgccctggacggcacatggcttgccctgccccgaggatctcctctcacccctggtgctcttcttcctgcgcatagacgctcggacaaggtcagagccgaagtgggcattgtggtgccgctgggagcgtgcttcctggaaccagtcccctgtcaggatcttcagctgcccagggtctgccactgaggcccggagcttgctggaggaagggggagggtgtggctgtcatgactcacccaagcaacattcccgccacctacattgttaacaggcttgggaccaggggccagggacccaacagcaaatcagacttgatctgtgctgtggaggagctcgggctgctggggagaccaagtccagaagagacaagtacactgtagtgaggtggatgatgtgatagaagtaagaagagccagctctgcctgtgagaatccaggagggcttcccagaggaggtgacatttgaattgcctttatttatttatttacttaattattttgagatggagtctccctgctatgcccaggctggagtgctgtggcgcaatctcagctcactgcaaccttcaccttccaggctcaagtgatcctcccacctcagcctcctgtgtagctgggactacaggcgtgtgccaccatgcccagctaattttttatatatttttttgtagagacggggcttttccatgttgcccaggctggtctctaactcctggactcaagcaatccacctgcctcagcctcccacaatgttgtaagtcactgtgcccagccttgaatttcttcttaaaagacaaattggaactctccaggtagagaaggataataattattatacttttaattttattatttttttttgagacagggtcttgctctgttgcccgggctggagtgcagtggcatgatcatggctcattgcagcctgacctcctgggttcaagcaatcctctcacctcagctgcctaaatagctgggactacaggcgcacaccaccacgccaggctaattttttatattttgtaggaatggggtctcactgtgttgtccaggctggtcttgaattcctgggctcaagcaatcctcccgtctcagcctctcaaagtgctaggattacaggcgttgccactatctctggccaattcctcttaaatcagtgaagtaggactccttagccccattttacagacgacgagcatggtgctcaaggaggtcaggtgagttgccaaggctacgtagctaggaagtgtctgtccccaaacattgcttgtaacgcccatgctcttctacaactgtgctcttccaggaagaagtaccagcataggcatagaagtgaagagtgggttcagggactggggagcacctgagtggctggaggggtcactttgtgtctgtgtgtcgggtcggagttatggtgaaagaggagatggtgggggctggcaaggaccgaccagggaggcccagtggaccatgcctaggagcttgcccttgatactggggagccaggggaagttttcagcggggatattaaggacggatctggccaggcacggtggctcgcgtctgtaatcccagcactttgggaggctgaggcgggtggatcatctgagatcagaggttcaagaccagcttggccaacatggcgaaaacccatctctactaaaaatacaaaaattagctgggcatggtggcatgtgcctataatcccagctatttgggaggctgtggcaggagaatcgcttgaacccggaggggtggaggttgcagtgagccaagattgtgccacttcactccagcctgggcgaaaaaatgaaactctgtctcaagaaaaaaaaaaaaaagcagacagatctggggagcaccagctgcaggaggtgggcccaagaggcaagcctggaggcagggaggctggcgagaaagctggtgcagtcacccctggagaagtgatgagctgtgagctggccaaggccagaggagactgaagggcaaaaccaagaaccacgcagacatctgacaggcagtggtgtcggtagggagcaggatgggggccactcaagcctcttggtgctccccggccagggtctgccctgccttacctgacccgcccctcctccagctggcgcaggcgggcatctcgttggaggacgccagcaatggcctcctgctcctcctctgtcaggaagctgaggtccaacagtccttcagtctcaggctttggcccatgcgccatggggagggagggcagagcccaaagcccctcttgcgatgggtggcccctctggggcatcagctggggggctgtgccccagctgggcacacggagcttcctgggggcagaccgagggtcag

SEQ ID NO: 963 - DNA, 3514 bp, Homo sapiens
gaattcgaggatccgggtaccatggggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaaaaaaaaaaaaaaaaaaaaaaaaaaaa

SEQ ID NO: 964 - DNA, 3036 bp, Homo sapiens
atgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctga

SEQ ID NO: 965 - DNA, 26993 bp, Mus musculus
  misc_feature (5740)..(7267): "n" at positions 5740 thru 7267 can be any base
  misc_feature (11948)..(11967): "n" at positions 11948 thru 11967 can be any base
  misc_feature (20513)..(23225): "n" at positions 20513 thru 23225 can be any base
  misc_feature (24371)..(24800): "n" at positions 24371 thru 24800 can be any base
  misc_feature (25973)..(26272): "n" at positions 25973 thru 26272 can be any base
ctcactccgccagtctgaagcatccgggctctgtctgtgaaacagtccgcgaactgggagggtctacccactggccccagcacccctcctcccaaggccccccatgctgctgcttcatgtgaccagggctgggccgaatctctgagcagacagagagaagcatggtgtgaccgcatgagtggagtgagttctggggacagtgcccagttgtgcgatagacagcagattccggaggaccactgtgcatgtgtgtgtgttgttgtatttggtttgtgtttgtgagtatgtctgtgtgtgtgtgtgtgtgtgagagagagagagagagagagagagagagacagacagacagacagagacagagacagagacaaagagagttgtgtgaggaccactgtgcatgtgtgtgtgttgtgtgaatgtttgtgagtgtgtgtgttgttgtatttggtttgtgtttgtgagtgtatctgtgtgtgtgagagagagacagagagacagagagagagagagagagagagagacagacagacagacagacagacagagagacagacagagagagacagagagagacagagagagagagagagttgtgtgagggcctcccaggtgatctgggaagcttgtgaatgtgaaagtgcctgtgggtggcttcacctctggcagaggcattctgcctcctgtatattaactatgtgtgctcagacaatccactcaaagatgctctggggctgcagctgatagagcagcttacttagtgtgcacaaggccgtgggtgcaaacaccccagaactacaatcccagaactctctctgcgcactgaactcgacttcctcatttgtttcttgtttcttttttttgacggagtctaacattgtccggattgcttcaaactttatagcggaggaagatcgatggcaattcttctgcctccaccttctgagtgctaggattgcaggcatgtaccctcatgcccagttgagacagtatcagtgattgaacccagggcctcacgcctcctggagaagccctgtaccatggagctacaagtctagttccttttcttgtccttaaaaaaaataaaaagctgggtcttcttatagcccaggctggctttgtactccccatcctcctgcctcagcctcccaagtgctgggatgataggcttatggcacggccatgatagcacctacaatttccagagttgcctgtcctttgcagtgtactatgccttgtgagggacaggctctgagggtctgcttgtgatcacacacctgaggacctgtttgctgggagttctgtccccatttctttgccaggctggaagacactgacacacccaccatggtgacagtacccatggacttaaatggtgtgactccctctgctctaatgggagggtctcagtgccccgtatctgctgtttctcaaatggggtaggtaatacagagataggagggctgacacaaaacatatcaaacaccaagatagcaaaggctagaatgagaccctgtctcaagctttcccatagagaaggggagtgtataattgcacccactcacaagactgttggccataaacaagtttgtatggaaaatgtttacaaagtgcttggcacatccaggggtggtggcgcacacctggattctcatacttggagagaagagccaggaagattagggacggttccagtcaggcctacatattgagaccttatctcaaaaacaaaacaacacaacacacacacacacacacacacacacacacacctcaaaaacctctggaagttcacattttgggaaaggcatctgaatggtaaagtgtagggattaagagtagagactagagtccctccatgggaccgagatgtagaaaagaaagaaaagagagcttgctaaagcaggccagcctaagggcagactcctgaaaggacttgctccaaatgattgttgagggtggaggactctaagaaactggaattgtgggaaaaactctcggggaatgacaaaagccggtttgcaggttggtgagattagaaagtaatggccacaatatagggcacaatatacaggctggtcttgaacttgtaatcctcctgcctcaacctcccaactattataggtatatgtcaccagctggatgcttttgcctgtcttgtttctttctgtgccccagggcttcagtgaatagggatggctgccgattaaataactgaattgctagcagggtgggtgagtcagggctttaatcccagccttcaggaggcagaggcacacagatctttgtgagttcgaggctaacctggttaacagagagagttccaggacagtcagagctacacagagaaaccttggctcaaaaaacaacaaaatatctgaatggctgattgaatgactgggcagatggacagatagacagatggacatgtacgatccacagacatgtacgatctttgggatggtggggaaggcttggtagctaacacaggctggctcaagacctgcttctgggaaccctttctttcctttgtatcctcagctctgggtcatgaagggtgtggagtgggccgggaagggagtgtcaggctcagtggctgcttgccttggattctggcccagagtgtctggaggaagaagagggtatctcggcatctgagtcaccttagagaaaccctagccacatacctgacttctgacatcacacaaccagggcaaccctggtggccgagacaaggagactgaatcatggactgaaatcagtcaccttgggcatgggcacgtggccgctagtgaccccctgagacacccccgagtggctgtctggctgtgtgggcatgcaaaccacatcaaggtcagtaaaggctctccagcctgagtcagggacagggtggccactgccagagaccaccgaccacagcatctgcaggacaggaagagaaagttgagggagaaaaggcagagggtaggccccagtcagggagagggaagtgcctgtgggagaaaggggaagctgtggcttgcggccagtagcctggtgacctgtggctgggatgtggaatggggtcttagtgtttgcgcacagaatggcgaagttgcaagcgaggctcagaggacaatggagtcagcagacaatgggctcttacacttgcacacgcaggcacaggcgcacaaaagccagcgtgggagccctaccctccagccaccccagagctacagcttgccacacacacacaagactgtccccacaagactcgcttcctttaccctattaagtgacatccgtaattctcattgtgaagattgcaactctcggtattttgatgatctcatttgatatgaataacttagacatttgcagtgccaggcactgttgtagactatttagctgtgctagggattgaacccagggcttcttgcattctgggcaaacatcctgccactgagcttgctcccagacccacgtgcccatggtttgtccccagacccctgttttatatgtaattctgagacaaggtctcactgtaatgcccagagacccttgagctcactctattacccagccttgaactcactgatccttctgcagggattgtaggcatgactagctagacacagctaagtatctgttagagcgtgtatgtgtaccttggggcagacatctgtccaactgtatatgtctatacattgttaggtttcaaacaaatggctgaggtgcctatttaacatatcaagaggacctggcccccaatttctccctgcaataactcagctcctatatgccctcctggctggcataccccacccgctatgctgaacttctccagcccaggggctgggctgttcatccctatgtaatccaactattttagctctcccctctctttgtaccttaaggctgcacctggctcccatggctcccctccctctctccccacacggctcagggttaagtcgactctggactatcctagaggtccctgcctctggctatgctctcccacatatctataataaactctcctctgcatacctaggaacagtcatgttcccttcctttctctttcttaatttccttttcttttcattcatacatacgtttctttggattctgtattctattctccctccttaaaaatatacacagctagccaggcatggtgatgcacacctttaatcccagcactcgagaggcagacacaggtggatctctgtgagttcgagaccagcctagtctacagattgagttccaggcctgtctggcctatacagtgagatcctcaaaaagaaaaatgtacacacactacccccttcaagtcagaagaccctgagacacaagcccatccatcgccgggcagcatgggaaaagcaggttgttacaaatgcctggagtcaggtctgacactcacacacaaggtccctgccaccagttgatccagcagctacattcgaaggatcagagaggtccagataactgtgctgccctgtcagaccttatgaatgaagacctgaatggaggctgatgtctgtaattccagcactcgggaggcactcaggaggcaaggaggattggagggagttagctggaggccagcctatgctatagagtaagactgcttcaaacaagagaaatgagaactgaaaagattgctcagtgggtagaggcgcttgcctgcaagtctaaggaactgagttcaattcctgacatttgcatgatggaagaaaagaaactccttcaaggtcacacacacacacacacacacactcaaagaagtaaaaatactttttaatttaaaagaacagagaaacttgaacacatggtcggtctgcgatgtggctctgcagtaatgcctgccttggatgtatgtagtcctggttttgaccccaccattatacagaccaggtgtggtgatacaaacctgtaattccagcactgggggctggagccaagacgatgggagaagttctaggtggctcatccttggctaaaaaaacatagcctgagctacctgacactggttgctagtgtgagctatctgagactctgcctcacaaataattaagtaaaaatatggtagattcatgacgacagcacctacagattgcctgtcctgtgctgggacacagggcagcttcacactaaccctgatgggaacacctgggagacgacatgcttgttgcaaggcgctggctcatctgagaccaaagcgacttcaggagccaagtagaccagaatccgtgtgcttcagacagtgggaagggcatacagaaacctcaggaactgaggcacagcagggagatgggaggctgggacaagggaccactgacagacaccatacatcataccatcttgtccctctgaatctccatgggcaccccctctgggaggactccaggactgcaagcaaaggttaactgagtcagccaattcaaccctggcctagggggtggaggcagggggtctatcagcgcgaggagacaggacaaggacactcatgtattgccatagggatggctctcttgtcaaaccatcagaacacccacaaacatcccggctcacaggggtctgcaggggtagggctgggatgtggcccgagacttgtgggaactgaggaatgtagtggcaaaagtttggccaagggaagaccagaggactctgtatgcatgaaggccagggtgatgacatttcaggaaagaaaagcacagaatcaagcatggtaggtagttggaaagtggaagcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacatttactaagcccctccctgccaaagtaagcaataaattatggctaagagtctccccactcctaagatggaaagatgccaagctgcaaaggagatcctgacaacagaccagctacttggaagactcagaacctagccaagctgcctgcaagaggtttagaccaactaagacatctggagagagcaccctccaatctgtggagcagtcttcaggctctgcagggtgctccaggctcccagctttgtaagctgtcactcatgctggggcgggcttgggtgacgcagctgtctttgagtgacttctcccgtaagtcacccctcacccatgcacactcctgtaagtaactctaatagaaaattcatcggttcagcaaattggactttggtctcttctgagctggctccctgtctagggtgaatggacatgtgtgtgtggcatctcccctggaaaagttttctttccctaggcttggcctggggtctcccaggctttttgcagttgctggtggcatccttcttagtgggtacttaagaatcaggaccctggccagcgatgcagcagccgttggcagagggctcccctagcatgcaggaggcccctggattacatccccagtaataaaccaggcctggcgacaatatagaggtgagagcaagatgttcattgtcatccttgggtacatagtaaattctagtctttgttttaaaaacaaacaaacaaacaaacaagcaggacataagatcagatatgcctggcatggtggaaggtgcctttaactccaacactcaagaggtagaggtcatcctggcctacagaatgaattccaggccaaaggtggtacataatgagaccccatctcaaaaacagacagagaaaggaggagggcaaagggtagaaagaggaggggatgttcacaatagggggaggggatgttcacaatacgtgtatatatattctttccttctggatgtggatagaacccaggacttcacacatgctagacattcattccactttaagctacattcccgccctcacatccccttttgtttaaatcattaatattgatattattattattattattattattattattactacatatgagtactggttgttttctgtctttgcatgcatgtggagatcagagaacaatttttaggagtcatttttcttcttccaccgtgagtcccagggatgggactcaggttgtcaggtatgtgtagcaagctcctttacctgtgaaccatcttgctggggctgatacctgctgattgctaaacacatgccaccgattatattaatgcactagtattttatttatttatttttcgagacagggtttctctgtgtagccctggctgtcctggaactcactctgtagaacaagctggtttcgaactcacagagatctccctgcttctgctgggattaaagatgtgtgctgctgccgcagctgccaccaccaccagacaccaccaattattattgttcaattattattgtatacacactttcttttctgtctcctgagctaagtgggaaggagaggcttccaacaccatcaagcctgaagaactcaccgggtgtgggttcctacctgctccaattctgcaggtcccccagattcagggacccggaaaagccacctatcctttgcttagctatgagtactgaagttttagatcagggagggagcacattttccaagctcaccgagtcacacagaatccgtgacaaagctagtggggaggggactgcatccttacccatccctacacctggggatatcacagactctccaattccccctgagcctcagtttccccacctagactgattatacccctctcgccagaatctgcactggggaccttgctctttttcaccagcaggggcgctgcaccggtttggggagggtggggtcccaggggtataagcagacctgggatctggagttgcaccttctccaacccgggtcagcaggggccttctgagggagtttaggcgcctgtcaatctcagcctccgggacagcgtggaactgcgcaggcgcgggcgggttccgcacagcgcaacagcgggcgcgcgcgggagcgagggattccctctgacgtaattgctaggataccaaacaaacactgggccgcgctggccgagctccttatatggctaattgcgtcacaggaactccggggagggcggggcgggatcccctcccgcgaagcccctcagaacgcagccttggggacccccgagacccccagggtcacactatgggcaggtggcaggtgcacgaggccctggagggcgccacaaggagctcagtcggcgggaagggagagtttgggaggtttgtgcatggagttgcgggtgacgcaagcgcggggggcgggtcccggaggcataaattcagcccggcagctcccggtttcattcataagactggagcggctacgccggggacacgcggagccggggcttgctggacttgactactggtgactctttctttttcttcttcttggaggccgtgaaaaatttatatatatatatttatatatatttttaaactggagagaaagttttgtgggtttcctttttgcaagactctttctagatcgttcttccgattcgtccggaggatagactttctttctgtgggcttctggatcgcgcccctctgctctccctcatttcttgggacgcttcgacaggattggaactgcatctgaagcgcacgctgcaccgcggcactgcccggcgggtttctgggcggggagcgatccccgcgtcgccccccgtgaaaccgacagagcctggactttcaggaggtacagcggcggtctgaaggggatctgggatcttgcagagggaacttgcatcgaaacttgggcagttctccgaaccggagactaagcttccccgagcagcgcactttggagacgtgtccggtctactccggactcgcatctcattccactcggccatagccttggcttcccggcgacctcagcgtggtcacaggggcccccctgtgcccagggaaatgtttcaagcttttcccggagactacgactccggctcccggtgtagctcatcaccctccgccgagtctcagtacctgtcttcggtggactccttcggcagtccacccaccgccgccgcctcccaggtaagttctagatcgtaaagattctactttagtggttgggggggggtgtttctttcaggctaaagtgtagattgagcatcctctcaaatagagacgcgccaaaacccaggatctgggattgcaatagttcggtttgcactttggttttttgttgtttgcaaactgcaaagaatggagtgatgtttgcaaaaggttatttgcgcggagcgcgggaaaggaatgcagctgggcaaacgttggcgatgcccggtgcaaagtatatacccggtggttagcagaagctgagaacttttagccgaaagccggctccctaagccgaagctaggcaagtaggggaagaaaaagaaacaaaaaattccagagaagcttccaggagcctcctcctcttccctcttccttcaaaacgcggactgcaagtccgcagtcaccctccacccagcaagagttagggcctcgaaccccggtcacgctgcctccgcctcctgcgcggagacgtaacgggggacccgtgcgtaaaggctgacgcgctggaatcctccgtctgacgcggggcacgcacagcgcgcagcgccccctccgcccgccccgcccctgacgtcccgggcacgttctattttggaacgccgaggccacgttgctaagggagggggcagcgtggctttgtgattggctgtcgcggcgcgagctttagccaatcagcgttcccttcctatttgtagagcgtagctcccttccttgctttttgtggttcttcccgtgctgggggtctccaagagggagagctaggggattcttgtcgcgatcgggggactcgttgtcaccccatgggtctgcgaggaccttgtgtggacctggtcctgttgtcataagctagaggcttttggctgagtgttagcgcctctaagggggaactgaaggcctcatcccttctccaggcacacatatacgtgctccctgagctctagacactcagtccttccgaggtgttcaaacactagatgagctagcctacggagaggcagccaggtggtctctaaaaggtccgccttcccttagttcccagggctctgattggccagggattcagcccttccctcgccacgccccctagagtagttaagcctctaggattccacttgcgggaaggggggggggggcgtgatggacgcttcttgggttcggggacgcagatcctatgtcaccccatcccctgcaagacagtctgagagattctcgctgtcacttttctctgcctatcagttcactgaaacctgtcagtctcactggggaagagacagacactcggaagggatgctctcaactcttaggccggtcccccaacaccgttggaactgggatctccgcccctgcgggagccctcatgcagtggggggtgtgtttgtgtgtgagtggaggagaggaaggcttgggctaaggcctctccctctccctacctactgtggtgggggtggggtgttttggctgtatgtgtgtgtgannnnnnnnnnnnnnnnnnnnctgacttgaagggggtagtgtgtgtacatttttctttttgagacaggatctcactgtataggccagacaggcctggaactcaatctgtagactaggctggtctcgaactcacagagatccacctgtgtctgtggctccagtcccgggattaaaggtttgcatcaccaggttctgtccagcctccgtctcccacccacccccccacacctaagagtcaccaacccggggtgtgattcaccacccgctggaaccgtgcaacctttccccgaggaagaaggaggaggtagaaggcagttgaacagaatctctcattaaccactgcgtcacggtgtagtggaagggtgggtgttgtggctttttgcctgtgacacacacatccacacccgctcaccctgtgctcactcacaggggtcggtgtgtgttatgtgtgttgggcgtgtgtgtgtcggtggctttgtttgtgtgtctacgcctgtgtgtgtatgtctcaccccgtaggagtgcgccggtctcggggaaatgcccggctccttcgtgccaacggtcaccgcaatcacaaccagccaggatcttcagtggctcgtgcaacccaccctcatctcttccatggcccagtcccaggggcagccactggcctcccagcctccagctgttgacccttatgacatgccaggaaccagctactcaaccccaggcctgagtgcctacagcactggcggggcaagcggaagtggtgggccttcaaccagcacaaccaccagtggacctgtgtctgcccgtccagccagagccaggcctagaagaccccgagaagagacagtaagtatgaggcctcaggagttgggatggaggagcctagctagggatgtgggctcagtttgtacagtgcttgctgccatgcatgaagatccctagcacagcataagccaggagtggttatgcagacctgtaaccccagctctcagaaggtggaggcaggaggagcaggagttcgaggccagcctgtgctacttatggagtccagcctgcactgcaagagatcattattttcaaaagttggccttggggggaggtgggtgagggaagtaagagaaagtgacagtaattttatcacttaatagttggaggttcctctgaggcctcaagtctgaaggaactttaccattctggccagtgaggagtaggggttattatttggggttcaggaggaaggagttttcttagggctgatagaggtacccccagatctcatggtccttatctctgactcagcttaccccagaagaagaagaaaagcgaagggttcgcagagagcggaacaagctggctgcagctaagtgcaggaaccgtcggagggagctgacagatcgacttcaggcggtaaggaggagtctgggggtgtcttgaggccgtgctgggagcactctgccttgttcttcccccgtttctcactgtgcctgtgtcctaaacgaggaaaccccctcttagggaacaggggtcagtataggctgatggagtggctccatatgcatgctcagacccatgcccacttactttcgactgttccccactttccctgaatatgtccccacatgtcaccctcctggctttctctcagcctaaggagacaagctggaggaggtaattctctcaccttctttccttcactaaataataatccattttgccttcctgcctccatttttttttcctgagctggggatctacctgtgtagttcagccctcctcccccaacttgatagcctcaagtttcagcccttggctgagatgccatcatcctgactggctctggctggaaactattttgtgctaagtcaattccttacctgctactccagctatctacagttctgccgaacttgagctggtggcgcccaccaagcccacttctttctctcttctacctcagtgcaacccccacacacacacacacacctcatgcctgccccttgaaaccagggtgtgtctctgatttcccgtcgggaggctgaaggagatgggtaacagaacctcattaaaaacaacacataagcattacctactgactcaacaaactgtagtgtttttcttttttcctctcaaaaaattatttcgtttgtttatttattatttgcttatgtttgagtgagtgctggtgcaccacagcacacatacgaggtcagagggaaattttcatagtttgttctctccttccgtgttgtgggtgcttgctggcaatctccttcactcagtgagctacaatgcccccttctgccctttaaggcagagtactccttagtacagggggaccctttcctcggcctctcaaagttgagattacaaatgttcaccatcacaccaggcttggagttcttgcctatcagtgacgtccactcctgcctagcttcttcccaaccatctcttagtctgatggggaaaccgaggcacgagtagcatggtctaccaggatttcctcttaggggacggtcccctcagttgggagggagctgtccagccccctggatcagcagcaagaatgtatgagtgtggggttgggcgggtgaagctactctgtgtggtcgctgaccagcaattctcctttctctgtctcctatgacctggccctgctgggatccattaggaaactgatcagcttgaagaggaaaaggcagagctggagtcggagatcgccgagctgcaaaaagagaaggaacgcctggagtttgtcctggtggcccacaaaccgggctgcaagatcccctacgaagaggggccggggccaggcccgctggccgaggtgagagatttgccagggtcaacatccgctaaggaagacggcttcggctggctgctgccgccccctccaccaccgcccctgcccttccagagcagccgagacgcaccccccaacctgacggcttctctctttacacacagtgaagttcaagtcctcggcgaccccttccccgttgttagcccttcgtacacttcctcgtttgtcctcacctgcccggaggtctccgcgttcgccggcgcccaacgcaccagcggcagcgagcagccgtccgacccgctgaactcgccctcccttcttgctctgtaaactctttagacaaacaaaacaaacaaacccgcaaggaacaaggaggaggaagatgaggaggagaggggaggaagcagtccgggggtgtgtgtgtggaccctttgactcttctgtctgaccacctgccgcctctgccatcggacatgacggaaggacctcctttgtgttttgtgctctgtctctggttttctgtgccccggcgagaccggagagctggtgactttggggacagggggtggggcggggatggacacccctcctgcatatctttgtcctgttacttcaacccaacttctggggatagatggctggctgggtgggtagggtggggtgcaacgcccacctttggcgtcttgcgtgaggctggaggggaaagggtgctgagtgtggggtgcagggtgggttgaggtcgagctggcatgcacctccagagagacccaacgaggaaatgacagcaccgtcctgtccttcttttcccccacccacccatccaccctcaagggtgcagggtgaccaagatagctctgttttgctccctcgggccttagctgattaacttaacatttccaagaggttacaacctcctccgggacgaattgagcccccgactgagggaagtcgatgccccctttgggagtctgctaaccccacttcccgctgattccaaaatgtgaacccctatctgattgctcagtcttgccctcctgggaaaactggctcaggttggatttttttcctcatctgctacagagccccctcccaactcaggcccgctcccacccctgtgcagtattatgctacgtccctctcaccctcacccccaccccaggcgcccttggccgtcctcgttgggccttactggttttgggcagcagggggcgctgcgacgcccatcttgctggagcgctttatactgtgaatgagtggtcggattgctgggtgcgccggatgggattgacccccagccctccaaaactttccctgggcctccccttcttccacttgcttcctccctccccttgacagggagttagactcgaaaggatgaccacgacgcatcccggtggccttcttgctcaggccccagactttttctctttaagtccttcgccttccccagcctaggacgccaacttctccccaccctgggagccccgcatcctctcacagaggtcgaggcaattttcagagaagttttcagggctgaggctttggctcccctatcctcgatatttgaatccccaaatatttttggactagcatacttaagagggggctgagttcccactatcccactccatccaattccttcagtcccaaagacgagttctgtcccttccctccagctttcacctcgtgagaatcccacgagtcagatttctattttttaatattggggagatgggccctaccgcccgtcccccgtgctgcatggaacattccataccctgtcctgggccctaggttccaaacctaatcccaaaccccacccccagctatttatccctttcctggttcccaaaaagcacttatatctattatgtataaataaatatattatatatgagtgtgcgtgtgtgtgcgtgtgcgtgcgtgcgtgcgtgcgagcttccttgttttcaagtgtgctgtggagttcaaaatcgcttctggggatttgagtcagactttctggctgtccctttttgtcacttttttgttgttgtctcggctcctctggctgttggagacagtcccggcctctccctttatcctttctcaagtctgtctcgctcagaccacttccaacatgtctccactctcaatgactctgatctccggtctgtctgttaattctggatttgtcggggacatgcaattttacttctgtaagtaagtgtgactgggtggtagattttttacaatctatatcgttgagaattctgggtggaaatgtctgatcaggagaagggcctgccactgccgaccacaattcattgactccatagccctcacccaggctgtatttgtgatttttttcattttgtttttttgtattttgcacctgaccccgggggtgctggggcagtctagcactgggcagctcccctcccccccttggttctgcactgtcgccaataaaaagcttttaaaaaactgtattcttcaggtcaaagtgtctgttttccctggacatctactacatggcttcctttcagaaaaacggagtttggattgctagggaggtcttgctggcacttagtgggacgcctaatgaatcagaacctacaacgggactaaaaggaagtggagacttgctaggttttcccatgttcccaggctgggccacctacttgaaaaaataaggggcggaaaagtgtaaggtacaaatttggtgaagggtctggaagacttcatgatcggaaaagaatttattcaccttgggtgtgcaatgacttcagcaacagctaagggcaaggtgtaaaagctgggcacacttgtaaatcctagcatttgagaggtggaggcaaggggatcactggtggagttcagtgtcatgtggatcgtagataccaagcgcaaagatctgctatggggagagggcttggtacaccaggggagccagaagttcgtggtgagggtagtggagggcaggtggagagtgagagttagcctcagggagattctacaggcaatgatgcagagttcagacgctcctttgaaagcactagagagccgcagcaggttttgagcagagaaggttagcgttaggtggtctcttctagcccatcccaggctgaggaggacgctgagggtttcaagaaggatcgagaatggaaagcagaggagaaaaaggatccaagaggcatggaggaggcagaacacatttctcttctttaatagcaagcctggaaaggataacttgctgcaggaggagatgctcaccagtcgggtggtctagggggttcttggaaaagagaaggcatttgctcaagcctcggttcccccattctcgctcttctgtcagcttgtcttccattaagtgtgtgtctcaaggccaccctgctcaggactccttgtgagacgaccttctatgctcgagttcattaaaaacacaattgcctggtgccctgctctctccactggctcagttacctcaaaagaccagggctaaaggtgtgatcacaactctatccccattactgctccaacgcagagacaggactgagccggagtgaacaaatgaacaaaaatgactaataatgcatgcgtgattaaatacataaaagagcagatgactggatgagcaaatcgtttaaggagagacagcaagatcctagaattttggagactaatttaaatccatctttgagatgtatttggtcggaaattcctgggaggaaaaaaagtgtaagtatgaagagagaataaatgagaataggggtggcttcagagaggttaactgcgcgctggtcgcttttgtacaagaatgtgaattgcagggagcaaaatgggatagatactcccgcccgaaaggtggaattgaaccactctgtcgctaaacagctacaggtttgaagcctgcaccccagaccactgaggatcatccgggcgaaaggagctattttcggttagttatataaaggccagatactactacttttttcacttatggtcattatttgtggtatacagtagataattaatttcaatggtttcgaacattttttttcactttttcttgtgaacatgtgtttcctcagtaaagtgttccgtgaatgactctactaactaaaaagtaagtagcttcatttgcatagcgccttgcattctgggaagcagcgcctaaagtgcctgtctccctaactaaaagcagaattttttgcaaagtgaaaagtcagttttatttttgtttgtttgtttgtttgtttgtttttaatggaaaaacttctcacgcggcccattcgtagcagaattcgagattttctgcaagcgagaccgtagggtctgacggcacgcggccgcagagcgacacctgccgttgctttatagaactgcaagtatgtagggaatctactgagtccctaaggtgatggagttgacaaccaactccccttgcgtttagacgctaaaaaccatccctttttatatctatgtgattagcccagggaaactaaggctcagacatggataataccacagccgagttcctgtagcccaactccctaggggaaatgaaacctacagttgtggttttaatatgcttggcccaggggcagtggccctattggcaggagtggccttattagaggaggtgtaccttgttagaggaagtgtgtcacttggaggcgaggttttgaggtacgtatgctcaagtctggccagtgtgatcctggctgtctgcagaacgcggtctcctggctgccttcggatcaaggtgtagaactctcagctccttctccagcaccatgtctgcctgcttaatgctttgcttctttccatgacgataatgaactgtgcctctgaaactgtaagtcaaccccaattacacaattacatgttttcttttataagagttgcatatatatatatatatgtcacactctttagctctggctggcctgaaattcactatgtagcccaggattgcctgaactttgaagcaatcttcctgcctcagcctcccaatggtattacaggcatgagtcacaacaagccatttaaatcttatgatgacttataagaagacagaaaatcagagttcctttacctagttcacagatccctacaatctaacctcgttcgctccataaacagccctaccccaccctcctggaactgctttgaggaatgctgcaggctctcacaggcacactcctccttggttaatctcttcagcctggttgccttccctccccatgtccatgtggcccaaagcctctcatcctgttctcaaataccactagctagtaaggcctccccgacctgaccccggtttaaatattagaaaagggtcactttctcccctgccacagacaaccaaaccaccatatgcttgtcacttactacctgactatgaaggtgaatagatgtcttcacaacctttctctgagcctcagtttccccacctgcataatgcatctgagacacagaattccctagagctgtggttctcctcattcctagtgctgggaccctttaatacatttcctcatgttgtggtgactccaccaccaccataaaattattttcattgatacttcataactgtaattttttctattgttatgaatagtaatgtaagcatttgtgtttcccagtgatcttagatgaccctgtggaagagtcattccacccccaaaggggtccccaccacaagttaagaattcctgccatagaggaatcacaaggaaccaatgaattacactttgggtcgacttttgggctggcctctgggaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggattacaaacatgtgccaccaagtctggctgcccattatgcatttctgtggcaggcgttgatggctattaaacccaagccttgtatatactaggcaagtacccatccactgaactacagccctagcatggacctcacagggcaatggcctgacatctgggaaacactatcacagagtataataataaaaccgtagcatgcttttcagattgagcatttctgctgggtcacacttggaaaaccttcttattgttatcatgagtatgtgtgcatacatgtggaggtgagaggatgacgtcatagagacagctctgtctcccattctttattgccaatattattttatgttttgtctgcgtgtatgtttgtataccaaagtgcatgcagtgcctgtagagaccaaaagggggcatccctgagactggagttagaagtggctgtgaaccactcactctgtgggtgctgggaatcaaaccccggttctctggcagagcaactggtgctcttaaccaccgaatcaacttctccagccctgcattgctttaatcttttggtcgattcccccaatccaactcataccgccaagtctgagtagcaagtgcctttatctgggagactcactgatcttatttttttttcctttctttttctttctttttttctttttttttttgagtcaggtatgattatttagatggcctcgaactcacagagatccacctccctctgttatgccaggcttttaaaaaacaacatttatttttgaatgcatatatagggctgtgcaaacacagcctgaaggagtcgtttctgattgctcacaacgtggttccagggatggaacgcgggtgaccagcttgaaggtaggtgctttcaccagccccaagaatttattttttaactttatttttttaattaaatgattaaatgacacatgttcattgtgggtagtgcaggtatgcgatggagcacatgtagaggtgacattactgcaggcggtctctctaccatggggattcaactcagaccactgcttcctttaccagatcatcattcttgcatcccccaatcatttctttttgttgatggttttgtttgtttgttttagttttggggggtttttaaagtttttttcgagacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaggcgtgtactaccactgcctgggcataaccggcctttctgccttatttgtttcgaaacggagtctcatgtagcctgaggtggcctcaaacatgcaatgtagctgcagctgggattacatatgttcaccaccacaacctgttttatgcactgctaagagattaaacctgggccttcgtgctaggtaaggactctattaacagagctacaacctctgcctggtttttagtttttcagacagggctttgcgacatagccctaactggccttgaacatgcaatgatcctcctgcctcggcctcctgggtcctcagattgttgatgctacacccacatatctcagacctgagggttggcagcttgggccatgctctgatttgggagtgacatattaacagtagtttaatacgaatttgaatccaccttacttttttggtggcactgacattgaactcatggccttccacaggcttttacgtgagaaatgttttacctcccttccttgagccatgagcgagcccctcactggtggagtctatgcagctggtctgaaactcataccatcttcctgccccactctccgagtgctgagtgtctacagagctcctgactctgcctgggacgtgatgtctgtgggaccttggctatagaagggaggcagtcacaccacccatttttggcttccatgtcggcaatggagagcttgccatactcacctgatgttgtctgtacagaagggggacggtaaacaaagcaaccactcctacagatgcagagagagagatgggggatggggggtgtcaggttctcctggcaaagggtcagctccgttgagggcttttccactcccgaccaaattcccaaaataacgactctgagactcaatatttcatgaacaaatgcttgggctagcttgggcttgttccctgacaagcccctatctcatttaacccgtttattctattctatgaatgccacatggctggttacctcgtctcagtttcatgagaccctctcatcagcactagggcaaaccctgattctattactctcttcctgcaggagctcgggccccctatttcctccctaagctaatagcccaacagcttttgattgacaggtgatgcttccacacagtgcacacgaagattctctttaccctccatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttgtagagagggctgaggtcaagtttaagattaggaaagagaatcaagaattatcaaggataaagggagaggtcaggatttacaggggagcagggttcatggtcagaatgaaaatggatgagagagggcaatgcgtgagctgaggtcaagggtcacaatggacggtccgtcggcgggggctgggcagggccaagcattctcactggaaagggttggtgccgtcgccccggtgcacggcctgcagcactttgcggtaaaccctgagagagatggtggcgcagagacccaacagggccaggtgcgcagccacggacacgatgctaaagtgcaggaggcagaggagagaggccatgaggcccgtgaagaccgctcccgacgtcctggtgtccttccagtacaacaggtctgccactgtggaaaagaagacaatgttgggacccgacctgaccaagctcactccctttctgtttgttttttagagataaggtctcactatgaagctaaggctgacttcaaactatgaaaccctggctggtcttgaactcctgattattctaattcatcctttctttttcttagactgagttaagtttgaccggcttcaaactcaagacaaatactcctgcctctaccctttagtgcttcaaggaggtgctaaggatcaaatttagggcttcatgcatgctaggtaaaacccaactgagctacttccctgac

SEQ ID NO: 966 - DNA, 4145 bp, Mus musculus
  misc_feature (4045)..(4045): "n" at position 4045 can be any base
ataaattcttattttgacactcaccaaaatagtcacctggaaaacccgctttttgtgacaaagtacagaaggcttggtcacatttaaatcactgagaactagagagaaatactatcgcaaactgtaatagacattacatccataaaagtttccccagtccttattgtaatattgcacagtgcaattgctacatggcaaactagtgtagcatagaagtcaaagcaaaaacaaaccaaagaaaggagccacaagagtaaaactgttcaacagttaatagttcaaactaagccattgaatctatcattgggatcgttaaaatgaatcttcctacaccttgcagtgtatgatttaacttttacagaacacaagccaagtttaaaatcagcagtagagatattaaaatgaaaaggtttgctaatagagtaacattaaataccctgaaggaaaaaaaacctaaatatcaaaataactgattaaaattcacttgcaaattagcacacgaatatgcaacttggaaatcatgcagtgttttatttaagaaaacataaaacaaaactattaaaatagttttagagggggtaaaatccaggtcctctgccaggatgctaaaattagacttcaggggaattttgaagtcttcaattttgaaacctattaaaaagcccatgattacagttaattaagagcagtgcacgcaacagtgacacgcctttagagagcattactgtgtatgaacatgttggctgctaccagccacagtcaatttaacaaggctgctcagtcatgaacttaatacagagagagcacgcctaggcagcaagcacagcttgctgggccactttcctccctgtcgtgacacaatcaatccgtgtacttggtgtatctgaagcgcacgctgcaccgcggcactgcccggcgggtttctgggcggggagcgatccccgcgtcgccccccgtgaaaccgacagagcctggactttcaggaggtacagcggcggtctgaaggggatctgggatcttgcagagggaacttgcatcgaaacttgggcagttctccgaaccggagactaagcttccccgagcagcgcactttggagacgtgtccggtctactccggactcgcatctcattccactcggccatagccttggcttcccggcgacctcagcgtggtcacaggggcccccctgtgcccagggaaatgtttcaagcttttcccggagactacgactccggctcccggtgtagctcatcaccctccgccgagtctcagtacctgtcttcggtggactccttcggcagtccacccaccgccgccgcctcccaggagtgcgccggtctcggggaaatgcccggctccttcgtgccaacggtcaccgcaatcacaaccagccaggatcttcagtggctcgtgcaacccaccctcatctcttccatggcccagtcccaggggcagccactggcctcccagcctccagctgttgacccttatgacatgccaggaaccagctactcaaccccaggcctgagtgcctacagcactggcggggcaagcggaagtggtgggccttcaaccagcacaaccaccagtggacctgtgtctgcccgtccagccagagccaggcctagaagaccccgagaagagacacttaccccagaagaagaagaaaagcgaagggttcgcagagagcggaacaagctggctgcagctaagtgcaggaaccgtcggagggagctgacagatcgacttcaggcggaaactgatcagcttgaagaggaaaaggcagagctggagtcggagatcgccgagctgcaaaaagagaaggaacgcctggagtttgtcctggtggcccacaaaccgggctgcaagatcccctacgaagaggggccggggccaggcccgctggccgaggtgagagatttgccagggtcaacatccgctaaggaagacggcttcggctggctgctgccgccccctccaccaccccccctgcccttccagagcagccgagacgcaccccccaacctgacggcttctctctttacacacagtgaagttcaagtcctcggcgaccccttccccgttgttagcccttcgtacacttcctcgtttgtcctcacctgcccggaggtctccgcgttcgccggcgcccaacgcaccagcggcagcgagcagccgtccgacccgctgaactcgccctcccttcttgctctgtaaactctttagacaaacaaaacaaacaaacccgcaaggaacaaggaggaggaagatgaggaggagaggggaggaagcagtccgggggtgtgtgtgtggaccctttgactcttctgtctgaccacctgccgcctctgccatcggacatgacggaaggacctcctttgtgttttgtgctccgtctctggttttctgtgccccggcgagaccggagagctggtgactttggggacagggggtggggcggggatggacacccctcctgcatatctttgtcctgttacttcaacccaacttctggggatagatggctggctgggtgggtagggtggggtgcaacgcccacctttggcgtcttgcgtgaggctggaggggaaagggtgctgagtgtggggtgcagggtgggttgaggtcgagctggcatgcacctccagagagacccaacgaggaaatgacagcaccgtcctgtccttcttttcccccacccacccatccaccctcaagggtgcagggtgaccaagatagctctgttttgctccctcgggccttagctgattaacttaacatttccaagaggttacaacctcctcctggacgaattgagcccccgactgagggaagtcgatgccccctttgggagtctgctaaccccacttcccgctgattccaaaatgtgaacccctatctgactgctcagtctttccctcctgggaaaactggctcaggttggatttttttcctcgtctgctacagagccccctcccaactcaggcccgctcccacccctgtgcagtattatgctatgtccctctcaccctcacccccaccccaggcgcccttggccgtcctcgttgggccttactggttttgggcagcagggggcgctgcgacgcccatcttgctggagcgctttatactgtgaatgagtggtcggattgctgggtgcgccggatgggattgacccccagccctccaaaactttccctgggcctccccttcttccacttgcttcctccctccccttgacagggagttagactcgaaaggatgaccacgacgcatcccggtggccttcttgctcaggccccagactttttctctttaagtccttcgccttccccagcctaggacgccaacttctccccaccctgggagccccgcatcctctcacagaggtcgaggcaattttcagagaagttttcagggctgaggctttggctcccctatcctcgatatttgaatccccaaatatttttggactagcatacttaagagggggctgagttcccactatcccactccatccaattccttcagtcccaaagacgagttctgtcccttccctccagctttcacctcgtgagaatcccacgagtcagatttctattttttaatattggggagatgggccctaccgcccgtcccccgtgctgcatggaacattccataccctgtcctgggccctaggttccaaacctaatcccaaaccccacccccagctatttatccctttcctggttcccaaaaagcacttatatctattatgtataaataaatatattatatatgagtgtgcgtgtgtgtgcgtgtgcgtgcgtgcgtgcgtgcgtgcgagcttccttgttttcaagtgtgctgtggagttcaaaatcgcttctggggatttgagtcagactttctggctgtccctttttgtcacctttttgttgttgtctcggctcctctggctgttggagacagtcccggcctctccctttatcctttctcaagtctgtctcgctcagaccacttccaacatgtctccactctcaatgactctgatctccggtntgtctgttaattctggatttgtcggggacatgcaattttacttctgtaagtaagtgtgactgggtggtagattttttacaatctatatcgttgagaattc

SEQ ID NO: 967 - DNA, 1017 bp, Mus musculus
atgtttcaagcttttcccggagactacgactccggctcccggtgtagctcatcaccctccgccgagtctcagtacctgtcttcggtggactccttcggcagtccacccaccgccgccgcctcccaggagtgcgccggtctcggggaaatgcccggctccttcgtgccaacggtcaccgcaatcacaaccagccaggatcttcagtggctcgtgcaacccaccctcatctcttccatggcccagtcccaggggcagccactggcctcccagcctccagctgttgacccttatgacatgccaggaaccagctactcaaccccaggcctgagtgcctacagcactggcggggcaagcggaagtggtgggccttcaaccagcacaaccaccagtggacctgtgtctgcccgtccagccagagccaggcctagaagaccccgagaagagacacttaccccagaagaagaagaaaagcgaagggttcgcagagagcggaacaagctggctgcagctaagtgcaggaaccgtcggagggagctgacagatcgacttcaggcggaaactgatcagcttgaagaggaaaaggcagagctggagtcggagatcgccgagctgcaaaaagagaaggaacgcctggagtttgtcctggtggcccacaaaccgggctgcaagatcccctacgaagaggggccggggccaggcccgctggccgaggtgagagatttgccagggtcaacatccgctaaggaagacggcttcggctggctgctgccgccccctccaccaccccccctgcccttccagagcagccgagacgcaccccccaacctgacggcttctctctttacacacagtgaagttcaagtcctcggcgaccccttccccgttgttagcccttcgtacacttcctcgtttgtcctcacctgcccggaggtctccgcgttcgccggcgcccaacgcaccagcggcagcgagcagccgtccgacccgctgaactcgccctcccttcttgctctgtaa

SEQ ID NO: 968 - DNA, 27184 bp, Homo sapiens
cactaagcactctcaccacccaatgcctggagtggttgtagtcagtgagtgacacattgcacagtgtgtgccccctggattgggggtgggtgagagacagcccccacagtgagtggcacccctggccagggcctgggacaagtctgtatccaagggtggctctctgcttaggtctgtgtttgtacctgggtgtgtctgtgtctgccctactctgtgcatactcatatatgtgaacccgtgtgtgtgtgtgtagttgtgagtgtgtgtggaagaggctgcatggcagtggaagctaggtgtgtgattcgtgtatctgtgtgcctagagtgccttgttctatagatttggatgccactccaagcaagtcagtgggtctttttgttttttgttttttgagatggaatctcactctgttgcccaggctggagtgcagtggcacgatcttggctcactgcaacctctacctcctgggttcaagtgattctcctgcctcggccccccgagtagctgggattacaggtgcccaccaatacactcagctaatttgttgtatttttagtaaagatggggtttcaccatgttggccaggctggtctcaaactcctgacctcatgattctcctgcctcggcctcccaaagtgctgggattacaggcatgagccaccgcgcccggccaagtcagtgggtctttaggagctgtttcgtacggtgtgactgtgagtgaaccttcgcacacgtgtctgtacggatatctaagaaattcttcaagtaggccgggcacagtggttcaggcctgtagccttagcactttgggaggcccaggtgagtggatcgcttgagctcaggagttcgagaacagcctgggcaacatagtgagacttcgtatctataaaaaatatgaaaattagccaggcatgacagtgggcacctgtagtcccagctactacttggggggctgaggcaggaggatcccttgagcctgggaggtggaggctgcagtgagctgagatcgagccactgcactccagcctgggcgacagagggagaccctgtctcaaaaaaaaagaaaagaaaagaaaaaaagaagacattcttcaagtccacaactctgagggtatcactgtgagagcaggggtcctagctctacccatttgtgtgtgtgtggagatgtgtaagtctatgtagacaaaagtgtgtgtcatttactgtgtttggggtgtgaacacctatgtgatgtgtttgcacaactgcacgtgttttgttctgtgtgtgtgatcgtgtgttcaaataagtcatcttgtcgccgggcgtggtcgctcatgcctataatcccagcactttgggaggcctaggcaggaggaccattgagcccaggaggtccagactgcagtgagccgagattgcgccactgcactccagcctgggcgacagcaagaccttgtctcaaaacaaaagcaaaaacaaaaataaacaaatagtcatcaggtgcctgcacagacaaaggtgaaaggtgtctgcctgttgagatctgtggatagggtgtatatatggacatctcagcctgtctacgtgtgtatctgtctctgtcctcacggcaaaagagaggttggccgggtgtgtggtggctcacgcctgtaatcccagcactttgggaggctgaggcgggcggatcacctgaggtgaggagttcaaaaccagcctggccaacatggcgaaactccatctcttctaaaaatacaaaaaaattaaccgggcgtggtggcacacgcttgtaatcccagctactcagggaggctgaggcattagaattgcttgaacccaggaggtggaggttgcagtgagccaagattgcgccactggactccagcctgggcaacagaacaagactccgtctcaaaaaaaaaaaaaaaaaaaaaaagaggctcagatatgtttctgtctgagagtctgtcagagtttaggaattagtaaatgaatgaatggtgaagatccatttactcaacaaacatttatttatttatttatttattgagacagagtctcgctctgtcacccaggatggagtgcagtggcgcaatctcggctcactgaagcctctgcctcctgggtttaagagagtcttgtgcctcagccaccaagtagctgggattacaggtgtgtgccactgcgcccagctaatttttgtatatttagtagagatggggtttcaccatgttgcccaggctggtctcgaactcctggcctgaagtgatctgctcacctcagtctcccaatatgctgggattacaggcatgagccaccagtcctgcctcatttattcttatattatattatattgtttttattttaaatttttttgtagtgacagggtcttactatgttgactgggctggcctcaaactggcctcaagtgattctcctgcctcagcctcccaaagtgctgggattacaggcatgagccactgtgcctggcttgaacaaatatttaataaccacctattgggtaccacgtgctatgctggggacaaggcagtgaccgggatggttttggccgagctttcacccagctcacaacccaatgagggagacaaacctatccccagacaatgatgagcccagattggcagagttggagggagggaccccaggagagggggccttgactcagcctggagatcagggagggcttcctggaggagaggttatgggagttaagacttggaggaaaagactatgagccacaggaagcgaagggaagagtgacccaggcagagggaaaagcacctgcaaaggcctgaagtccagggagagaggccaggcatctggaacacaacggggagaggagagacgagactagggcaccctcggagcaggtcgttcagggcctcaggagccatggggaggagtataatgcaggatgcaggggtactgggagggtcaagctaacagtgtccaatctgggttactctgcttccctgaaactccagggacatctcctccaggaagccctagggattgctcagtgtggagcggctcagccacccagtcacactcactattcaatgctgagcactgaggaggcagccgttactaaatcagcctggatttgccctcccagaggtcacagtcacaacagtcaaacacacacctgcacgtgcacactcatgaacgtgcccctcccctcctctggagcctcagaaacccacagaccttgttcctcccagggggtgtccctggggccaaagcttctgcactaccagggggcttgttggaaatgcaaaagatggctgggcacagtggctcacacctgtaatcccagcagtttgggaagctgaggcaggcagatcatttgaggtcaggagttcatttgaggttgggagttcaagaccagcttggccaacatagcgaaactctgtctctactaaaaatacaaaaaaattagccgggcgtggtagcacacgcctgtaatcccagctacttgggaggctgaggcaggagaatcttttgaacccgagaggtgaaggctgcagtgagccaagatggcaccactgcactccagcctgggtgacagagtgagtcttaaaaaaataataataaaataggctgggcgcggtggctcacgcctgtaatcccagcactttgggaggctgaggcaggcggatcacctgaggtcaggagttcgagaccagcctgaccaaaatagtgaaaccccgtctctactaaaaatacaaaaaaatttagctgggcgtagtggctaacgcctgtaatcccagctacaggctgaggcaggaaaattgcttgaacccaggggtgcagaggttgcagtgagccaagatggcaccattgcactccagcctgggcaacaacagtgaaactccgtctcaaaaaacaaaatacaaaaattagccaggcatggtggcacacacctgtaatcccagctactcgggaggctgaggcaggagaatcacttgaacccgggaggcagaggttgcagtgagctgagatcgtgccactgcactcaagcctgtgtaacaagagtgaaattccgtctcaaaataaaataaaataataaaaataaaaagatgaccacagcagatctgctggctctccaggcaattcgtgatcaccacgaattgagaagcgctgctctcaggcttaacccccctgtacctcagtttccttttctgtacaaggagatcaaaacagaatccatgtagaggactgacgtggagtgaggcttaactgagataatgagtgtgaaagtgctaagcacagcttcctaagtgcttgttttcagcagctcctcttcctcttttctatttttttatttttattttttttggggggggaacagggtctcgctctgttgcccaggctggagtatagtggcagagtcatagctcactgcaacctcaatctctcagggctcaagtgatgcccgtgcctcagcctcctgagtggctgggactacaggtgtgtgccaccatgcccagctaatttttaaatttcttgtagaggttgggggtgggtctcactatgttgcccaggctggtcttgtactcctggcctctggcgatcctcttacctaggcctcccaaagtgctgggattacaggcgtgagccaccacacccagccctcctcctcctctgtattattaaatttcagagctggaaagaaatttcgaagaccgccatcactcaaccttcttgctctacagatgggggaactgaggaacagaggagcagaggtttggccagaggaaggtgggaaggacgtggtgtggctggccttcacagactctgccgggggctgtttacaggatactctgaggaaagccaggatgggcactgatacccacctccaccctgcgggaggcagaaggctaaggctcccccagccgtctcccccaagcagagctgagcccttgggagccagggcagagatgcaaccctctcccccatgctcaggtcctcctcctcctggaagctctccttccaagaggagcctcttattttattttttattattattatttttgagacaaggtctcactttgtcacccaggctggaagtgccgtggcatgatcatggctcactgaagccttgccctccccaagctcaagtgatcctctcacctcagcctcccaaatagctgagactacaggcacacgccaccacccctggctagtttttgtatttttagtagagatggggtcttgccattgtccaggctggtcttgaactcccgggctcaagtgatctgcccaccttggcctcccaaagtgctgggattacaggcatgagacactgagcctggcaaggaatgagccttatggagaagaacttgatttacccactccatgctctgcaggcaggtgtgtcatgtctgtgagtgcaggtgtgtgtgtgtgtgtgtatgtgtgtgtgtgtgtgtctccagggccaatttctcccttaggcccaggggcacagtgcctagggcccatgataaatttaaccgacccacggatatgggtcaggagggtatacatgtataaagttcaggaagactttgttttagtaacaaaacgagcatgtacaatctgtcaggagccttatgatatcttcccaccagtctcatgagtgggcactacatcttgttctcctttgtcgggtagggaaactgaggccccggatgtcctagctcaagttcaccaagctacttggtgatagaagcggaacataagcctaggccacctagcttctgggtctgcgatcgtgtgaggataaatgcccagtgtgttcgtgaacatgagcatccctgtgtgaataaattgacatacataaacccatttaataaatttcaaagccaggcgccgtggcttactcctgcaatctcagcgctctgggaggctgaggtgggaggatcgcttgaagccaggagtttgagatcagcctgcaacaaagtgagaccctgactctaaaaacatttttttgaataaaaaaattaggctggacacagtggctcacgcctgtaatcccagcactttgggaggccaaggtgggtggatcacttgaggtcaggagtttgagaccagcctggtcaacagggtgaaaccctttctctactaaaaatagaaaaattagccaggcgtggtggcacatgcctgtaatcccacctactggggaggctgaggccggaaaattgcttgaatctgggaggtagaggttgcagtgagccaagatcatgccattgcactccagcctgggcgaagaaacgagactctgtctcaaaaaaaaaaaaaaaaaattagtcaagcatggtggtacgcacctgtagttgttagttacttgggaggctgaagcaggaggattacttgaggccaggagttcgaggttacagtgaactatgattgcatcactgcactctagcctggatgacagagcaagatcctatctcaaaataatactaatagttcaaggaacagactttgaagcctgacaccctgcatggtgttattccagctttgctacttacttgctgtgtgactctgggtgaataacttaacctctctgggcttctgtttcccttcctgtaaaatgatcatttgtacctcacaggagtgttgtgagaattaaataagttaatataagctcttgggaagaattagctcttgttatggttgtgtgaagagctttacacgagtccctctgcaggatgcatggttgttggtctgtgtgtgtgtatatatatatatgtgtgtgtgtatgtgtgtatctatgtgtatatgtgtatatgtgtgtgttgctctcttgatctctgagtgttgtgtgtgtgtcaatgtgtgagatcatatatgcacctttagtaaagatctaggggtctctgtgtgttttgggggtctgtacctgtccttggctgtacacctgaaccctacgtcttcttgtgtgtgtagggatgtgtgtcatgtgtgttgataaccatatgacagtgtgtgtttccacatgccagtgtgtgtctgtgaagctgtttctatgtggctgtgggtgattgcccacgcgtgacctggtgagcggctgtgtggaagtctgtgttgcctgtgtcgggtgtggagtctctggccagccagggtaggtctttgcatgtttcctttattccatggaggaggagatgaggggcttggatgagacagaagaatgaggggtcactccctgtctgatgctggggccgagtcactgcctactagtggctgctgtgtcatctcccagtctctgtccctccctcctggctggtggcagacagagggggcgtggaggaacagggcagggggtgggcttgaggctggacttttgtctggaaacttgaacctccacctatgccccccacgtccctctagtcttccacatctccctacaccctccctactattggggcagggaatcaggactccctgaaaattaagaaccatcgccttggctctgccacaggcttgctgtgtagcccggagacaggccctgcccctctctcaacctgtgaaattcaatgttttaaaagtgcttcttcctttgtgcccagggctgggccaggctgtgcactgggagggaagtgctgggttctctgaggtttgtgaaatagctggtagcacccttcccagtgggtgcttaagagttgggggctgtagcatctgaaatacccaagtcagtgcaggcatagtggctcatgcctgtaatcccagcactttgggagaccgaggcaggcggatcacctgaggttgggagttcgaaaccagcctggccaacatggtgaaacccccatctctattaaaaatacaaaagttaggccgggcacagtggcttacgcctgtaatcccagcatttaagaaggccaaggcgggaggatcacctgagtttgggagtttgagagcagcctgaccaatatggagaaactctgtctctactaaaaatacaaaaaaactagccaggcatggtggcacatgcctgtaatcccagctactcgggaggctgaggcaggagaagcacttcaacccgggaggcggaggttgcggtgagccgagatcgtgccattgcactccagcctgggcaacaagagcaaaactctgtctcaaaaaacaaaacagaacaaaacaaaaattagccaggtgtggtggcgcacacctgtaatcccagctactcgggaggctgaggcaggagaatcacttgaacccaggagatgtaggctgcagtgagccgagattgtggcactgcactccagcctgggcaacagagtgagactctgtcaaaaaaaaaaaaaaaaaacgtcagattcatgaaccccatttgctaagaagatttgctcaggtagtcacctgtacccctgtgagccaagattgcaacagtacatgctaagagcagtaagaaggagtttgtaaagcttagaaagacctgacaggccaggcgctgtggctcacgcctgtaatctcgacacttcgggaggccgaggcaggcggatcaccaggtcaggagttcaagaccatcctgaccaatatggtgaaaccccgtctgtactaaacatataaaaattagcttgacgtggtggcccgcgcctgtagtccagcaactcgagaggctaaggtgaggcggaggttgcagtgagccgagatcgccactgcactccagcctggcggcagagcaagactccgtctcaaaaaaaaaaaaaaaaaaaaaaaaaaaagacctgacaagtgaaagctactaatattgccattatcatttaaaaaaaccccagacacaggtttttcagggagtttcatccaaccaggcaggtctcagaaatcagaaaagaaatggaaagggtaggaaatctggagtttgacaattctgagtttgaatttcttgtgatgggatcttgggcaagtcatttaacctccctgagtatcatttttttcttttataaaatgaagatttttctctcttaaccttccagagctgttttaaggattacaaatcttctactgaaaggcgtagcacaggagctgtgcttggcaagtgccaaatacaaggcattaattattattattagaattaataataatatcccctccctcttacacattctttgtctccgggtggattaaaaggtggaaggagaggctaccaacaccatcagaagagaggcttctctctaagtttcatttcccatctcctccaaatccgcatccctcccaaacgccggacctgtaaggccagcagggtccaagacacacatcctttgcccagcggggaagattaaagctaaagctcagagagggaaaacatttcctaagctcgcacagcgaatcaggacagaaaccaggacgagcctcggaatccctccattacctccactttcacctgagcatcacagcccgctcgggactcagtttccccacctacgtgaccacaccacactaatcagggtctccttttggagatctgctcttcttctcgaatgggggcgctgcaccatcggtagaacagggtaggtgggggcgccagaggtgaaggggacctgcaggctggggtcttccccgcccgggtcagcggggtccctgcggggctagtctaagcgcctattattaccagcccccggggcggcgttgcactgcgcaggcgcgggcggggcgcgggcgcgcgcgcgagcgagcgagggattccctctgacgtcattgctaggataccaaacaaacactccgccgcgccggccgagctccttatatggctaattgcgtcacaggaactccgggaaggcggggccgggatcccctcccgccgagtggcccggaacgcaacccccgagacccccagggccccgagggtcatgcaagtgaccagatcgagtctagaacagacctcttgctggacagtgcgggactcgatttggcggggccggagatttggggaagtttgtccagcaaggggcgggtgacgtaagcaggggggcgggtcccgggcatataaatacaggctggcgggtctgtgcttcattcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggtaagtttttgatagtaggggtgctgctttgtaggttttattttttaagtcaagggtgaaaagaataaaccccaacccccacaaaaaggcgcatcagaaccctagatctgagatggaaaaggctcacagcgcactttgcaaactgcaaagagtcgggagatgtttgcaattggttgcgtgcgtggagcgcaaggagggaacgcggcagggagggtaggctttggggcgaggtgggggtggggtgggtaatgcgctgctcaatgcaacgtgtatgcggtagcggggctgagaactttgagccggccccgggactgccccctgctcgggtcccagacctgaagctagcgcagttaggcaggtgggggaaatcccggggaagcttccagcagtctcttttcctttcctcctccttcggagcgcccacttcggtgccgggtcgccctccacccatcgggaagaggggcctcgaaccctcagccgcgctgcctccgcctcctgcgcggagacgtaacgggggacccgtgcgtaacggctgacgcgctggaatcctccgtctgacgcggggcacgcacggcgcgcggcgcccccttcgtccgccccgcccctgacgtcccgggagcgttctattttggaacgccggggccacgttgctaagggagggggcagcccggcgtttcgattggccgccggggcgcacgccttggccaatcagctttcccttcctatttgtagggtgcattttccttcccccctctctgtccccggaacccgtggttccttggcggctgggtctcttttcggcgcctctagaggcagagggaggggatccctgtcgtgacaagagcgcctgtctgcgacccaatggatctgcgaggcccttgcggggatctagtccctgggctctcaggagaagggggtgtctgcttgtgtgctggcgtttcttggagagatacggtggctgtcaccctcttctccaggcacacacagacacattcccactccctctgctcctcatgcccggttcctccggtgtgtcccaagacaggactagaaccgcgaaccgaagggcaaccagccaggtggtctccaggagctccgccccctctgggttcccaggactctgattggtcggcgagccagcccttccctcaccacgccccccgagagagtagttaagccttcagagcagttccaggagtccatttacgggaggggggagatgagcgctgctgaggcttgggggctcaggtcccgcaccattccccctccgcgacaatctgagagagctccagtggttacttttatctacctgtccgttcaccctaaactgtcactcgtcagtctcactctgagaagagacagtaacttgaaacgttgttctaaactcctaggcccgtcccccaaacacccttttgactgggacccccgcccctgcatgggacctcgcgcagaggggggtgtgtatgtgtgtgagtgtagaggaaggcttggcctaaggcctctccttctccctccccttgcctctggggtgggggtggggtgttgtggctgtgtgtgtggctgtggctccgtcccgggggttctgtcacccggctgtgtccagcctcctctccaccccccatacctaagagtcaccaacccggggtgtgattcaccacccgctggaaccgtgcaacctttccccgaggaagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagccttcatttcatcccaaggggccacatggggcccttgaggagaggggcgcccccatcatttctcccatctggtcttcagcaagtaacaacccattttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctaccaagaaaaaaaaaaattagttgggcatggtggtgcacaccactgtggtcccagctactatggaggctttagtgggaggatcgcttgagccgaggaggtccaggctgcagtgagccatgattgcactattgcactccagcctgggggacagagcgagactctggctcaaaagcaaaacaaaaccaaccacataacgattgttcattcattcaacaaacctcctgcacaccagaaacttccccataaacctggccccttctgtaccatcctttggacagatgggggaaactgaggttcctggaaggcaagacccttgccccaactcccatggccaccaggactccatctcaggaggtgttttttctcagcccggggctgccttccagcagcaagtccaagggagccatgacccgagtttcccggtcactgacatgcttttttctccttcctctctctcttctgtgacctggcctccctggcctcaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgcattcgccaggctacagtgtttatttcctcctaacacccattgcctggcttccttttagtaagagaggatgaggttagattgtcgaaggactacacacacacagagatcatacacccatgcacacacacacacagacacacacctatgcaggaactccttctagtcaatgggtctacagcaggataaaaggaaggcagacagtcaggaggacttcctgtactcgcaggcagtgcctcctactagaaaaagtaagtggctacagctgggcgcagtggcttgcgcctgtaatcccagcattttgggaggccaagatgggcggatcacttgaggtcaggagtttgagaccagccttgccaagatggtgaaaccctgtctctacaaaaaatacaaaaattagcctggtgtggtggtgcacacctgtaatcccaggctacttgagaggttgaggcaggagaatcactttaacttaggaggcagaggttgcagtgacacaagattgcaccactgcactccagcctgggtgacaaagtgaaactgtcaaaaaaaaaaaaaaaagtaaggggtcagaaggttagcctgcaggtgtgggatcacagaggtctcctagtgatggagcttgtatgctctatgggttaaaaacagacgctaaggagataaactatacacagaagaagcttaatgggctgtgcacagtggcttgcacttgcaatcccagctctttcggaggccgaggtaggaggctaggagttcgagaacagcctggggcaacatagtgagacaccccccaccccaacccatctcattatgttgagaaaaaaaaaaaaaagaggatcttgagaaacttgcacagcaaactactaaagaccactcaggctaggaatgaggcgtcatcttggattttttacaaactacaactacaaaaaacaattattttacactgaagatgtgtttccttttgttttccatatgaccactattggggccaacccaagactgactgaagcaaatatatgaccattttttttttttacacatagagtggagccatccccattgcaaaatcctagccgtctcttatttgcataacagcaagtcctctgggaattgaggtgagggtccaggggtcgctcagacgctttggtaaatcaataagcaagggaatttgtcatggtggaatccatttattaattcactcaaaaaaatgtgctaagcacctacccaactgtgctgggagttggggacactatagggactgagcctcaggtcttgccctcctggggctcacagtccattgggggacacacaccgttgccagtcagggacaacctaaagtggattgggtttgggaagcccatggggctagggaagcacagcagggacacctagcttggactgggagtcgggaaaaacttcctggcggaggggacagctgagctgagtcctagaggaggatagagagtatagaaagaaatagaaaaaggccaaggccaagaaaatagcacagccatagatctgttggtggggagaaggcttgatacattgagaacgcttagagggtcgggtgcgatggctcatgcctgtaatcccagcactttgggaggccgaggtgggtggatcacctgaggtcaggcattcaagaccagtctggccaacgtggcgaaaccccgtctctactaaaaaatatatatatatatatacaaaaaattagctaggcatggtggtgggcacctgtgatcccagctactcgggaggctgaggcaggagaatcgcttgaacctggaaagtggacattgcagtgagctgagattgtgccactgcactccagcctgggcaacacagcgagactctgtctcaaaaaaaaaaaaaaaagaaagaaaaaaaagagaaaactcagagattcgtggagactggaaccacgggtgtggagagaggggttagtagagaccagattctgcaggtactataatgacattcccaggctaaggagtttagatcttttcttcagggcactggggagctattgcaggttttgaacacgagaggggcaggggcaggtttgtgatttaggaaagacccctctggccccagactgagcgtgactggaagggagaggagtgagactgagcaggagaccagggaggaagtggggtggggaccctgcagggtggggtgaggaggagtccagaacagggccagggacatgggacagagaggaggggaaggattcaggagacactcgggaggcaggacagttgggcttggtgagcagccggcttgggaaggaaaatacagggcagtaataaatagcatgggtcaagtggtctgagtgaggctgggagtggtggcacgcacctatggtcccagctactcaggaggctgaggtgggaggattgcttgagcctggaagtttgaggctgcagtgagctatgatcgtaccgctgcactccactttcggtgacagagtaagaccctgtctcaaaaaaaaaaaaaaaaaggaaaaaaaaaaaaagacactgcctatgagttaaccctgctctacaaggagcagtttttaaagtaaaattaaaaaaaaaaaaaaaaaagaaagaaagaaagaaagaaagagagagaaaaaagaaaaaaggctgggttgccttggacaacagacttcatctccctgagcctccatttcctcatctgtagaatgggggctgttaagaggagttgcaaggcttgtgcatgccagcagtaagtgcagagtgacggtgcaattatcattacccccatcatctttattggggtcagcctgaaccctcgatatcccataatattcacccccatccttcaagggtctgccctaatgttcccatgacacccgaccagctcagctctccttatgagagggcctcacttttctattccctttgcagccgttatcccctttgtagttgttaattaagtgtgtaattacatgatggcttaatgtttgtctcccccactgggctgactgcaccaggagaccaaggccagggctgtcacccaccgctgcgtcctcagcaaatgcttgtttgatgagtgaatgacagatgaacaaatgggcaagtatttgactgattaatcacggcatgcgtgattaaataaatgagtgagcaaacgactgaatgagtaagcaattgaaggggagagatctaggataatttccaaactgccaatatcccagaactgggtagatgactttttctccgtcttttggagtgggtttttatactccggagggggaaataagtaacgacaatcagagatcggagtgacagagaatgagtttgcgatgcggaaggccgcagcgacctctccaggtgcaggctggaggagcgcctcccgggcaacaagcaaaataagtccggttcgataagtaagattcaaggcgcttagttactaccgcccgaaaggtggaattgaaccactctgtcgctagacagctacaggtttgaagcctgcaccccagaccactgaggatcatccgggcaggacaaccttcttcccgcgcagctatataaggatcgcaaaagcttaccttttagagttatggtcgcgtcctttggaaaggtgtgagatggttgacttcaagggctataagttctccccactcatttatcgtgagagatgtccttgtaaaacgttgccttcacttcatatagtatgaatcatcctcgctccccaaaccgtctcatttacatagcgccacgcattctgggaagcagcgtttgagcacctggcaagctgttaaagggcccaggaccccctttttccaaaatgaaaagtcagctttttaagaggagagattcatgattcggcattcagaagcgccttctcggaaaattccgaattctctttctgcggaggagtggtgagtgggttcctgttagagtctgattcaccctggccccaaaggcgctgagcaggcggctatagggctggtgcgacacctgctgttcttttatggaattgcgtaggccgatggagctccgcgttcattcaaacgtttattgagcgtctactgagtcccaggaactgtctcggtgctggtgacgacagacatcctgtcccgattgagtttaaacactagacataaccaatttctgcacttgcgttttatggttggagaaactgagacagactcagaaacggatagtaccatattccggttaaaacagcccatccacttagggaaatcgaacttgtgttacaatttttattacaaaaaaggtgattcttttttcttaaatttttacatatttaggaggtacaggtgccgatttctacatgcatatgttgattgcatcgtggtgaaatctgggcttttaggtgtactcatcacgaaaaattattcaatattctaagtcagtgattctttgacaataccattctcctgcatgaaactctcccatgacttccatttcagagtaaaagtcaaagtactcaccctgctttacaaatccctgtaatccagcccctttggtccctctgaccctgtctcacatactcctcttcccttggatattattggatttaggcacacagatgtcttgctgcacacatggatcatgctaccaccacagggactttgtgcttgccgatcccctagcctggatctcctcttcacatgttcccatggctcatcgcctcccttcactctgtcatctgatcaaatgtcaataccaaaaactcactgagtgaccagcactcagtggggccttccctgatcccagtttaaaatagcgagtggcggccgggcgcggtagctcacgcctgtaaccccagcactttgggatgccaaagcgggtggatcacgagatcaggagatggagaccatcctggctaacacggtgaaaccttgtctctactaaaaatacaaaacattagctgggcgtggtggcgggcgcctgtagtcccagctactcgggagcctgaggcaggagaatggagtgaacccgggaggcggagcttgcagtgagctgagattgctccactgcactccagcctgggggacagagcgaggctccgtctcaataaataataaataaataaaatagctagtggctgggatcggtggctcagggcctgtaatcccagaactttgggaggccgaggcgggtggatcacctgaggtcaggagttcgaggccagcctggccaacatggtgaaaccccgtctccacgaatgatacaaaaattagtcaggcatagtggctcacgcctgtaatcccagctactcgggagtttgaggcaggagaaccgcttgaaccggggaggcagaggttgcagtgagctgagatggtgccattgtactccagccttggtgaaaagagcaaaactccatctccaaataaaagtaataataataataaataaaataaaaatttttaaaaagcgagctctgtcactctatccccttaccctgctagacatttccccaccactctgatcaccacctgccattttctgtgtctatttgcttaccgtctgtctgcttctgtagaatatcagcaccatgaaactatgcactttatttttgatcattgctgtatctctagtgcctaaaaagtgcttgagaacatagcagatgttcagtaaatgtttgtggaatgaataaaagaatatcatcactgtctttttttcattcttcttccagacaggatcttactttgtcacccaggctggaatgcagtggcgcaaaaacggctcactgcagcctcgacctcccaagctcaagtgatcctcttgcctcagcctccctgggatgacaggcatataccatcacgcccagctaattttaattttttttgtagaaacaggggcctcactttgttgcccagactggcctcgaactcctggcctcaagtgatgcttctgccttgggctcctaaagtgctggaatttcacgcgtgagccacagcacctggcctcactatccttctttcagcctcagttttctcatttgtataaccagactagtacaactgatctcactggagaaatcatgatataaaattctgacactggctgaggcaactgggaggagctcagtaaaggctgtttctgctgggcacggtggctcacacatgtaatcccagcactttgggaggccgaggtgggtggatcacaggagattagaagttccagaccatctggcaagcatggtaaaaccccatctctactaacaattcaaaaagtagccaggcatggtggctcacacctgtgatcccagctactcgggaggctaaggcaggagaatcccttgaacccaggaggctgaggttgcagtgagccaagattgtgccactgcactccatcctgggcgacagagcaagactctgtcaaaaaaaaaaaaaaagttttttttttttggctggaattacaggcgcctgcccccacacctggctaatttttgttttttgtttttttaggagagacggggtttcaccatgttcaccagactggtcttgaactcctgacctcaggtaatccaactgcctcagcttcccaaagtgctgagattacaggcgggagccactacacctggccaataaaggccgtttcagtcttcaatctgttttgagcttggaggctttagtcattcccagacccaaaatctcaatcagaccctcttccaccactttttgtgatagatcaataaacattttgtcttatgggaagtttaactaagagtatctttagaaagttttggacaggcgctgtaatcccagcactttgggaggccgagatgagcggatagcttgagcccaggagttagagacaagcctgggcaacatagtgagactctgtctcaaaaaaaaaaaaaagaaagaaaggaaaagaaaaaaagaaaaaaaaagtattccctctgcttggcaaatccagattcaagatatatcccctaaaccctctttgttttaattagatagttgctgctaggcacctctgtatacaaattctgaggatgtaaggactccttggaacaccgttatctgtctcctaatatgtgacgtgtgtatgacgaacaagtgagttttttttttttttgtttcttttttttggttttttgttttgagacgcagtctcgctctgtcgcccaggctggagtgtagtggcgcgatcttggctcactgcaagctctgcctcccaggttcacgccattctcctgcctcagcctccctagtagctggaactacaggcgcccgccaccactcccggctaatttttttgtatttttagtagagacggggtttcaccgtgttagccaggatggtctcgatctcctgacctcatgatctgcccgcctcggcctcccaaagtgctgggattacaggcgtaagccaccgagcccggcttttttttgagatggagtttccctcttgttgctcaggctggagtgcagtggtgtgatctcggctcactgcaacttccgcctcccgggttcaagcgattttcctgcctcagcctcccaagtagctgggattacaggcatgcaccaccacgcccggccaattttgtatttttagtagagacatggtttctccatgttggtcaggctggtctccaactcccgacctcaggtgatccacctgccttggcctcctaaagtgctgagattacaggcgtgagccactgcgcctggctgcacaaacattttaaacgtcaatatttttgtgtttatttttactattgtcttctatttctggcaagcaatactggtttctggtggcaaggtaacctttcttcttaaaatacatttgttattatattattaaatattaaaccaattttcaagaaaaatattagataaatagcagaacaggttgtagaaagatgaaggtcatgtggggaatgactgaggtttgggaaacaatattataactccttactgtgcatttattatatgccaggcccaatgccaagggctttacatgtaggtatagttatggttgacagttttcttctttttcttttctttttttttgaaacagggtcttgctctgtcgccctgtctggagtgcagtgacgcaatctcagctcactacaacctccacctccttagttcaagtgattctcctgcctcagcctcccgtgtagctggtcttacaggtgcccaccaccacatccggtatttttagtagggacgaggttttaccatgttggcgaggcttgtcttgaactcctgacctcaggtgatccaccttccttggcctcccaaaggctgggattacaggtgtgagccactgcacctggcctctttttttcttacttaatttttttgtagagatgaggtctatgttgcccaaacttgtctcgaactcctggccttaagtgatcctccctccttggccttccaaagtgctgggattgcagacgtgagccatcgtgcccggcctaataagttttccatttgaggaaactgaggctttgagagatgaagtcatatgctcaaggtcatacagcgaaggggtagtagagccaggattcaaacccaagtctgtggatctttagacctcagtgttctcccagtctccccacgggtccctttgcttcatcctttccgagtttagttgtcttttttgttgttgttcttgttgttgctgttttttgatagagtctcgccctgttgcccaggctggagtgcagcggcatgatcctggctcactgcaacctctgcctcctgggttcaagtgattctcctgcctcaggctcccgagtagctgggattacaggtatgcgccgccacacccagctaatttttgtatttttagtagagatggagtttcatcatgttggtcaggctggtctggaactcctgacctcagtgatctgcccaccttggcctcccaaagtgctgggattacaggcgtgagccactacgcccagtatgtagtttttttgtgttttgtttttgtttttgtttagagacagggtctccctctgtaactcaggctgaagtgcagtggtgtgatcatagctctctgtaacctcgaactcctggcctcaagcaattttcctgtcttagcctcccaagtacctgggactacaggcatgcaccaccacgcccggataaattttttttttttttagagacgggggtcttgttatgttgctcagggtggtctcgaacttttggcctcaagtgatcttcccacattggcctcccgaagtgttgggatcacagatgtgagtcatcatgccaggcctcagattagtgttgaaactggaagtccagggaggccctgtatttgttcccgaggcaatcagggtggggagacgtgggtggatgagagaagtttgtgaggcaggatagacacagcattgtgactgattgtttgtgggaggtgagtgtgtagaagtccagagccatacctgggtgtctggcctggtgacaccgtgggcagtgaaaacatctctgagttggaaatcaggtaggatgaagaagacgtttggttagatttagggtggaaggggcatccagaggccgttggacacgtgggtttgggctcagttgaggtggctgcacagtaggcagggtgtgggatccattagtgatgtctgccttgagcacaggcatgggaagtggctgccaaggcttggctaaccctggaatgggtggtctgtcagcatcttcccctcaatcatttctttcttttttttttttttgagacagaatctcgctctgtcgccgaggctggagtgcagtggcgcaatcttggctcactacaacctccatctcccagattcaagcgactctcatgcctcagcctcccgagtagctgtgattacaggcatgcaccaccacacccggctaaattttgtatttttagtagagatgaggtttcaccatgttggccaggctggtcttgaacttctggtctcaagtgatccgccctcctcggcctcccaaagtgctgggattacaggcgtgagccactgcgcccggcctcccctcaatcatttcataacctacacagatggcagag

SEQ ID NO: 969 - DNA, 3775 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 970 - DNA, 1017 bp, Homo sapiens
atgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtga

SEQ ID NO: 971 - DNA, 30828 bp, Mus musculus
  misc_feature (1)..(42): "n" at positions 1 thru 42 can be any base
  misc_feature (15334)..(15753): "n" at positions 15334 thru 15753 can be any base
  misc_feature (22853)..(22872): "n" at positions 22853 thru 22872 can be any base
  misc_feature (30603)..(30828): "n" at positions 30603 thru 30828 can be any base
nnnnnnnnnnnnnnnnnnnnnnnnnnnnnnnnnnnnnnnnnngggagttccattctcagcccgctgctactgcctgtgagcctcctttgggaaagtccttaatttctctagttctgttatttcctcatctctagaatgggcatcacgacactgatttcacagagttgttccgagatgaaatgatgtgatggagtaagtactagttcccagcctctcagatcctggaaatgggtgtcctgcctctccctctggaagctccctgaaggccaggctttgggtccttcatccaagcttggatgagtattttaaaagagtctccgtgagttttgctcattagccaaaacggatgctggcctttggaagcggggcggatgactctgcgtggaaatattcttctctgagtttccctcctctgcctacttcctcgtgagttctatgtggcatctatttgaggtcaaatctattgaaatatacttcagcttaactctaggtgccttttagttgagcaccaagaatatactaagtgctatgtaagaaatagataaaggacccagtatggaggaggagaaataccaagccaagcctagtactcaaaccgcagacagtgatagggacagccggatcgctttctgtaggcttgagggtttctgaaattcttcagggaattgggagctctttgagctggacttttttaagcgtatgagtgtttggtctctctctatgcatctgtgtcatgagcatacctggtacctatggagaacaggagagggtatcagacaccctggaactacagatagttgtcagttgccatgtgggtgctgggaaacccaccctaggtcctctgcaggaacagcaagtgctgaagggactactgagctgtctctccagccccttacgttaaatcttgaagaacgggttaaaagatgacagagcgggggagaggtaccggagagaaaaatgtgtgaaagtagtcagggccttgacctggaagagttagagaacaaggcagatgcagttggcaggtccggagcaacagctcctgagtgttcaatgggccaagttgagaggggctttggatgccatgaaaggttgccgaggagaaggaagtagagagtgagtccttcagctaccacaggggaagggtgggaagggggtgaggagatttcctaaatgtgcatcattggccttctgaggtcttcagaagacgaccagtggggtccccaaagggtgagaccagacagaacagacagccactattccctactctgaccccctacctcaagaggaaaggacgaagagagagctgagaagagaccctgagcctcttcaccacagcagacaggaccaagtttcagcaggcaccaggacactcaggtgtctacgtcagtcgctagctatgcacatgggtaccctgggcatggaaagtacagactggctttctaacacatcattttgccgtgagaccaatcccagcattccctctattgtcctcaacagaatcaaacgtccaagctaaggggcttgccacctctccaaaataaaggtcaccttagaggtcaagaaagcattgacacaaaccttgggtaagccctaagactgtaacttgggagttgtcatgacaacagggcagtagagccatctctactctctcctaaatggcacgaggtttagatgagtaactctgaaagaacagaccccacccctgttttcctatttaccatcttcagacccctcctcacctgtgccccagccctctcctctaggaccttagcaacttgaacaacatagacacacacgcctcctctcagtgtccaacaatgagccctcccagcaaaacaggaagcctcttgctgccaaggcattgtgcttgccctgtcacgtgtcaggaaaccactaccgtgccatggcaacaggtgttgctgagaccttagccttcccgccaacctgtgccctgcccttctctctcctccttactcctagagagtgtcctcgttgtgcagtgtccttgactcacctggacactgctgtgagtgagcgtcctaattaccttaacttggatgagaagactaattcaccctataagtcagtggcccagggccagggcttgggccttagactgcataaaaaggagaaagcttgccgactgcaggtgttcatctccccttgtttcctgcctatcagtgcaatgtcaccagccactccaagccaatgtcaccaccagccaccccaagctcctgctgccatgattccccaaccaggatggactctacgctggaactgtgagctgtattaacgcttctcccctaaatttttcttgtcaaggtgttttcatcacaacagcagaaaaaccaaaaccaactgacacttcctccttgcaactggcagctcacatcgcttgctcctttcccatttggacaccaaagatctcactgatcatcatccaaacacagttcttcatgctagccaggcaacataagaatgtacctgtgtggaaatttagcaagcttcttagctcttttggatcgcaaaagtctaggtaaggtctgagatgactctctctcaaattccaatatccctaaatgtatgccagaccttcctgtaaggttgctgagtcctgaagctaaactgactgtcttagttaaggttagtagtgctaccacaccaaaaacaaaacaaacaaacaaaaaaaaaatgaacaagccaggcgtggtggtgcatgcctttaattccagcactcgggaggcagaggcaagcagatttctgagttcaagaccagcctggtctacaaagtgagttccaggacagccagggctacacagagaaaccctgtctcaaaaaaacaaacaaacaaacaaataacagcaacaacaacaaaaacatgaacaaaagctatttggttggggaaggttttattggctcacacttccatatcatggtccattatcaaaggaagtcagggcaggcactcaaggcaaggcaggaacctagaggcaggagctgatgctgaggccatggaagagtgttgcttactggcttgctgagtctgctttcttttatcatccattgttacatggagattaatcaaagttgcatgaaaagaagagagaaggacctcctcagacgcagatggaagcatgtggtcctttgttaggactctgaagggcagtggtctctcagaaaaaggctgtcagccaaggcacagggggtttgagggttttataggacagaaaaggaagcgtttgtggttggaaaattccatctgcagatctgtttcctcaagtctcagcactgtaaataccaacggaggttcttatccattagtgaatttcttgtcaggagaatcccggctcctaactgcctgcagatgttagcagtgtatccctggtgccatccggagtttctcagctctcctggggcttttaggtcattaacccttcacccaagaccagcagcagcagcaccgcccagtgaactagcctcagagactcaccctacaggccaatctgatggacgcatttttctcaactgtggttccctcttctcaaatgactctagagtgtgttaaattgacataaaactagccagcacactgatgattctggagtgaaatcaaaaggagcttgaagatgagggtggggacagaggcaagggtatgtcttagactttactcattgaattgcaagccgagaaggattagaagacatcagcagtatcagtggacaagtggcatttgaatgccatatggaagaaggacaataagaagttcctgcagacctggttccatccagaagcctctgctctgactcctctcccgggactctttaggtcaaggactttctccaggggtctcaagactttctgtgttcctttatactaagttttctttcatcctgtgaacaatcaagtcatcagtgaggtggttgggtgacatggcccataaagatgacttccagggacctggttcctgctcacactctgaaacctttgctcctgggcaaaacttcccctaaagaacaatgacacacattctcagagaacagagaacaataagccgtgtgtaacaacatcttccagagagagagaagcgtggatttagtccttttgggccacgctcagcatcagcaggagctagcttgacataaggagaaaagccccttagcttggagctaaaggtcacatcacttttaagtctcagtttctacagccacagaacagaaagttaccaaacacagcagcctgagggtttcatgtgagaaggtcatggagtcccaatcactcactccttaaacttgactctgtctgcagcccccagctggccttgaacttgtggcagtggagaatgtgcttgaaatacagaagccaaatagaaacctggaaatgttacttgtcactggttggaagccctggaccatggtggatggacactcgattctgagtacctacccccaggactccccagagtagatgtttatagttgctggatgatggtggatggacagacagacacggactggcgcctaagaaaagtctagcatgtcatcacgtactccagcagcccgagagcttcatgtcaaagacacaaagcaaagccatctcatgtgccaaccacaacctagccaatgggcagttatcaaagccagaaatctggcctagaggccatagcactctaaaatgaggccaagttaaactatgtggcgctctctgccctccaaactgccaacttcagcagcccttttgaagctgagtcaaactcctgaccatagcgtttcttttcaccactgccttcctccctcacctggcccactccctcagctctctaggtgccactcttcccataggagtcttggttggactcctactgtgcctaagctatgccaggctgttccctagctaagtcctgcagtgttgtgatgcaatattgtcctccattatttcctaaataccatgaaatatttaatatataaagccataaaaagccgggcatggtggctcacacctttaatcccagcacttgggaggcagaggcaggcaaatttctgagttcaaggccagcctggtctacagagtgagttccaggacagccagggctacacagagaaaccctgtctcgaaaaaacaacaacaacaataacaacaacaaaaagccgtaaaaaataatgcaatgaagactttagttcatcataaataaaacatcaccttccgagcccttcccaaaattaaggtgagcctgtttgtgggtgccatttctcttcatattgtttgagagtgattgtgtcttgtcatttgtctcactttgtgttccttggttttttggccacagagtctcactctgtaaaggtggcagatccaagtgtggcaatcttcctacctcagctgctgctgctgctgctgctgctgctgctgctgctgcttcttcttcttcttcttcttcttcttcttcttcttcttcttcttcttcttcttcttcttcttcttcttcttcttcttctttttcttcttcttcttcttcatacggtattctgcctccatgtatacctgcaggccagaaaaggacaccagatctcattagagatggttatgagccaccatgtggttgctgggaattgaactcaggacctcttcaagagcagccagtgctttgaatgtctgtgctgtctcttcagccttcctcctcctcctcctcttcctcctcttaataatttacttttattttatgtacattggtgttctgactgtatatatgagggtgccagctcccttggatcaggagtcatagacagttgtgagctgccatgtgggtgctgggaactgaacccaggtcctttggaaaaacagccagtgcgcttaactgcagagccatctgtccagcccctgcctcagcttcttagtgctaagattacaggacttcatcagaaccctctgttgataagacaagatccatctttgtctatcttcttcactgtggtggactggatactccctaccaccatcacccacaaagatcatatgctaaagttatgaccctacgatggctggatttgagaataaagctgttgggggttggttttaatgctttgaattaatccagcccccaaaatcgggaaactgcatgtccaaacactaaagatccttgtccccaattggtttttgatcaatcaaaaaagagccaatggccaatggttgggcaggtagactgaaacaagacctttagatttgctcaggctgggaactgggagagaggaaggagagagcattgtcgtggtttggagggaaacagatcagaattagagacgcaaaaggaaaagcatccgaaatgtaggagagaaagaattcgggccctggaggaacagctcagaagtgtcttgggcagcaaagactggggtaggggcacccagaaggagccagggcaacaaagataaaatatagaattagagggcattaagccaggagtaccaaagggaaatgtgttctagccacagggaagattagaactgcccagcctttgagctagtcaaagcatatttaaaattaactggtgtgtgtgtgtgtgtgtgtgtgtgtgtgtgtgtgtgtgtgcttcattcttgaatccagatagctcttgggcaggtgcatgggtgtgacgaatcgggagcacaaaatgatttagctaactactgctacgtagagaatctaaggaagttatttaaattaaatagcactatagagtagggtcctggttccatggaattggtatgtgagtgacattaccagaaattgaccctactggcctttgccttgggacttccagcctctagaaccatgaggaaacatatttctgttgtgtaagacatccagtccatggtattttaagagtccaaacagactactcactccatgtaagttaagcaaggccaaggatcatgtgtgcttgtctttggatcaatactgtccatcactatacctaacacataagtgcatgccaaatatctgtttgttgaatgaatgaatgaatgaatgaatgaatgaatgaatgaattagataattactaaaacaaaacatatagggttctggggtatgcaagatggtttaatgggtaaaggtgcttgctgacaagcctgacaacctgagtttgatcccaggagtagacctggtgggaagaggagacttactcctgcaagatgtcctctgacctcaacaagcatgctgtgccacatgcctgcacacagctctttctccctctcccttcccccacccccattctctccttccttccctcatgcctcaacatgaaagctctcggctactgctcccataccttgtttgcctgcctgcctcctgccatgccatcatccaccatgatggatgtgaactcatcctctgaaactgtaagcaagcctacaattaaatgctttcttatataagttaccttggtcttgccatctgttcacaggaataaaaaactaaatacaacaaattatacatgccccccccaaaaacccttgtaaatgaatatttatagcaacaatactcatgataactaaatagtagaaacaatccaaatagccaactaatagtagataaaacaaatgtggtatatccacacaatggaatattattcagccacagaaaggagtggagagttgaaacatactccatatagatgaacctaattaaaagaagatagatatgaaggtaacattgtgtctatttatgtgcattaatcaacagaagcaaatctacagaaagaaagtaggtctgcggctcagagcagttatgtgcacaggtggaaaggacatgggaatcatcggaaataatggctgaggagatctgactaaaaatgattcaaagtttaccgtggcgaataaacgccgtgactatataaacaccacagaaatgtctactttaaaagaggaaatgtggggacgggagagatggcgcaacagttaaggacacttgatgctcttgctgaggatccaggctcagttcccagcacccacacatcagctcacaaggcctgtaactccagttccagaggatctgacgccgtcttctgacctccacgggctgtaggcacacaggtggtacacagaaaggcactcaggcaaatgctcatacacataaaataaaaatcaatgaatcgttttcaaaggtgaatttagatatgaactatagctaactagagctgttgtcttttaaaagaaaggaaggaaacacagatgaattcctttctttcaaccttccattacctgtcagtataacctcatggccaattctctccagaagctagagggaaagtcgtccgggaaatgtagtccctgtatgcagagcagagcaagggtatcaagtgagtgcctaaagggttatgttgtcatggcaactgttttaactatttatttatcttatgtatatgagtacactgtcactctcttcagacacaccagaagagggcatcgggtcccattacagatggttgtgagccaacgcgtggttgctggggattgaactcaggacctctggaggagcagtcagtgctcttacccactgagccatctctccagccccctgtttttaactagttaatacagaagaagggctaagtcattctgagctctgtgtcgggtcctgtcgctcactgaattgtctacaatcagtggctagagataaaaaaatttacaggtgtctctcctggaaatggaacatttagatatttgctctagaactcaatggccacccacagtccccacatgatctctatgcttgttttaaacccactccttggactggggaggtggcttagtagctaacagagaattgccccacaaacacgaggaactgagtccaaatcccagaaccctcataagcagcttggcagtagcatgagcattcgtcatcctagcagtcccccaaggagatgggaagcagagacaagagaccacgcacccagaaggccagctcaccttagtatagaatggggcactcaataaagacgtgatacctgcaacagaatggaagtaggctgacacctgacattgtctctgatcttcacacgtgcaatggcataaaatccccacattcacgcatacgatcgcacacatacacgtgtgtacacacaccatacacaccacacaggcacaacaattaaaaatgccaataaatatatcaatcagtttccctgtgggggaaaatgggtgtggtcacaaagaataaaaaaagtaaaataaaaataggccaggcatggtggcatatgtctttaataccagcactcgggaggcagatgcaggtagatctccatgggttcgaggctagctaggtccacagaacaagttctaggacaatcatggcactgacaaaaataaaataaaataaaataaaataaaataaaataaataaataaataaataaataaataaataaaatctcttcttggggaaccagtttggataatgacttagacttgatgtcctcctcggttagtagagaaagccgaggggctccaggcaccctcatatctagcatctaggtcctgtgatgtttagcttaagtactaaaaataaacactcaaactttcacttcgtggttgtgtcactgaagccttgctggccggaccgttcaacagacctcaccctggctgcgcaggtgtatgtcggggctgcctggcggctgctgggacaatagccactgatcaagttcatactgaaagggagacttttattcaaaaccaagagaaggatgcaagtacacctctgactcccgagcctcagcctatctcaccccacagcagccacccaggcgtgcttggcactcacagatgtaagcagctcctccctgagtctctacaaggcactactaccaggggctttctgaaggcaaacgactcagtgattcaggatcctatgacagccgaatgtggttatcacataccttgtggcccaggaagactctgaggggtgggacaggagtgggaggggctctggaacaacttaaaaggggctcttaccacttcctccctgccagagagggctagctggagagagacaagaaccaaaagcacagccttcctgtgtgatttctacagcccccagagcaccatggacccaggtaagtaagctttctcttaagagaagtcaaaacttctgacacaaagccagactctagggcaatgaacatgcatgggggataggggtcatgggggggggggggagtttcccagagcaatcagggcagttggtgtgaactggtggctgctttcagagaatgccatcccgttggatgaggcattggagagaggatgtacctgctctttcagacccaggggaaggaacagctgtggatgccaagacagacacaggcataaagttgggtcctctcaagcagcaggcaatgaacagcctggtagactgaccttgatgcctggatagaacacgttctcagctggtagggatgggtgatgttctctggcacctctggggactaagaaaattctctttagagagttcaggacaccctgctcccactctgggtccctcctttctgtcctgttaaaccaggatttgaatctccttgctcacgagaagagtgaaactgatggaaactgtgctgtgcatagtgcaatacaaatactagctgccacctctgcctcttgttgtctctgcctgtcatctgtctgtctgtctctgtctgtcttcctccctcccttcctccctcctacacatcccaggttttgtgcctcttgcaggttaaagggtgaatgactaacataaaattgagtggcccagggggcactccacgtagagaaactgtagccagcacagcacagcccctaaaacaaagcccacacaccacagccctctctataacaagctattctaccaggcaagcctcagtgtctactatagcaaagtgccaaggggagtccagctccagacaccccagttacacatcttaaatctcggctgcagagtcagactcggctggggctggaggggccaagttcctagagttccgctcaccagcctcaaagccacaaggggttgactttaaaaagtgaaggttccctggtgctgtcctcacaccccctccaagccacaccacagccagcagcatctttatctgtctctcctgcccagcgtgcattgcaccctagatctagatccagctgtggaaggtatatagtggggtccacctctgctggctatgaactcatgggaagcaggattttgttcttacacctctgcctctcagatgttttgggtgtaagtaaaaagtgttgatgggagggagggagagagggatggaggaatggatggatggatggatggatggatggatggatggatggatggatgtgtggatggatggatggatagaatcagcctctctaagtatattttagaaagcaaatatctattccagcttctcctcccacctgcctgctttctaagcctacacctcaggtatctacctccaccagccatagtctcagagaacccacaccatccaccaaagatcttctccaccttcctaaaatgtggctcccagaatagggaaaggttctaaatttacagcatttgccaatttccatggtgtaaattttaccatcccaattgaccttagtcggtcccattaaaggtctaaatgttttgacacaaaaaggagacagacacctgccttccttggcacttgggacactatagagtctctcctgaactaggtttggggatgctaaatgcatggctttgatacagggggtggggcaaactctggtcctggaagaagagatagtcttgcttttttactcaacttaagaagcaccctaatagctaactctgaaatgctggtgtgaggggaaactgcttaagaagttttgctcaaaacaggctccggcgccgttggaagggcgggtgggccacaaactatctgtttttcactctttgtctacctagtagggacaggaggtgggtgagaaggcctaggtttctgttatacaaaatgagaaactacaaaccagggctgagctggcctctttcatgatttgaatgagcagccctgatatacccttcctaacttcaagacatgggaccacagatctcagcacaacatctcaaaatcagagaaggggagggggtgacaaatgaacccataagagacttgtgtctcacagctcagctgtagatggcagtagaagagaattcagggtcattctcttgtggccctccagaaacctggctgtggagaacactggagcccagagtagctaggaaaaaacgctcctctgtgtggtattgtcttccagtcatgtgtcactcattgagaacttcttgaatacagagtctggtggggaacgtaacatgtatgtcaacacgcaacaccaacagtgagagacacagcactcctgagggggcataaggacaagattcaaaagcaaaaagcaaggctgtgaacacgtgtccagaaagcatggcaattgtattttgaagggtgtgtagaagttgtcaaacctaataaagaagggccaggttgtagccagatcttcagactctacagccttaagccaacaaagtaaatgaggcatccgagtgtcaggaacgtgactggcacacaagcctgaggaacctgagcttgtagcctcagagtttaaaagctggctgtagcaaggtacacacgtaatacctaagcctgcttagggaggcaggaataataagacttgctggccaaccagtcttcagaattggcaaactccaggttccatgagagacactgatgtcagcctctgacctctgtatgtgtgcacacccatacatatatgagcacacaccttgagctcatagtcagtcagctctggtgaaggcaatagagcaacaaggaagggggaatggtgtcagctgatgggagtcagggaaatagatgtgccaagaaacaagctagactggggtggcccttacagcgctgtgtgacagcaccagggaatccatacaccaccctaaaaagaatgggggccagcaaaggtcccccacccttttccaaatagatgggcagatagatgaaatgtgtgttttggaaggagtaggggacaacagatccttgtatcaggacaggggagggaccaacatcaaaagatgtggaagatcgagatgtggaagcaacagacacgagtggccagaagcagtagagagagcaagagtggccttgatctgtggaggaccctccacacccaaggctcatcagtaatgtcacatgactcagccattagaacccaggctagatgttcccctttcccatctctgatctattgtttaatagctatgtgaatccagaggaacgacataacatctctgggcctgtttcctagaatacaaaaggaacttacaagatgttatgaggggggagagatgtagggagaggagctaggagtgaggtggccatggccaggggctgggtgtccttagggaagccttgtgctgacagttcttccgttggggctgattgtcacgtggggtctcacagggtatccattgaggacggggatggcagcgcctgtctcacgtggacagcgcacttcactgaaagctcagtgggtgccaattgcatcactgagtgacagcgttggtgccctaataacaagatcccaccagctctcacatccctgcctcccatctgcgggctgggtccctgcttcagcctctgccctttctcatgtcccctacaagcggctgagaaggtccagagagaaaatcatcacctgaggtgtctctcgggccagatgataagcagccatggtttcctgggcagcctggagggactgggggaatgtacagatgggagctttaggacctgagcaggaggcgactggcttcccaggctgggagctgggggcgggggagggaattgagtgtcaggctgaggcagggcagggcaggggagttgggatggtgtcgggctagagtgctagggagttttcctttcaccttaatcattctgcaaacccaagaactcaggaaacaccgaacacctcaatcaacagctcccccacactggcattcccaactgcccgtagctcaagagcagttgctttctgactattgagtcatctgactcaccaacactgaccaggtccctctgtcaccacacgttcaaattcccccaaattctcctgttaactgccttgaacatggcctgtcctggatctacaggaccccgactcacccacccaacccccacccccaacctcatatccagtatccctggaatgagacatcaattttgttcacacaccccagagcccctccgggtttgtggctacaaaagaaccgggacagaacccagagtaaaacagaaacagttcttgttccttaggggtttctccacgtccctgacagtcagattgggctttctctacagtaaccgaaagccgttgatgggttgaaagaaacctcgaacgctgaaccccgaaatgagtcagggaagggcgggctgtgcatcagaccctgaaaatcctatagttgagaatgggcatgtgacctcaagctcgtggggtgggggtggggtgccaggggtaattcagttgggggggggaatgtgtgagagagatgagctgtgaagccacgtggtgatgttccccttcctgtctccaaacgttctagtacaagctgatgataaggggacagtggctgtctgtccccagaaaaagatggagctggtgaggcatgggccccacgctaagcctaagcgtctctctatctctacagctaggatttcgacttatggttagggatttaggagggaggcaagataggaatagagggcagagttagcttcagtaagacgtgcttacatagcatggaggagaatgtagaggggaaaaacgtttgtccgggtcaccctgatgcccttcctgcctgtactgagtgaccaagcgtagcctcctcagcctggagtacatgtcaggtaccctgggtgtcatgtagcctagtctccagcaggtggtgctatggccaaggacaaacaacatctgcgtttgaactgtttccctggcctcaagaggtcccccagactcagattggggagcaaagtcctactctggactgcaagacccatagggtctgactcttcctgtagatctgaagaactgggattcaagggctggagaggggtgccaatagcaaagaaggcggatcaagggtccccaggggtgagacgggagtatgtggggtagaggtctggggtggggggcataagatgtctgcaaaaattacttttccagttgtcctcttgcttagctgtcaggagaaaatacagcccaggctggctcaaggctcagctctgagcagaatgaggagtggtcgctgtcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcagcaggccaggtgttcaaacacacaatctggttctgatgttctctttcagcaagcccgaggtgcctggagcctgggataaaagttcccaatggtgcccctgccccacccccgaatgtctccttaatcaccgagcaatttttaccggggcggtaacatcatctcctttgtctcctctagggaaacccaggaaaaacgtgctggtggtggctctccttgtcattttccaggtgaggcttcctgccagggcaagagctctcttccctcctccacaccccctccccagccaggagtgctggaacacaaacagaccgctgcaaggaacgaaaggtctagacacaaacccacctgccgttcacggccccttgccccccccccgcctcccccccacgaagggggcaggcattctctggacttccattgtccccctttaaaataaagcccagggagacgtaacctacccccaccctcgttcttcccagctcccacctcctcactcaggagacagaaacagtgtctgagatctcttagacttgtgcaacacagggcttagagtgggcctggttttgcacataggtgcacacatcatctgtgaactgagaaaaggaccctcggtcgggcgctctggttactccccagtcacccagagttgcttcctcttgcctttcagtccaagggtctccttgtaatctcattctgttttccttcataaaatagaaagaccttggcttggcttgcctgtggggagcaggagggagaatgagtggagcccgggacccgggtggagaggacggtgaagggaacacatagtgggtctgaattctgcagagccaagagcccactccgttctctatcccagcaatggaggcagaacgtgtgtctccccaaccaccagagtcaggagaaactctgagagtcaagtttcctcaattggggtaggactctctcaaggtggggaatggccacggccagcctggagaagcaatgcttcaggatttgactttctcccaggtccggaggccagagggggagctttccaggagctcaggccaggcacaggccccaggctgggcactgttccccaaacccctctcagaggccccctggagcttgggttgcagccccttagcctggccctttccccatcaccactcccgcccctcctgtactgctggctggaaggccagagaagggtaaagacatctgtggctggtttttgtctttcacttgggaggaagggggggggggggttcagacaaggccggatgtggtggggctgtgggctgcagaggcggcaagcttgggggaaggggtgttgaacaggagggagaagagaagactgggagggaggtggtgtgggagcacacttcatagaagctgggagttctgacctccaaagggtctagaagccctttaagcctctggggccgcagacctaaggccacagacccattcgtgaagagccaagcgcagctaacctctcccagggcccccaggctgcagtcaaacctggaccagggaaacaaggttgctatggactcttcttctcaagttagccatgccccaagaaagggctcctgaacaccactttgtccttatcctgtcggtaggctcacaatggtggtgcgatctgtggatcaccactgaatgactgaaaatctcctacccagaggaggaaccctaaactttccaaagtgggccttcaaaccaccccacccccctcccatctgtggtggtccatccatcacacacaggcagacggcaggcaccccctccattgataaaaatcacagcagctgctgaaccgtcccccacacgcaccctgcagccctgctaaagggctaaaaaaagcccagaacagctgagccctgctgattgggatctgccggaagagaggcaaagaggtgtgggaagagggtgggaacacagagggagagtgggggaagagagccgcttccttccaggggcacaagccgccataggaaggcagtcacatttacccaagcactaccccacaggccctacggtacatttgtctacgcgctgagtgtagtgggtaccagggagctgtgaaaatccccatgtctcttatcagcagtccctcgactgaagtttattcctacaaaggagctttgatcttctcttcctgcttcggaccttcctcaaccttgaacctaacatagggggttgtttttttgttttttccctcgaaagctgaggcattttgtagcccccaccccaaaaagaaaactctcctgggacccaaaagaggctccagaagaaagacacactttccccccacatcacagggtcccaaaccccacaacggtccagcacaggagttgcgatttgcctctatctcccagacacagagaagatgtgcgatttccagctcagggctcagcagaccccaaagccctagactatccccaatctcagccagtgaggatgagactggatgtcccaggagttgacaaaacatcaggcctttgctactgatgagtagaaatgtaaactttctggtcctgcctgagtctgcagggccagacgtttacatcttaactagatcctccctgagtaattcatacatgtgctaacatcgttacttagatttattttttgttttggtttggttttttggctttttaagatttttttattcattgaacgtaaatgcatacactgtagctatctttagacacatgagaagaaggtatcagatcccattacagatggttgtgagccaccgtggtggttgctgggaattgaacccaggacttttggaagagcagtccgtattcttaaccctatttaggattattttattttatgggtataaacattttgcctgcgtgcatagaagtacaccacatgcacagaggaggtcagagttgggcatcagagcccatggaactagagttacagagagccacgacgcaccgtgtgggtgctgggaaccgaaccggccttctctaccagagctacacgcactctgctcttaacccctgagccagttcttcagccccacatgctgaggcttaagaggtgtggatttctagtcaaagactcacttggggtttgagggggaaactatagtttcctgggctcctccgtctaagatgctgacccaaagggtctaaggtctgagagtctgcaagagaacagaagccccgggcaatgtcctgactgtgagatccggactgtgagctcatcaggtgcttccttcccccttaggtgtgcttctgccaagatgaggtcaccgatgactacatcggcgagaataccacggtggactacaccctgtacgagtcggtgtgcttcaagaaggatgtgcggaactttaaggcctggttcctgcctctcatgtattctgtcatctgcttcgtgggcctgctcggcaacgggctggtgatactgacgtacatctatttcaagaggctcaagaccatgacggatacctacctgctcaacctggccgtggcagacatccttttcctcctgattcttcccttctgggcctacagcgaagccaagtcctggatctttggcgtctacctgtgtaagggcatctttggcatctataagttaagcttcttcagcgggatgctgctgctcctatgcatcagcattgaccgctacgtagccatcgtccaggccgtgtcggctcatcgccaccgcgcccgcgtgcttctcatcagcaagctgtcctgtgtgggcatctggatgctggccctcttcctctccatcccggagctgctctacagcggcctccagaagaacagcggcgaggacacgctgagatgctcactggtcagtgcccaagtggaggccttgatcaccatccaagtggcccagatggtttttgggttcctagtgcctatgctggctatgagtttctgctacctcattatcatccgtaccttgctccaggcacgcaactttgagcggaacaaggccatcaaggtgatcattgccgtggtggtagtcttcatagtcttccagctgccctacaatgggggtggtcctggctcagacggtggccaacttcaacatcaccaatagcagctgcgaaaccagcaagcagctcaacattgcctatgacgtcacctacagcctggcctccgtccgctgctgcgtcaaccctttcttgtatgccttcatcggcgtcaagttccgcagcgacctcttcaagctcttcaaggacttggggctgtctcagccaggaacggctccggcactggtcttcctgccggcatgtacggaacgcgtcggtgagcatggaggcggagaccaccacaaccttctccccgtagggggctcccctgcccggactacaaggacctctcccaggagccttaatgtggtgcacacatgcacagactctccatccaccgaattgctgctgagggaagagcaattctggccagtcaggttgacatgaggacctaagaaactgcttaaccccatcccacttataactacctcaaccaaagctgtaaaagatatggctgagaagttaacactcaagccaagacagctatccccaaaacgacagccaaaagtgaaagtgagaggctgccacactttccggagtgagggatgtggggccagtgaacaccctggttgagtagtcttcggaggcctctgaatgaacctgcttctagcttagagagatgtcccggagattcaaggacagagcttatctccacacttagcaagcaagcaagagatgacagtctctctaaatgctcccacagagcacccctgcccctcccttctgcctctccaccgcctttcctgaggtccaggccacaccatcagcctgaaggcagtcccagctggggctctggatggcaatgacaagtagttgggtctctatgatgggaataaaaaggtaggggaaaggtgacagaaaggagagaaggtgaccctgctggctgacagaggccagcaagctacttctttgttctctgtcagccactgatacctttcctcatgttctgcttttgattcatatatcttttatgaagaaacaaataaaaaaaaattttccctcgaggaaacaacttggaaagaagggaggaaattccttggttaaatggcgagtgagtgagttgtccccccattccacctgagagtcctgcgccccacacccctccgccccagccttcctttctcagcactcagaaccatgaggtcacagagcctctccggagatgcaaacccaggaggctgcaagaggtggaaaaagagcgaagacaggatgtctgtcttgcacatacacctgcagagcccgtgggatgggacctaggcccttacaggcagcagtatacataggagagcactctgagtatggaaagacgaggttgtcccaggaactcctgtgtctgggaactcagaggaaccccgggttggggggaaatggacacctgcatcctgttgtgtttgctgtaacaggatagcccggaaacagccctaactcttgtcaggccccttcagacttgcgtacattcctctaagaactccagtttggtgggaagctcagacagaggtcatgacattctagagtaagggaactagggactagtcagatgccacaggctggatgggactctgcagggtgtttgagagctaggaccactcggtcccctcctttctacccactagtaacagaagttactgttaccagcctgacccctaagtgcctctgtagtgcgagtctcagtccatccccgtttcctgtaacaaaacactgcggtctgcggaacttatacacaacaggaatctatctctcaccattctagaagtgagacaacttccactctagtatctcccaagtccatttataaggccttaaatccattcatcagggtggagccttcacggccagccagttatctctcaaccaccccaccctccaataccatcatcccctagggttcaaattcaaacacaggcctattggagggacacacacattcaaaagacagcggtgtggaaagcagagggagagggccagactctgtcgcccctcactccatccccacaggccaagtgtccttgtcattgtgtcccagtgtctaaccaaagccctaatttccccaagcccgagagcttggtccaaactatgatacctgggcaaatgtccaatggcttagcacccgaatagctctgagcctggcggtaggatgagggtggggggtgggagaaaaaaggtgagacattcacacaaaaacatagttccaatccccccccccccaagaaaaaagaaaaatggagcctgttccataacagtgctcattctctaagcttgtaaccacaaaacacccattaccctcctccacaggatgcatggggctagaaagactttaacacaatttgtcaggcggcctcccggtctggaatcagcatcgtgggaggaacgaggctggctcaagtgcaggcagtggctggtggcgggtggcgggtggcgggcagctttcgggatgctggtactgaatattaaaaaggttcagttgcgactgtgtgaccacaagcacgctgcaagaaggcgatgccactggccacggtcatccccaaggggaacctgccagagtgcacgtggctttgtagatcctaatgaagttacagatgggaaaacagccctcgattcctaccagggaggaaataatggagggatcacggaaggggaagctgggccaaccacacaagcatgccaccctggcctcaaatacattgcgctagtataactggacatctccaaatatttacagaaacaacagaacccccagcaatgctaattccccaaactgctgtgtctcagaagttctatcctcagcttcacgctggcctgctgcctaagacctggcctgatgcactcttgtgcctaccaagggtgatccccaggatacaagaaagcaccctgcctgaagcccacccaggtcttctttctcattctgcccttctcgtctgctccatacaacagccccatgcctctaaatctgtgtcccttgccacgccatcattctgcaattgccccaagctccttccattccactaacagtcccttgtccacgccccccacgcccagtcccannnnnnnnnnnnnnnnnnnncacacacacatcagccctaactcagatcccccctggctgtgaccctaggccaaatgtaagacattcccaggtcatgaaactgccctttctgctagaagtgccgaacctttaataggttcctggagacctcaggaagcaggggctgacccctgtcgttctctagacagagcaaggagctggcttgtccaaagagacacagcaatgaggggaggttgcttaagctagctgtggagcctgagggtctggcagagttgccaaaaggggggatggagcctggcctactctgaatcccaaccctgccgctccccagctgtgtgaccttcagctgttgctcaactgctctgaatctcagatttctcaattgcaaaacaagggagatttgggtaaacacttagcacagagccagaatgttgagcgaggcagcagcaggggagctcccactccacagccagatggcctggttcatgtctccgctcccttacggtgcggtgcctcggtttccaaacctgcataatggagttattagtcgtgcctgcctcccaggattgaggtaaggaagcaattcatctacaaaagcaaaatatttagaaatacccgggcaagtgatatcatcttttgggagatagttgagaaattatagatttaaaacattgcagggatggagaggtgggtcaatggttagagcactggctgctcttccagaggacccaggttcagttcccagaatccacatggcagctattaacggtttgcaaatctagtgtcagataatgaggtacagtgccatgtatgtgtggggtacatgcctacatgcaggcaagacactcatacatataaaatgaaaataaatcttttgttttgttctgttttcattttttggaaacagtgtttctctgtagagtcctagcagtcctggaattgactctctagaagagaatggcctctaactcagagatccatctgcctctgtctcccaaaccctggggttaaaggtgtaggacaccacccaccggcataaataaatattaaaaaataaaataaaaatgtttctttaaagagacagagagagaaaaggcacaagagatggctcagtgggtagtgtttgttgtacatgaggccctgagtccagattcataacccacactcacaggccagggttggtgttgcggacgatgaagaaacagagatgctagagcctctggccaaccaagtctaacagaaagtagaagcttcaggcttcacaaagagacccccatctcaatagataagcaataagtaaatgatggagaacagaggcagacaccccagtgtctctctgccctccacctgcacacacacgaaggagagaaactcttgctaagttcaaggtcaccaccttcagttcctcagccctatgtctgttcacacgcaatccacaacaaactggaggacaccttagatgagagtctggtctccccacagggtggccaggagagacatttgaggcacaaggagaaggagatcacctgaggtctctaggggcctctctgatactcagaatcctaacgccctttaggtccaccctcaatccggtctgccagcatccatccttaatacgaacctctcttgcctgcagacagctcttgccttgataatgagtcttctttgagaacgaggtactcacttgcgggttttttgagtcaaggacagagtaggtaaggaagaaacaagcctatgagatggtgggaataaaggacagagtcggagaggagattctgaattcggaggaaggagcagggatgggggagctgtatattggagacgagacatggagagtatatccagtgggcagatgaatccgtgtgtgtgagtgagtgagtgtgtgtgtgtgtgtgtgtgtgtgtgtgtgtgtgtgtgtgtgtgtcctccctcaagtctcctagtctcacaggaagaaatgattccatgggtgtttgttcttttcaagggaaaggttagccggggtgtggtggcgcacgcctttaatcccagcacttgggaggcagaggcaggcggatttctgagttcgaggccagcctggtctacagagtgagttccaggacagccagggctacacagagaaaccatgtttcagggagggggaaggaggaagaaggtcaagtttccctacactgagtccctgaggactctcactctcaccccaacaggaacccagcttttccacacaccaggcatcccagccagggacacagatgaaggcactgtcaacagaagcaccagctagaacttctgtgatcctgaggtcacatggcccacaggttcctccctattctgatttgtatgtgacccgatcacatttccttgcagatgttaggtttaccccttcccttgtgcactttgaaaatggctactgccagcggggggcgtggtgccgcatgcctttaatcccagcactcagaaggcagaggccagctgatctctgtgattttgaggccagcctggcgtacatagtaaattccaagatgcccaggagaaaaaggaaggcagaagcaaatggctatcgctctattttgtctactgcccactgatcccacaaagttccctgaccaggctgttgtggcactgtgtcacaccacagtgaccccaccgagttctcatctcccagtgtgacctacgggtagtctgccctgaagtggatacccaagtcctctatcacgagggcaggagaggggacttctcaatccatgtcacagcttgcctaggacagtgtacgttatgtttgctctaaacaaatatcattgtgaagctgaacagatgttgcagataaaatgccctaaaccctttccctacgtttcaaagaagctgggaactcaggcgtgctagtcttggatggtttctgcatctgtggtccagtaactggcacgcgcaatctctcttgcaaaggcagaggtgaattcttctggccccgggggtgttttctgcagcctggctagctccagacctgtaattaagtctagtggtatgctggcaaggatgtggagaaagaggaacactcctccattgctgatgggattgcaagcttgtacaagcactctggaagtcagtctggcggttcctcagaaaattggacatcgtattaccggaagatccagcaatacctctgctgggcatatacccagaagatgttccaacagataataaggacacatgctccactatgttcatagcagccttatttataatagccagaagctagaaagaacccagatgtcccttaacagaggaatggatacagaaaatgtggtacatttacacaatggagtactactcagctattaaaaacaatttatgaaattcctaggcaaatagatggatctagaggatatcatcctgagtgaggtaacccaatcacaaaagaactcacttgatatgcactcactggtaagtggatattagcccagaagcttagaatacccgagatacaatttgcaaaacacaagaaaatcaagaagaaggaagaccaacgtgtggatacttcattcctccttagaatagggaacaaaatacccatggaaggagttacagagacaaagtttggagctaagacgaaaggatgtaccatccagagagtaccccacccggggatccatcccataatcagccaccaaacccagacactattgcatattgccagaaaggaccctgatatagctgtctcttgtgaggctaggtcagggcctggcaaacacagaagtggatgctcacagtcatctattgaatggaacacagggcccccaatggaggagctagagaaagtatccaaggagctgaaggggtctgcaaccctataggtggaacaacaatatgaactaaccagtaccccccagagctcgtgtctctagctgcatatgtagcagaagatggcctagtcggccatcattgggaagagaggccccttggtctttgcaaaccttggtacaggggaatgccagggccaggaagcgggagtgggtgggttggggagcagggcgggaggagggtatagggaactttcgggatagcatttgaaatgtaaataaagaaaatatctaataaaaaagtctagtggtggagaatcacccaagtgggaaccatctttgctcctgcactacagctctcacaggactggtagacatgccatcttgttcgagctaccacctctgtctaccacctaccctgcccgtcatgctctggctctgctgggttggccgttgacaatctctggactagaaagcctggtcagggaatgaacgcgatgagaactcgtgcctgctctaaccacagtctctctctccatcaccccagcagagccaaccctaagcagactacgaactagaagagcttccgagctttaggttaaacacagcagagcaggggaaacacaggaatcacgagggatcgggagggaggggaggttttgaggaagggaggaaggaaggatgtgctgacatttgcttagtgtccattctagggatccacctggcactgaatccacaagtgaggaagccaagggtgagagcaggctggtgtaactgactcatggtgacacagccagcagctgtgctaagattatattccctacttcatttatactgtgtattgaaaccttaccttattgaagtctgtcctgtctgtctgtctgtctgtctgtctctctctctctctgtttttttttttttttttttttttcgagacagggtttctctgtgtagccctggctgacctggcactcactttgtagaccaggctggcctcgaactcaaaaatctgtctgcctctgcctccctcccaagtgctgggattaaaggcgtgcaccaccacacctagccttattgaagtgttttagcaatcctattgaaggcccattttacagatggggaagtaaagcccagagaggggaaagtgccaaagccataaggcaataaaactactaaaggatgtcagccagttctagctggcctccaaaggccaatttgcatctgccctcttgctgcaccatttaaccacatagttgcctactcttatcaaatccaatcaaatgcagctaggagctaggcactgtgctgggtgtacatagcatctctcaaagcacgctggatgcagagttctgtcctgggaggaggcacggtcgaatgagtaccgccttcagggagcagggaaacagcccggctgtgataggctgtccactccttcttcccactgggccctgcttctctctcaggccttcttgggcctcctggctctgccatggagccactgggcaacatgaacaagtcacctgtctgctgcagctcctctagagcaaaagaaagttcctagatggagtgagttttacacccatcccctgcggttctgaggtgccttgggcatattgactgggtggggtcagggagcccacatctcagggcatgttgacgcctggaaggggtgcaaagtgcctgggtgaggggctgaggaagctactccacccccagctgtggtttctggtggggccactggtggcagcaggtgaggggaagtatctgtcactcttccaacaaaggcaatcaaacaaaagcctcctggggcattgtgggaactgcagtaaaggcgccaaaaataaaacacaactttcctttgataggcactggtagctgcctgggggttgtgacaaaagtgttcagatttcacacctcagttcataccccacacacacacacacacacacacacacacacacacacacaccagtctcacaaacaagtcatataataggcagtcaatgatcccagaagaaacatctccgtgggctgtgacacatgtcacaagaaccacatatgtgtcaaatggcttgtcctttccattttgaaatgttcaatattttaaaagaacttttaaatatcctattttatttcatgtatattggtttttgtctgcatctatgtctgtgtaccctaccattcacaaaggccagattagattccctggaactgggattatagacagttgtaaactgccaggtgtgtgcctggaatcaaacttgggtcctctgaaagagcaatcagtgcttttaaaatatatatacatatgtgtgtgtgtgtgtgtgtgtgtgtgtgtgtgtgtgtgtgtgtgtgtgtgtgtaaaatttattttatgtatatgagtacactgtcgctatcttcaggcataccagaagagggctttggatcctataacagagggttgtgagccacagtataattgctaggaattgaactcaaggcctctggaagaacagccagtgctcttgaccactgagccatctctccacccctaaagttttcagtatgttttaagcaaggagctgaacggggtattttgttctttgtccttcaagctacagaaccaaacttgctagcattcattcataaatattcatatgggcagtatgcctaaaaattataaaatactgataggcaaaagtgcatacattgcccacacagcgagaggaacagacacatagaccccccccccccacacacacacacacactggtactacaggggctcccctgtgtacacacactgcagtacaactgcttcccccataagggacattgacacccactcgaaaggcccagagagagctcaaccacaacccagtgacatgaatggattgacttagccagatcaaggcacctcgatggcactgaaaggaagggcttaatctcctttactgtatcttcaactgtcacagctggcctctctttcgggctatgggctcatccaccaacccttgcagcggagactaaggaaaaggagaccttggggagtagaggaatccttgggaggagaggttgggaggaggagaagaacattagccaaaaacagcaggctgggcgacaacggaggcgcctagtgaactggcctgagtggtggttctgaaagagcctgggggaggcgggggcaggtcttgaacccagacaagtccgagctcctgctctcacatgaacagccaatcccttgccccactcctctttctagctaggtggccttgggcacatggctgaacttgcttggcctcagtctccatctccacggaatgagaaagtattgtctgcatggcagggttgtgtggtgcatgtggaagttgcggcctcatcttctgggctctcccaacattcaacagtttgccttctttcccggccttgcaatccgactcttgcttcagaaactccagaccccctcattaacggcagaccttcagaatgtgtttatttcttgtctccccacccccaccccacttcccagccagatgcaagcatgggaggtggccgtagttcaaggcccaccctcccttcggggactttcaacgttcctcagttccttttgatcccatagctccagccacaagccaaacagcccccaaggcctccaaagttttctgcctgtgctctctacccctaaccccagtgctgcctgtaagaaaccgttccaggctctgcccagaagcccctccatcctgttaggtgataccagatgctcaaagagtgacccagaaaaacaattcttttcagctcattgtgatggtgcacatctgtaaccccaccacgctgaggaggctaagggagaaagagagaattctcggccagcctgggctacagatcaagaccctgtctcagaaaaattccaacaaaattgctggggaaatattgctcaaccatcggaatgcttacatagcatgcatgagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 972 - DNA, 2072 bp, Mus musculus
ggacatggactgctatctgcgtcgcctcaaacaggagctgatgtccatgaaggaggtgggggatggcttgcaggatcagatgaactgcatgatgggcgcagactgggctagctggagagagacaagaaccaaaagcacagccttcctgtgtgatttctacagcccccagagcaccatggacccagggaaacccaggaaaaacgtgctggtggtggctctccttgtcattttccaggtgtgcttctgccaagatgaggtcaccgatgactacatcggcgagaataccacggtggactacaccctgtacgagtcggtgtgcttcaagaaggatgtgcggaactttaaggcctggttcctgcctctcatgtattctgtcatctgcttcgtgggcctgctcggcaacgggctggtgatactgacgtacatctatttcaagaggctcaagaccatgacggatacctacctgctcaacctggccgtggcagacatccttttcctcctaattcttcccttctgggcctacagcgaagccaagtcctggatctttggcgtctacctgtgtaagggcatctttggcatctataagttaagcttcttcagcgggatgctgctgctcctatgcatcagcattgaccgctacgtagccatcgtccaggccgtgtcgcgtcatcgccaccgcgcccgcgtgcttctcatcagcaagctgtcctgtgtgggcatctggatgctggccctcttcctctccatcccggagctgctctacagcggcctccagaagaacagcggcgaggacacgctgagatgctcactggtcagtgcccaagtggaggccttgatcaccatccaagtggcccagatggtttttgggttcctagtgcctatgctggctatgagtttctgctacctcattatcatccgtaccttgctccaggcacgcaactttgagcggaacaaggccatcaaggtgatcattgccgtggtggtagtcttcatagtcttccagctgccctacaatggggtggtcctggctcagacggtggccaacttcaacatcaccaatagcagctgcgaaaccagcaagcagctcaacattgcctatgacgtcacctacagcctggcctccgtccgctgctgcgtcaaccctttcttgtatgccttcatcggcgtcaagttccgcagcgacctcttcaagctcttcaaggacttgggctgcctcagccaggaacggctccggcactggtcttcctgccggcatgtacggaacgcgtcggtgagcatggaggcggagaccaccacaaccttctccccgtagggggctcccctgcccggactacaaggacctctcccaggagccttaatgtggtgcacacatgcacagactctccatccaccgaattgctgctgagggaagagcaattctggccagtcaggttgacatgaggacctaagaaactgcttaaccccatcccacttataactacctcaaccaaagctgtaaaagatatggctgagaagttaacactcaagccaagacagctatccccaaaacgacagccaaaagtgaaagtgagaggctccacactttccggagtgagggatgtggggccagtgaacaccctggttgagtagtcttcggaggcctctgaatgaacctgcttctagcttagagagatgtcccggagattcaagacagagcttatctccacacttagcaagcaagcaagagatgacagtctctctaaatgctcccacagagcacccctgcccctcccttctgcctctccaccgcctttcctgaggtccaggccacaccatgacgctgaggcagtcccagctggggctctggatggcaatgacaagtagttgggtctctatgatgggaataaaaaggtaggggaaaggtgacaggaaggagagaaggtgaccctgctggctgacagaggccagcaagctacttctttgttctctgtcagccagccactgatacctttcctcatgttctgcttttgattcatatatcttttatgaagaaacaaataaaaaaaaaattttccctcgaggaaacaacttgg

SEQ ID NO: 973 - DNA, 1137 bp, Mus musculus
atggacccagggaaacccaggaaaaacgtgctggtggtggctctccttgtcattttccaggtgtgcttctgccaagatgaggtcaccgatgactacatcggcgagaataccacggtggactacaccctgtacgagtcggtgtgcttcaagaaggatgtgcggaactttaaggcctggttcctgcctctcatgtattctgtcatctgcttcgtgggcctgctcggcaacgggctggtgatactgacgtacatctatttcaagaggctcaagaccatgacggatacctacctgctcaacctggccgtggcagacatccttttcctcctaattcttcccttctgggcctacagcgaagccaagtcctggatctttggcgtctacctgtgtaagggcatctttggcatctataagttaagcttcttcagcgggatgctgctgctcctatgcatcagcattgaccgctacgtagccatcgtccaggccgtgtcgcgtcatcgccaccgcgcccgcgtgcttctcatcagcaagctgtcctgtgtgggcatctggatgctggccctcttcctctccatcccggagctgctctacagcggcctccagaagaacagcggcgaggacacgctgagatgctcactggtcagtgcccaagtggaggccttgatcaccatccaagtggcccagatggtttttgggttcctagtgcctatgctggctatgagtttctgctacctcattatcatccgtaccttgctccaggcacgcaactttgagcggaacaaggccatcaaggtgatcattgccgtggtggtagtcttcatagtcttccagctgccctacaatggggtggtcctggctcagacggtggccaacttcaacatcaccaatagcagctgcgaaaccagcaagcagctcaacattgcctatgacgtcacctacagcctggcctccgtccgctgctgcgtcaaccctttcttgtatgccttcatcggcgtcaagttccgcagcgacctcttcaagctcttcaaggacttgggctgcctcagccaggaacggctccggcactggtcttcctgccggcatgtacggaacgcgtcggtgagcatggaggcggagaccaccacaaccttctccccgtag

SEQ ID NO: 974 - DNA, 31670 bp, Homo sapiens
aatatatgaaacaaatattgacagaattgtcaaagaaataagagaaacacataaagcaagaaataagagaaacacataattcaacaataatagaaacttaaatatcctcctttcaataatagatacaacaactaagcagttgatcaacaagaaaacagaagatttgaacaatgctatgaaccaactagacctaacgtctatctataaaacaccacccaacaacagcagaatacatattcttctcagatatacatagaacattctccaggataggccatctgttaggacataaaacaagtctcaaaaaatgtaaaagaattgagatcagacaaagtctgttctctgaccacaaccagtaacagaaggaaatttgaagaatccataagtatgtggaaatgaatcaaggaactcaagggaaattagaaaatactttgaaatgaatgaaaatgaaaacacagcataccaaaacttatgagatgcagctaaaatagtgcttacagagaaattaatagctattaatgcctgtattttttaaaagaagaaagataccaaattaaaaaaaaacttttcactttaagaaaaagaatagtgaaccaagcccaaatcaagcagaaggaaggaaataataaagattagaatggaaaaaaatgaaatatggaattggaaaaactagagaaaaattaacaaacccaaaagttgttatatcaaaaagattgataagtttgataaacatttaactagacttaccctaatatcaaaaccacatacagatatcacaagaaaagtacagaccaatatctctcataagacacatataagatagatgcacaatttcttaacaaaatattaacatgccaaatccagaaacattacaaaaaaaattgtataccatgaccaagtgatttattccaggaattcaaggttggtttaatataaaaaaatcaattcatataatacaccatatttaatagaataaagggcaaaaacactcaattgtctcagtggacacaggaaaggcctccaactccctccatgtccctccaaaggacattatctcattcctttttatggctgcataatattccatgatgtatatgtagcacattttctttaaccaatctatcattgatgggcatttaggttgataccatgtctttactattgtgaatggtgctgcaataaacatacacgtgcatgtgtctttataatagaacaatttatattcctttgggtatatacccaggaatgggattgctgggtcaaatggtatttctgtctctaggtctttgaggaattctatactatcttccacaatggttgaactaatttacactcccaccaacagtgtaaaagcattcctttttctccacatcaccagcatctgttattttttgaatttttgataatagccattctgactggtataagagggtctctcactatggttttgatttgcatttctctaatgatcagtgtgttgagcttttcaaaatatgattctgggtcacatgtatgtcttcttttgtgaagtgtcttttcatgtccttggcccactttttaatttttttttcttgtaaatttgtttaagtttttatagatgctggatgttagactttcgtcagatgcatggtttgcaaaactttttttcccactgcgtaggttgtctgttcactctgttgatagtttcttttgctgtacagaagctctttagtttaagtagatcccttaatttacttatttgtcaatttttgtttttgttacaactgcttttggcatctttgtcatgaaatcttggcccgtgccttggtcctgaatggtattgcctaggttttcttctagggtttttatagtttttagttttacatttaagtctttaatccatcttgagttgatttttgtatatgctgtaaggaaggggtccagttccaattttctacatatggctagccagttatcccagcaccatttattaaataaggaatcctttcgctattgcttgtttttgtcacgtttgttgaagatcacgtagttgtaggagtgcagtcttatttctgggttctctattctgttccataagtctgtctgtttttgtatcagtaccatgctgttttggttactgtagccatgcagtataggttgaagtcaggtagcatgaggcctccagctttgttctttttgcttagggttggcttggctatttgggctcttttttggttccatgtgaatttttaaatagttttttctagttctgtgaagaatgtcaatggtagtttaatgggaatagcattgaatctataaattgctttgggcagtattgtcatttccacaatactgattcttcctatccatgaacacggaatgtttttccatttgtttccattatttctaatttctttgagcagtggtttgtagttctccttgtagatgtccttcacttcccttgttagctgtattcctaggtattttattctttttgtggcaattgtgaattggagttcatgcgtgctttggctctctgcttgcctgtttttggtgtataggaatgctagcaatttttgcacactgattttgtatcctgagaatttgctgaacttgcttatcagctgaagaaacttttcggctgagacagtggggttttctagatataggatcatgtcatctgcaaacaggaatagtttcacttcctctcttcctatttgagtacactttattcctttctcttccctgaatatgactgccctggccagaacttccaatactgtgttgaataggagtgatgagagagagcaaccttgtcttgtcctgattttcaaggggcttacttccagcttttgcccattcagtataatattgtctgtgagtctgtcatatatggctcttattattttgaggtatattccttcaacacctactttattaagagtttttaacatgaaggggtattgaattttatcaaaggccttttctgcatctatggagataatcatgtggtttttgtctttagttctgtttatgtgatgagtcacatttattgatttgcatatgttgaaccaaccttgcatcccaggggatgatgaagccaaatttgatcatggtggataaactttttgatgtgctgctggattcggtttgccagtattttgttgaggatttttgctcaatgttcatcaaggataatggcctgaagttttctttttttgttatatttctgccaggttttggtatcaggatgatgctggcctcacagaatgagttaggaaggagtctctccttttcaatttttttgagtagtttccgtaggaatggtactcttttctgtacatctggtggaattcagctgtgaatccatctggtcctggactttttttggttggtaggctgtttattactgcctcagtttcagaactcgttttcagtctgttctgggattcaatttcttcttggtttggtcttgggagggtgtatgtgtccagaaatgtatccatttcttctagattttctatgcacatagaggtgtttatgatattctctggtggttgtttgtatttctgtgaggtcagtggtaatatctcccttatcatttctgattgtatttatttgagttgtctcttcttcttctttattagtctaactaacagtctatctattttattaacttttttgaaaaaccagcctggattcattgatattttgaatggttttttttttatgtctctatctcctttgattcagctctgattttggtcatttcttgtcttctgctagctttgggacttctttgcccttggttctctagttcttttagttgtgatgttaggttgttaacttgagatctttctagctttttgatgtgggcatttagtgctataaatttactccttaatactgccttagctgtgtcccagagattctggtatgttgtatctttgttctcattagtttcaaagaactgcttgatttctcccttaatttcatgatttacccaaaagtccttcaggagcaggttgttcaatttccatgtagttgtgttgttttgagtgaatttcttagtcttgagttctaatttgattgtgttgttgcccaagagactgtttgttatgatttcagttcctttgtatttgctgaggagtattttacttccgattatgtgatcaattttagagtaagtgccgtgtggtgattagaagaatgtatattctgttgtttgggaatggagagttctatagagatctatcaggtccatatattccagagctgagttcaggtcctgaatatctttgttaattttctctctcaatgatctgtctaatggggtgttaaaacctcccactattattgtgtgggagtctaagtctatttgaaggtctttttgagcctatgtctgtctttgcatgtgagatggatctcttgcagatagcataccaatgggtcttggttttttatccagcttgccactctgtgtcttttaattggggcatttagcccatttacacttaagattagtattgttatgtgtggattcaatcctgtcatcatgatgctagctggttattttgcagacttgtttatgcggttgcttcatagtgtcactggtctgtgtacttcagtgtattcttgtagtggctgataacagtttttcttttccatatttagtgcttccttcaggagttcttgtaaggcaggtctggtggtaatgaattccctcaacatttgcttgtcctgaaaggatcttatttctccttcgcttatgaagcttagtttggctggatatgaaattctgtattggaatttctttcctttaagaatgttgaatattggcccccaatctcctctggcttgtagggtttccactgagaggtctgctgttagtctgatgggcttccctttgtaggtgacctagcctttctctctggctgcccttaacattttttctttcatttctaccttggagaatctgatgatcatgtgtcctgggaatgatcttctcatggagtatctcactggggttctctgcatttcctgaatttgaatgtttgcttgtctagctaggttggggaagttctcctggaaaatatcctgaaatatgttttccaaattgtttccactctccccatctctttcagataccccaatcagtcatagattccgtctctttacataatcccatatttcttggaggttttattcattccttatcattctttttctctattcttatctgcccgtattatttcataaagacagtcttcaagctctgagattctttcagaggaagaatctttcagaggaagactaagcagaacttggcctattcttctatgaatacttctgattgcattgtgaagttcttgtagtgtgtttttcagctcgatcaggtcagttatgttcttctctataatatctattttggctgtcagctcctgcattgttttatcatgatttttagcttccttgcattgggttacaacttgcttctttagctcagcgacgttcatttttatccacattctgaagtctacttctttcattgcagtgatcttagccttaccccagttccaaacccttgctggagagatgctgcagtcatttggaaggaagaaggcactttggctttttgagtttttagtgtttttatgctgattctttctcatctttgtgggcttatctacctttgatttttgaggttgctgacctttggatggggttttggggtttcttttgtttttcttttaacaatctggccacttttccataaagctgctgtggcttgctgagggtcccctccagactctagtcactttggattttccagtacctggaggtatcaccagtgaaggctgtgaaacagcaaaaatggcaacctgccccttcccctgggagctccatcccagggaggtatgaacctattgctggcctaaacacacctgtaggagatggccggagaccccatttgggaggtctcacccagtcaggaggaacaggattggggagccactgaaagaagcaatctaaccacacttccgaagagaaactatgctatgctgggcaccacttgcatccccagttggcttgggatctccaaagcctggagactggtgtggctaagtcgccaaaacagcaaagatggcagcctgcccctcccccgaggagctctgtcccaggaagtcttcaaatctctgtcagccagagaacatcgacaggagtggctggaggccacagttgggaggtcctgcccagtgagaaggaatggattagggaccctcttaaagaagcagtctggccatattttggtaaagcagctgtgccacgttgggagatcctttcagcccccagttggtttgagctccccaaagctgaaaggctggaatggctgggatgcccaaacagcaaaggtggcagccctctccaccatccaggcaccctgtcccagggagagatcaaaattttatgggctgtagaaaatgggcagaggtggctgaaggccttgtttgggaagacccacccagtgaggaggaatggataggagtcctgcttaaaaaaacagtctggccacgttttggcagagcagctgtgctgtgctgggggatcctttccacacctggtgggtttggactctccaaagtctacaggctggaacagctgagtcgtccaaacagcaaaggtggtgcccctcacccccaccccagccacccccagaactccaccttgtctcaggtaggtgctacactgttgcccgtggctggctggaattccaagccagttggtcttatctggtgaggtgctgtggaagtgaggcccacagaccaatgctgctcagctccctggattcagcctccttcctaggggtatgtacagacctcctgccttgcctgaatggcggtcacctttgctggggttccggagcctgagtatgtaaagctcctgggtgtctgtgcatgcctgagcagctgctctgccaataatccaatgcagctctgtgtgtaagacccaaaggcctggtggagtgggttcacaggggatctcccgatccaaaggttgcaaagatcggtgggagaagcatcattccccaggtttgcacattcactcaccacttccctggtggggggaggggagggggtttcctttgggtctgtgttgctcctatgtaggccattgccctgccctgctttcctctatcctctgtgggtcgagctgattccttaatcagtcccaatgcaagtatctggatgtttcagataaaggttttgaagtacccacccctttgttcctctctgagagagccatgccccatacctgcttctagttggccatctttgaaaataaaattaagaaaacaatttcatttacaagcacatcaaaaagagtaaaatacttaagaaaaaatttaacaaagaagtgaaagacttgcagcctaaaaagtataaagaaattaaggaagacctaaataaatgaaaaaaatcccatgttcatggaccaaaagactttgttagaatggcaatactccctaaattgatttacagattcaatgaaattcctattagaatcccagctggtttcattgcagaaattgataacctaaaattcatatggaaaagagagagatgcagattagtcaaacaatgtttaaaaagacagataaagttggagcagtcacaactcccaatttcaaaatttgctataaagctacagtaatcgagacagtgtggtactgtcataggacagacacagagattgataaaatagaattgatagtctagaaataaaccattacatttatgatgaattgatttccaacagaggtgctaagacagttcaatggtggaaaaaatagtcttttcaacaaatgatgctgggaaaactagatatccatataaaaaatgaagctggatccctacctcacaccatatgcaacaattagctcaaaatggatcagatctaaatgttgcagctaaaactataaaagtcttaaaagaacatatacgaataaatctttgtatacttgaattatgcaatggtttcttagatatggcaccaaagacacaattgacaaaagaaaaataaatcaattgaacctccacatttaaaactttgcgcttcttttgccagagattcaggttttaaaaaacaaaaagcctttgtgcttcaaaggacgctatcaagaaagtgaaaagatgatccatagtaagggagaaaatatttacagatatgtatcagataagggattgtaaccagaatatataaagaagtcttacaactcaataataaaaaataaataacccaattttttaaatgggcaaaggatttgaatagaaatttctcaaaaaataatacaaatggtcaataagagcatgaaaagatgctcagcataggtagtcattaggaaaacgcatatcaaaactacaaagaggccgggcatggtggctcatgcctgcaatcccagcactttgggaggccgaggctggcagatcaccttaggttaggagtttgagaccagcttggccaacatggtgaaaccccgtttctactaaaaatacaaaaattagccaggcatggtggcacgtgcctgtagtcccagctacttgggaggctgaggcaggagaatcacttgaacccaggaggtggagactgcagtaagccaagatcgtgccactgcactccagcctgtgcaacagagtaagactccatctccaaaaaaaaaaaagaaaaaagaaaaaaaacacaatgagataccactttacagccactaggatggctagaatcaaaagaatggacaatagtaagttttgttgacaatgtggaaccctcacgcattgttgatgggaacaaaatggtgtagtcactttggaaaacagtttgatagttcgtcaaaatgttaaatatataattaccatatgactcaacaatttcacttctaggtatatacccaagagaaataaagcatatgtccacacaaacacttgcacataaatatttatagcagcatcattcataatagctaaaagggaaaacagcccaaacatccaactgatgacagacaaacaaaatgtggcatatccatacaatggaatgttattcagccataaaaaggaatggggaatggatccataccaccacataggtaaccttgaaaacactaactgaaagaagccagatgtgaaggtcacatattgatacttctatttatgtgaaatgttcagaataggaaaatctatagagccagaaagtagatttgtggttgccaggggctttcgatgacaggaggggaggggagcagtcattgctagtgattacagggttcttgagagggagtgagaaaaaatgttctaaaatgtattgtggtgatggttgcataactctgtgaacatacaaaaaccattgaattctatactttaaaaaggtaaattttatgggatgtggattatagctcaataaagctgtcattaagaaaggaaaaggaagggaggggagaagagggaaaggggagggaggggaggggaggggaaggggggagaaaaaagatacatcgtggcatatctcttcccttttacctgtcattatgtgtcagtgcctcccattggcctaaactacccagaagccagagggaaagccatttgggactatattccactgtgacactgagcagagcaagggaaggatggggacacttctctcacacatctctgactccccaacatctaacccatggcctggcatgtgatattcatgctataaatatttgttgaatcagtaaatggcccctcatctagattctgccaggcagcgcagggggctttttgaatgtaaatgacctaatgattcaggatcctatgaccagcgactgtcaccctctgtcacctttcttctgcccctttatctctgaaggcattgaaggggccctgcatgagtcagggagggctggggggaggagcaagggtgggaggggcagggaagagggtggcttctccgacaacttaaaaggggcttgaaccacttcctccccagacaggggtagtgcgaggccgggcacagccttcctgtgtggttttaccgcccagagagcgtcatggacctgggtgagtgagcctcttcatgtgagaaggaacagtaccagggtcttggacacccagactgaccctgtggaatgggggtggaggatgcgggtggagcgcataggggtgcttcctggagaaatcagttctgatttggtgggcattggaagctacttccagagaatgccccctgctgtcccaggaggggtgcacctgccctttcagacctggagaaggggtcagcctttggtgccagtggggacaagggaggggccgagatcatgtctttctaaaacagcagggacataagagagtggcggggctgggcttggtggtctggcagaacctgttctcatcatgagggtgataggttaggccctctgggacctctggggacaggtttcaacagagaaattctccctagagagcttaggaccttttacccactctctgattcccacctttctcccctgccaaatattcatatacctgtccacttggggtcatgaggagatgcaaatgaaacgtgactgggttgtgagaatggtgcggtgcattgcaaatgcaagctctggttgctttctctctgctgcacatcccacctgctttgatctggctttgctgttgcctcttgcaagttaaggaacgggcaggcaacatggaatgggatggcaaggggcactcagcttggagaaatcatagccaggccttcagcacagcccctgcccctgagcaaacctcacgcactctgccccggcagataactctactctttagaaagccctttctcaggtctaacctagaaggggtcaaggggaagcactgagggtgttctgagtggttcatccagctccagacgccccctttataaatctcagctgtggagtcagaccaggctgaggctaagaagaccaggttcctagatggcttgtctcaccagcaaacaatgcaccacggcggcctcaaagccgcaaagggttggctttaaaaagtgaaggttccctggtgctgtcctcacacccctcctcgccacaccacagcctccttgatttcatctcttactttcccgcctgccctgaacgctggatctggacccagcaaacagctgtgaaagggttaaagtggtcaccccacccactgactgtgaactcctgaaaggcaggttcaggtgctttgaggatgtgaggagaaaatgtctgcggaatgaatgaatacaccgtatcaagaactccgtagagtttagtttttgaaaatctcttccaaatgcctcatttcccagccaatctacccttaaatcccactcccctgcaccccctccaccaccccccatcacaatcccacagtacagacgtcacccacagaagaccctgctccagcctttcatactggcctccaggaaggaaaccaagcagtgcccagtggtgtgctactgggcatttgaaaagcagctccccggggtggagcactggtagctgactccagggtggagggaaagtcctgaatttgtagtgcttgccaatttccatggtgtaaattctcccaccctggctgattgatttcaagccatctacatgactgaacagggggttgggaagatgtgcagagtgtcttaccccagactaggtttaggggtgctagactcctaggctttgatgcagggagagagggtaatctctggtccaggaagaagggatattcttgccacttcactcaacttgagagagccccaacggtcaaacccgaaatactggtaggaggggaagccgctgacaagctttactcaaaacgggctctctgggccgttgatggggtgggtgggccttggaggatctgttgttctgctcttcatctgcccagcaaggagcaagaggtgggtgaggagggagggtttctgttacacaaaatgaaaactcccaagcagggctgagctggcctttttcacggtttgaatgagcagctctgaggcaccctccccaccttcgagcaatgagaccgaagatctttcataattctcaaaagcaaagcaaggaaaaaatgaacccatgagagatgtgtgcctcacagctcggacataaatggtggcaaagggggatgctgaagctaattcagggccagtttcttgcctgccagaaacttggctggggaggagaggaacgctgcagcctggggtcgctgttggaaaaaatctctcctctttgcttcggacattcaggcaactctcattgtttgagggattcagggatgaccagtctggtggggagagtgacacatatgtcacaaagccactgcaacagaataagatacagcattgaccagggcaagggcaagacaagaagggaatagtgaacctgggtcagagaggtatttaaggtgggttttcaagggtgtgtaggagttgtcaagcccaacaaggagctgcaatgggcccaggatgtggcaggaatggcaaactccattgccatcagaggccgacaaggtaatagagggaatgggcataaggtgcaggaagtggaggggagtagagtgacccagagggtgcatgccccacctaaaggcattcaaatctattatttcaaaaactccatgctgacaagcagagtgtcctggggactaaggctgcagccgtgtagatggtcagctgagacaacagtaacagagacaagaaagaagcaagcggaggggagggtggagtagctggccatgccaaggaggaagatgaggaggaaggacgcaggcacaggagacccaatccttaaaacgtggtacggcatccctaaggaatttgaactttatcctgaaaacaatggggacccatcaaagatttttatttttcaagtaggtgaattaaaggatgagatttgtgttttggaaggagttctgtggcagcaaagaggcagcaaagcccgtgtcagaacagaggtggggccggctcttttgggggccgggatgttgggggatggaagcaggaagcactggtggccagtggggcatggggagcaaagattcccctcatgctccgtggagcgtcctagatgcagcaggctcatcagaaacacagcctgatgcagtagccagagcccaaaccttgctatcctgttcaaatctcaggtccctctcttagcagctgtgtggccccaggcatttggcttaatctctctgggcctctattttctggaatctaagatgaggatcaccagggtagctcatgagatgttatgagggagagacacatacagacccagtggccgcacagaaggatggttaggagtgtggttgctggagttggagggtttcaaagcctgctcccctgctggccattgtgtgactctgagaaagttacttgctgtgtttcagtttctcattggtaaatggggataatagtagcgcctacctcatggggcttttgagaggatgaaatgagaccatacatgcagacagtgtggcacgcagtgagagctcagtgaatatgaattatctcattggatacagcagttgataacatagaaaatgcaaggtctaccaggctctcacccatccctgcctactgtctgaaagtggattccccagatctctagacctctcaccacctccctgcttctcctctgcctcccttatccaaaaaaaaagagagagagagaaaagttgtgttggcaggtgaggaagttcaaagaggaaaaagcttggggtcgctcttggggcgagctgattgggcaactgtgatttcctgggcagtctggaggacctggaaaaatgtggggatggaagttcatggtttggagatgggggcagccagccaataattttctttcctggatgggcagtctctcatgttgggggctccggttggagttctagggaattttcatgatgatcattactgaaaactcaagaactcagaaaacacccaacatctaggtcaaccactccttagccccagagattcccaacttcattggtctcactgaagctgctgcccaagaccagtttctttatgactttgtaacagacagggatgatctgactcaaggccactgaccaggctcccttttgccacatacaagagttcccctaagtttccctgtgatgtttcttgaaagccacctgttttggacctacaagacccttgctcatccacctcctccaaaacacctggaatgagaaatcacaggcacacacgccagcactcccccaactcccctcccctgacgggaacagcaggagtgggacagcgtccgggagaaggggttatcaacagagttcaacagaaacacagttcttgctcctcagatctcacccgttgtgacttatcaaaactttgaggtttctcatttctccctgacagtcagagcgggctttctctagagtaaccgaaagacacttacgtgttttaaagaaacctcgagactcgacctctagatgagtcagtggagggcgggtggagcgttgaaccgtgaagagtgtggttgggcgtaaacgtggacttaaactcaggagctaaggggtaattcagtgaaaaaggggaatgagcggtggggagctctgttgcaacagggtccaatcgcagcaggactacaaatgcccgagcgcaggctgggaacgaggggacagcggctgcctgtccccagaatagaaaatgcagctaggaagccctctttgagtggacagcggaggactggactgccaggccaagcatcaggggcttcatcctcagggccggttagagcccctgaggatttaggaggaaggtgaggtggggactgccatcagagctaagctttaggcagatgtgtctagcagtagtgtgcaggactatttgctcaaggcgggagaaatacctatttatttatgtagcccgatgcagtctctccttcccggaggaactcccaagcccagaatccctggctttacacaatttccggggaacacattaaccaactgcaacctgggtgccatgcagggaggcttccagcaggtggtgctgtggccaaggacacggaagcgctgggctctcactgcttccccagcctccaggagaaggtgccttaaacaggttcccacgcatttcctggcgctattgagcttggagctgccaagggcctgccttcacttgtggcatcgcagttactgactctccagtgggccaggccctacctagctgggacctgagggtcaggatacgggaagagggctactgccgccctgacttgtaggtaagctaaaacatctaggcaaattactctgtcaactgtcctccctgctcagcctcaggaagaaataagttcctgctgggccccaggctcagccacaaaaccagactgagcacatctgggccttgtgctacaccggggtccccatcagctgctcagaccccaggaagcctcctgacttccagaacacgtcgcttcccaaagctgaccctgttccccctttcacctgccccccaagcctaagttagaaaacaagttaaaggagagaaagtgtgtgcaggcacttcagttaagcaaaaaaataaagaagtcgtgacatcaggaaagagcgtccttcccccacactgcaacaggacagcatcccttctgtgtcctctcgggccatcttgatgccctctcccttggaaaaaggacaggcattcgtttacttgtcattcatgtatttattcatcattcatgtatttatcattcatatattcatcagcacacaattgtggggcacctcctcaattctgggcctgcacaagataaaagggaagggatctctgtcccaaaggcaggccaagggtgtgcgcccagtggaccaacagtcagtgctgaatgaatgtcatttcagtgagggggtgttgtggagctggtggagccctgaggcagtctccatcgctgtggaccagtaaggaacctcatccctctacccagcctgtgaggtcatcctccttcctcagcccacctccctcaggagacactcaggcttggcttcatgcacgtgtggctgcgcactcacctggatgccaggaaaatgctcctgggccagtggctaccagcaccaaagcagggctggaaacgtgtgcacctaccccacgacctcatagctttgccgcctcatcccacatcaggtggagtgggagggggcactcagacccaccaaccaagctcagtcttgaggggtggtctgggctagagaagacttcccagctccaagaagcagcccagatgggccaagacagggggtgggaggggctgccctgcattctgatgctgcttctttccaggacctgggagtggaggaggacaagaaggaggtgaggacagtgatgccgggcagcaggccaggtgttcaaaggcacaatctggttctgatgttctctttcagcaaacacagtgcctggagcttgggaggaaagttcccaacagcgtctccccctccactgctttctttaataacaaagacttgtccctgccaagcaataactttctcgccttgtctcctacagggaaaccaatgaaaagcgtgctggtggtggctctccttgtcattttccaggtgaggttctctgccaaggaaagctctgttcccttctccacacggcctcccaagtcaggggtttagtggaggagctgggcatttgctagaagatacaagacccagacataagcccgcctgccactcattaagctaatggctgccccctcaccatctgctgagtgaccctggagagccacagatgttctctggacttcctttactccatttaggttaaaacatgggggaaaataacttaccaccttccctatcccacctccaatctccctgcccaggagacagaaatatggactctgagttcttagagagagaagagctgcaaaaagcaaaaaatgttactgggttttgtgcacgtgtgctgagaaaatcaccctggatctggcgatcttgttactatcctatcgccccaaagttgtctctttccaaccttcacccaaaggcttccctcgcagcccccgttttctttggtgaaatagagacccatccggcctccctggcaggggagggaagagaggatggggccctagggatggggagaggggtggatgagcacacactttatagcaggcctgaactcggcaggaacaaagaccctcactttacaaagttctgtttctccatccagaaacagacagaaagtgtgcctcaccaagtgccaaagttagaagaaactgtaactcgcagagtcaactttctcccatttgttagaggtgggagctcagagtaggggtaggggagtccaactgaggccagagctagagaggcagtgcttcagaattcggctcatccccaggtctggaggccagaggggcagctttccagaagctcaggccagaggcaggccccaagctgggcactgttcccaaaaccccatcccagaggccccccggagcctgggctgcagcccatagcctggcccccttccccatcaccactccctcctctctctcccctgtctccaggactctggggggctgtattgctggcagtggaggctggaagggtgggaaggggaggaggacagctgaggctcattcttccctttcacttggggagggggtgctcagatagggcaggatgtggtggggctgtgggctgcagaggcagtgaggctaggggagggagaattataaaacaggaacaaggttcaaggggagaagggaaggcaggactggatgatgcagagtgcacttcatagaggccgggagtactgccctccaggaaggctgagaccccctcatgtccagggaccccgggtctaaggccttgggccgtaaccatggctgggccaaaggcagcagcctccttcagggctcccaggctgcagccatgcccaggaaagggaagaggggttgccactgacttttcgtctcaggctagcaatggccaaagaaaaggctcctggacatcattttgtcctcaccatgttcccaagcaggacagtgatgaatccagaacttgggtgtgaaaaagagatagagacaagatgcggtgaatccctccagcataaatggatagaaacccaccgtcgctgagctgctgaatctggttcctggtgatagaaccatgagcctcgtgaggcaggtcctccagcccagctccctgccctgcacaaacccgtccatcgctgtgcgcagaggcaggggcaggcatggaccccctccttcattgataaaatcacagcaggctgctgaaccttcacccgaccctgcagacggctaaaaaaagctccagcagctgagtcctgctgattgggatctgccggaagagatgcgaggaagagagaggcagagaggtggggggagagggcgggagcacagagggagagtgggagatgagagctgcgcttccttccagggacacagctgctgaggagtcctcgcccccacccccatggcccatcatccattcacggagtttatggcacttgggctcacgttgcctgagctcctgctgggtgctaagaggggacccaggatctagagtctctccaggtcacccaccacccatgatcacagcagtttgccccaaacccaaggcttcatggcctcaaaatgggagcatttgccttcctctcttcttactccaggccctcctcaaccttgacccccaggtggattttccccctaaagctgaggtcttttgtaagccccctggaaaactccaccaagttctaaaggagggtcaagaagaaagacacatgttccctctctcacggagcttccagggggcaaaattaaagctccatggagaggaaatggtgctggagcctgggctaggtacctcacagcaaccatgggaagcaaataggattcatctccatttcacagaagagaaaactgaggctctgagagagagagagagagacagaaagagtttaaccagctcaaggctcatctggccccagagcccagctgatttccagtcccctgtcagcacatgtagagtctctcagacttggcaaaatcagccacttgctacttactagcagaactgtagaatctcaggccccaccttagcctactgattcaggatagacatgttcacaggattaatcaggtgatgcgtattggagttaaaatttgagaagcactgatttaaaaccaaagaatcacctggagactttaggaaaacacagattcctagacccatcacttgagattctggttcagaattctcaggtggggcctgagaatttgcattcctaacaagttcccaggtgatgctatgatactgatgatgcggacctcacgatgaaaccactattcctcccgcctgggcaacatggcagaatcccatctctactaaaaatacaaaaattcgctgggtgtggtggcataaggctgtggtcccagctactcaggaggctgaagtggaaggatcacctgagcctggagaggccgaggctgcagggagccatgattgcaccactgcactccagcctgggcaacagagtgagaccatgtctcaagaaaaaaaaaaaagaaagaaaccactgctctaggctaaatcccagccagagttggagccacccagctaaactggcctgttttccctcatttccttccccgaaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaatgagcgtgtctttgttttgcaatcccccacaccccacctgaccgtcccctctcccctcctccctgccctctcccaggcctcgtttcttagagacgctcagaaccacaaagttgctcaggaatgctctgagcccgtctggtgacacaggaccaagaggctgaaaggtagaaggaagatgaggacaggaggtccatcttgcaaatacccttccagagttcaagggataggccccaagcctgcacagtcagcactgaaccggacatgctgatcctactgcagctttgggaaggccaacttttccgggtaacctcgatacctggggactctgcatttagcagctcttgcacagtagcctgctcacctgtcccagctcagaccagaactagagcccttaaccttttgtcagccccttagactctgaaagctggggtttggagggagggcctttctgtgggcttggagaccacagcatactggactaggggtcagggatgagaccctttgctggcatgagagctggaaccacccatgatcctctctgctagccactgtagcagcagtggcctccgtggtgtatgtcatagtcccttcctgctggtacaacaaaatgccaccgatggagtaatttacaaaccatagaaatgtatttctcacagttttagaggattggaagtccaagatcaagacgccaacagattcagtgtctggtgtggactctctctgcttccgagatggggccttgccatgccctctggaggggacaaacactgtgtcctcatgtggtagaagagtggaagatcacaatgagcctaactagttccctcctgctcttttattgctataagggcattaatcccgttcacaagggtggagccttcatgacctaatcaactcccaaaggccccccccaacttctcataccattgccttggggtttatgttccaaccatatgaatgtcggaaagatacatacattcaaaccatagtgtggatactgactgtggaggagcagggagagagggacagacaaaggcccccacacaggccaggtgtccgtgtcatttcgtgccttggtgccacccagagccgtgacttctgcaagccagagagcaggtcagtccaacctacaatgcgtcaagaggggtctgaaggacccagagctgcaatagctctgggccgtggggagctagagggagggctgaggcactcacgcaataggtgattccatccatttccccaagtggaaagagcctcgttgaaaatggagctgcctggtaatgacacccattcgctcatctcgcaagcacgtgacattaccctcctccgagagatgcactgggctggaaggtttttaacaagatttgtcagctggtctccaagccgggaattggcgccctgagaggaatgagcctggcacggatgcagtcagcgtggagcggcgtttgcagcaatggcattaaatattaaaaggcacagctgcgactgtgtgcgtgagcgtgtggccagggggcaatgccagtgtgcgtgtgtgtccccgaggggaacctgccggagcgcatgtgcgtgtggagcccgctggtgtggacatcctaatgaggttacagatgggaaaacaaccctcggttcctgaaggggaagaatgtaacagagcagtcatgcaaaaggcagccaggccagccgcacaaatgcgccccctcagctgcagatacatttttctagaataactggacatctccaaatatttacagagaaaacaaaacccccagcaatgtcaattccctcgaactgctgtgtctcagaagttctgacctcggttcagtgctggcctgatccctgctcccttgcccgaggctctcatgtgcccatcttgagcttggggtgacccctgggaagaaggaaaaggccccctgggaggcccacccagggcttctctcttcttttcttacctgcttcatacatctgaaccctcttcccaggttcacagccaataagccttctccagtcacctgaaatttccttttcatttcatccccaggccctcatctccctcatccttgctggctgcaaccccaagccaagcccaaggtattcccaggccacaggtcttccctttcagctagaagcaccacacctttctcatcacagactcacagagctccaagggacctcaaagatcagctgggccaatcccccagtcattttctagatggtgaaactgaggcccagcggggagaagctgacttgcctgaagaggcgtggcaatgcagggatattggttaaacttgctttggaagcctgagcgtctggcagggttgcaggagggtgtgggggagagcagagactctggagctctgccgactttgaatctcatctctactgcttcccagctatgtgaccttcagctgttgcccaactggtctgagtcttgggtttctcaactgcaaaatggagaggatttgtgtaaacagttagcacagtgcctggaatgttgagtgtggtggtgaggaagagggactttgcagccagactgcctggtttgaaccccggctccactgcctgggctggttacttagcctccctgtacctcagtttcttaatctgtataatggggatactaatggtacctatgtcctaggattgttgtggaaggcaacgaatccatatatgtaaaatgcttagaaaaacttacatatgtgttgttggtaatctttaggagatgtttaagaaacggtaacttaaaaaaaaaagttgctaaccacaaggaaaccaaattcaattccttagcccatttccatccccacagaatttataattcaagctggaaggcaatttagagatgagtgaatctggcctttccatccattgcatggtgagtcaactcgtgctctgagagggaagcaactagcctgaggtctcttgggaggtctttgcaatgctggaactttaacctagttccctgggctcctaaccagagctcttcccaccagaccctgctgggctcacgggaacatccctgcacatccaccgtggcacccgccctcatcccacgctgtctcgttctctccggcaggcaccgttcatcttgtcctttgattaggtccttaaggagaacctcccttctcccctttaaatagttcctgtccttatcactgagtctggagaatgaatgaaatataaaagaaatatggcagcggtcccaaaggaaatcaggcaactgatctttttaagaaaggaagatgggccgtcttctctgggaatggttctcagttacatgtctttgttgagggtgaacagttggaggaaaagaaacagacctaaagggattgtggggggaattaaggcaaaggagatgggggaaaggcagggggaagatggggcaggaatgggttttagggaatatacactgggggcgggacttgaagcaaatcttcagtgggtagttagatgtcccatcctgcatgcacacacatgcatgtgcacacacacacacacacacacacacacacacacacacacacatagagcctccccaggtctcccaatctcaggtgaggagaagggggctctattagtcttagagacaggtgggcccatggccttctttgcagagaagatggttagaatcggtcatgtgtctctggtctgagaccctagagaaactccaaggagaataaaaaaggttgggggggggcctctccctcaactcaaaagagcaaccctatcaggcttcagaaaagcaagccctcctagcactccaacccacgggagcagctgtctgagaagtcccaactcctccagcagccaccccctctgttccttcacttctcttgggcccaggcagagacacagacaggagtctgtgtgcagaaaaagctccccaggcccttttctgtggagagctgctccagactaagcgaatctcagctgatctcgtgcgaaatcagaaacgccaggatgtgtattccccacgggctcctctctttgtgtctgtgcatgacccaattcagactcctctgccgctgtcagattctctcctgcccatattcactttgaggatggatataaccttatttttgtgtgttgttcactaaccccagggacttcgctagctgggctgtcctacgtggtacagtaaccaccacatagtgtggcctccaggttctcatctctgggtaaataaacatctccgcacaggcttggccagctctggactggctcagttcctgcatgatgcaataggtctccaggtcacatatccgtgcccactagcaagagggaaggtaaggagatggttcttgccctgaagtcctcttgttcctgtgtcagagtttatttaggacagaatagtttatatttgctccaagtaaataatatctgacattgggaagcacagcagatgcagcagatgagatgcccccaaaccatttcccaatgtttaaaaagaggcctggaaaggacaagctcattgatctcatttggtttatgaaactgcactcaagtgactgaagcagaaacctgaccacgtgtaaagactgaatggctcaatctgcttcccaggcccagagggtgttttctgtggcctggcccaggcctatggtgaagccggtgctagggggtcacctatgtgggagccagctctgcctcctgccccgaagctccagagacttctcctacaactgactctctggacacgccctcttgcttgcactagtatctcttacctgccacctgccctcctccacacaccccgatttcagggaagctcagctgctgagagtgctattgacaacctctggacttggaaatcaggaggaagggaatgggaagaatggtggcagctttgtgcctgggctgttcaggaagacatccctctgcctttgttctccagggcaagacacagggctagacacgccggaatccttaaatcctttgtcaaaagcagaactgggattttcgtccaaggactacacctgtcctgtcctcagcctccttctcagttgcccccctcccacccatgctcatcagagccgaaccctgaggaaaccatggaccgaaagaccttgtgagcttttgttgctgggagtgtcagaggctgggagacagaaggtatgagagatgagatgccatggaagggatggcagcgatcacagaggctggggggcagaggaaagagacgttgaagaggtggaggggtaatgaacctaggcgggagacaggctaacatttactaagtgcccgtgatgcaccaaggactaggctagctatacaacctttcattgaattcttatgacaacagagaaggaaacaggtttagagagctcatgtaacttacctgtggtgacacagctagcaactttattaagattttgttacgtactatacactgtattaagcatcagtatcttatctcatttaatccccacaacaactctactagagtctcatttaataaatgaggaaacttaggctcagagaggttaagtaactttatcaatgtcacacagctactaagtgatttcaaccagttctagctgcctccaaatttcttgctttagtcaccctacttcaccgttcaactaaacagctgtttaataccaaatatttctggagcccctactgagtgccaggcactgtgctgtgtccagccaacatctttcaaaccctgccagacacagagctctgacctgggagaagggagaatcaaataacaaagacacagcccccacctgccaggggctgtgacccccacagctgggcaataaccaggtctttgctgctccacagtaccttgtccctgcttctcccctctaggccctgcttcttacctaggcttcctccatgggctagccctgcagatgactgagagggctgagatggctttgccacagactagtcactgggcaatatgggcaggtcacctcccttttctgggcctccagctccccagctgtacaatgaggttgctggaccaaatcatttctacccatcgcctccagctctgacttgctatgggtgccttgtctgggcagagtctgggaggccagtgctcagcggggtagggctctgggcatgttgatgcttgcacgaggtgcagggcaagtgtgtgaggggctgaggaagctgctccacccccagctgtggtttctggtggggccaccatggcagcaggtggagggaagtgtttgtcacccttccaacaaaggcagtcaaacaaaagcctcccagggcaccatgggaataggcggcaagggcgccaaaaataaaacacacttctcctttgataggcatcggtggcaggcataggcagctgctaagggagtctgtccttggggtggtgaggaaagggttcagatttcgtgcccaagaacactcacactcacaagagctgtcccacctcacaaacagcccacacatacagatgctcaatattcacacaagaaacaccaccgcacacatcacacacacacacaccaacacagcagtcacacaatcagcatacacatatacacatacaaatagaaaacttgcccccatacaagaccagcttcatgggccgcgacctgcacagtcactctgggccctgcactaaggccctgcactaaggcccatgctgggtataatgctttgctgcctgcactttgaaattcttaattatttttaaacaaggggcgcagcatttacattttgcaatgggccctacaggttctgcagttgctcctgtgggtgtgcactcatgagagcgttcactacctgcttaagcataccttttaacacttttacactgttgatgggagtgcaaattagttcaaccattgtggaagacagtgtggtgattcctcaaggatctagaaccagaaataccatttaacccagcaatctcattactgggtatatacccaaaggattacaagtcattctactataaagacatatccacacgtatatttattgcagcactatttacaatagtaaagacttggaacgaacccaaatgcccatcaatgatagactggataaagaaaatgtggcacatatacaccatggaatactatgcagccacaaaaaggaatgagatcgtgtcctttacaaggacatggatgaagctggaaaccatcattctcagcaaaataacacaggaacagaaaaccaaacaccacatgttctcactcataagtgggagttgaacaatgagaacacatggacacagggaggggaacatcacacactggggcctgtcagcgggtagtagggggcaagggaagggagagcattaggacaaatacctaatgcacgagggacttaaaacttagatgataggttgataggtacagcaaaccaccatgacacatgtatacctatgttacaaacctgcacattccgcacatgtatcctggaccttaaagtaaaattaaaaaaaaaaaaatcctacctatatagacaagagtgcatccgctacacacatacacacagatgcacaaacacatgcatgccacaaatgcaacacccacacaaacagcaatagccccccatgttcacgcgccaaagcacacacattgatacccagaaggggtccagacgctcacaagcaacgctacaacatgcagcctatgccctgcagcctgctgacacaattcaattgacttaacattgggggcagcagaacaatgtgaagggaaggggcttggagagaaaacaggttcatgtcctccacctgcaaacatctcccacctctctcttcggccctgggctcacccaccccactcagcggctgggaccagaagaaagggagagccagggaggtgggcgcatggacggaaaggggacagggatggaggtggagagggagagagagagggcaagaaagaacgggtggggagtgggggcaggaactgagtccccaggtgagctggccccagcagtggtctcataagagctcagaaggtcttggacccaaagcagtaagaacaatgcccctgtgctccccgcaagcacagggcggtcccgccctcagagtcagtcagaggatgcccacctcccttcttactagctacacagccttgggcacgccgtgtaactccgggcctcagcttcctcctttgtggaatgggatagccaattctacattgcagggtggcaaggcacacacagacacaacacctcctggattcctgcagcaatcaacagctcgtctcgtgatcaggcctgcaatctgattcttggcacaggaactccagaccccctcattacagcagacatttggaacgcgtttatttcccatcttctcctggtctcacttcacacctcacagccaggtacaagcacagaggtggatgtaattcatggcctcatggccaccatcacttcagggaccttcaggatcctgcagccccatcctgccccaccccctacccaaaccaagcaggactccaaggcctggaaatttttcttcctcctctattcttttttttttttttttttttttttttgagacggagtttcactcttgttgcccaggctgggcaatggcgcgatctcggctcaccacaacctccgcctccagggttcatgccattatcctggctcagcctcctgagtagctgggactacaggcacccaccaccatgcccggctaattttttgtattttaagtagagacagggtttcaccgcgttagccaggatggtctcgatctcctgacctcatgatctgcccgcctcggcctcccaaagtgctgggattacaggtgtgagccaccgcgcctggcctcctcctctattctttacccccaacctgtattctccacccccaaccctaaccttcctgatttatttatttatttatttatttatttatttatttatttagagacagagtcttgctctgtcgctaaggctggagtgcactggctcactgcaacctctgcctcccaggttcaagtgactctcctgcctcagcctcccgagtagctgggattacaggcatgcgccatcacgcccagctaatctttgcttttttttttttcttttttttgacagagtctcgctcagtcgcccaggctggagtgcagtggcacgatctcggctcactgcaagctccgccacccgggttcacgccattctcctgcctcaggcgcccgagtagctgggactacaggcgcccgccaatatgcccagctaattttttgtatttttagtagagacggggtttcactgtgttagccaggctggtctcgaactcctgacctctagtgatccgctcacctcggcctcccaaagtgctgggattacaggcatccctatttaaaattgtcccagcctctgtcccttccctgaaaaccccatcattctgttaggtgataccagattcttaaagagtgattcgggaaaaacgaatgggccctaaggggcatgccagtgtgccccattccaattacagtcacccacaggagagaggaaaggtcgtccaagtggccaccaacaagaaactatttcatcagatttcttttttgtttgtctgtttgagacggagtctcaccccgtcacccaggctggagtgcagtggcgcgatctcggctcactgcaacctctgcctcccggattcaagtgattctcttgcctcagcctcccaagtagctgggactacaggcacgcaccaccacatccagctaatttttgtatttttagtagatacagggtttcaccatgttgcccaggctgctgtcaaactcctgacctcatgatccgcccacctcagcctcccaaggtgctgagattacaggcgtgagccactgcgcccggcctatttcttcagatttcttataggacataagtcactcagatcccctcacaggctttctgtcaacttactgagagggaaactgagtcaaggaagagtgaagtgacttgggtgagcagcagagttgagggttgtggtctttctgatgtgcagtctccatgagaccagatc

SEQ ID NO: 975 - DNA, 2139 bp, Homo sapiens
gtgagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagccctgctccagaagttagcttcaccccaatcccagctacctcaaccaatgccgaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggccacgagcttgttctttgttctttgtcacagggactgaaaacctctcctcatgttctgctttcgattcgttaagagagcaacattttacccacacacagataaagttttcccttgaggaaacaacagctttaaaag

SEQ ID NO: 976 - DNA, 1137 bp, Homo sapiens
atggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccatag

SEQ ID NO: 977 - DNA, 28486 bp, Mus musculus
  misc_feature (8132)..(9060): "n" at positions 8132 thru 9060
  misc_feature (20544)..(21524): "n" at positions 20544 thru 21524 can be any base
  misc_feature (24896)..(25248): "n" at positions 24896 thru 25248 can be any base
cacgggatccaaaaccctctcctgacttctgcaagcgctgcacacacatggtacatagacatgcacacgcacgtgcgtaaacatgctggctttctgatcctacggcttctaatttagcactaacacttagactttttattccctgttgctgccatgactgaccccagaccctgcctttcaggcttctccttgcttttcagacatgggacagttctggggtctcttttgcaaattgagacctgtgctcacctagcacacatgtggccttgggttccatccccagaactgagtgaatgaggcatggtggctcaccctgtgattccaatattcagaatgtggagacagtagaatgaagagttccagtttcaggtacaccaaaccttgtaccagaaagaagagggggaagagaaggaagaggagggagaaatctagcaaaagatggaggaagcatacagtgactttgaagatgtgttaactttcccttgctgtaaggaaatacctgcggtaattaacttataaagaacagaggttatgtgaactcacagtttggggattttagtccagaacaggactctattctacttcgagtctctaatgcagatgatgagagcgaaatgctgagcaaacagaactgaactgccctgtactacatggcaaatcagaggaagagtagtcccatcgtcctctctgaggccaccttcagtaacctaaggactgccaggctgtgctgtttgtttgttctctgtctctagggtgtttgttttcgggtttgttttggttttgttggtggtaggttttgttcatttgcttgtttgtttttgatatagaatcatgctatgcagcccaggctgttctcaaacttgtaatcctcctgtcttcgccccctgactactaggatcacagtatgcgccaccacacctggctctagaatccatctcttggaagttctaccacctcccaataaagccaccctgagaatgaagccttggacaaccagagaatattgctgagccaaactacagcaagaaggctgaccagaaggctctgccaaattcacaagccactggcccatctgcaatagatgccatctgtaaaggagtcacttctccccagggtgacagattcaatgcaacctcaatcaaaaccctagctgtggtgggtttgtgtgtgtgtgtgtgtctgtgtgtgtttatgtgtgtgtctctctatgcatatctgtgtgtgtgttgggggtgctaacctgtgtctgtgcatgcatgcacagtgtctgagaaagagggtccaagatgccggccactgtaggccatgttactgttcgcatgggacaggccttaaagaagagctgcaaaagagccttgtacccacctcctccaatgagacccaccccagtctgctttctcagttaatctcttcctctctcaacttgaagcctgtctgggaatttgctgttgagtagattataggcttggcctcagctggtccactaaaagcaggaggtgagggcccaggcctgaggaagcattggggaggcagatcccaggcctaagtttgttggagacacattctccaggaccacaaatagctgacatgctgttaccagattgtcatcccagtacctgcaaagtgggagaaccagaatcaggtgttcaaggccagcctctcaaaaaacaaaactgaagtaagtacatcaactctactctgccttttaagagttaaaaaggggcctggagagatgactcagcagttaagagcactggctgttcatccagaagaacctaggctcaattcccagcacccatatggcagctcacaactgtccatgacttcagttccataattccaggggatttgtcatgttcacacaaacatacatgcaggcaaaacagcaatgcacataaaaaaaaataaatcataaaacaaacaacaaagagttaaaaggacaggagaagaggaacaagagaaggttcatgtggccaggttttcttttccccaatttaaaagtttcttctgaggtttacatctcacacccataaagagctcagaagtcaacaaagcgaggaggcttgattcatcatgaagtcatttcaaaatttctctttctgaatataaaccaaaatatttaattaattccacataccacaggaagtacattacagccttcaaattcactctgcttaacagtaaactcgtgaacgaatgcacagaacagaccccagtcacccaccagcactatgctaaatgtcctatgcacattacctgaattacttctggccatggcctggcagaggaaatcatcccactgcccagcagagatgagggcatctttgcccacagcctctccaatgccagagagcacagctctgtacgttgcctcctgtagttacagaaatgttttccaacttcctggcatcctgaaaagaagtggcttgccttaaagtgacttttctttttccttttcacaaacagtgcaggatggcctcctgtgccaatgacaggtatgtgctacctcatctagttctggtagtacgtggattttctctctctctctctctctctctctctctctctctctgtgtgtgtgtgtgtgagagagagagagagagagagagagagagaaagagagagagtgagagagagagtgtttgtgtacctgttctttcttgtgtatgtgtgtacctgctctttcttgtgtgcacatatgtgcacctgttctttcctctgtgtgtatgtatcagctctttcttgggggggggtgtatgtccccctgcttctgccttacaagggctagtatctcaagcaatgagttggtggagttacagatgcctgtgtccagctctctatggattgttaagctgctaacctcagcacactggttttctgccctgtcaaatgcctgcgatgacagcatccacctggtaagctggaaggtggggtctgctcctccatcccacctgagagggaatgatttccttagataggctgcggctggaactcacctgatctagaagtacactgggggcacacaggagccatggagcccctaaggcccaccagcagcttctgtcctatcccttctggcaaaggggccatctgtcaaaggaggggttgaaagatggcccagaagaggtctcctcaaatctctgacccttacaggactctgatgataaatgatacagtctcagtaggcctatcctggcttcatttcttctgctgtgataaaatgtcattgggggaaaaaaaaaaaagcagcttagggagaaagggcttattctggctcggaactccaggtttccagtccattactacatgaaaggcagtgtggcaggaacttgaagcacatggtcacatcatatcctcccagagcagtgagatatgaatccaggggtggggactggaatgatggctcaggggttaagagcatcggctactcttccagaggatgccgattaaaactgtctgtaactccagttccaggggatctgacaccctcacgcagacatacttcaaatagacatacatgtgggcaaacaccaatgtacttaaaataaaaataaataaattataataaataaataggtgcttagttacttttcccacctttaatcagtccaagacccaagcctagggaatgtgtcacccactcccacactgggtcctctcacatcagctaagatagccaagacactacccacagccgtacccatagggcttcttgagactctctagcaacgtgaatcgaggttgtgtcaagttgacaattgaaactattatggtgcttaactgctccctgatgaacaggatgtggcagagacaggcatcccattggttaatgtcagaagtgtcatccctccgtggactgaatttttgcctttaacttatatttatttgcttgtttgtttattagtgtttgtatctatgtgcatgtgtgagtgcggcttccctcagagtccagaagaatgtgtagaatccctctagagctggagtagggggctgccgggtatgggtgctggaaatcaaacccggtcctctggaaaaatcagcaagcactctgacctgttaaatcatctacctaacctcatccttgctcatgttttaaaaatagttatagtggccaggtggtggtggcgctcgcctttaatcccagcacttgggaggcattggcaggaggatttctgagttcgaggtcagccaaagtgagttccaagacagccagcagggctatacagagaaaccctgtctcaaagaaccaaaaataaatgaaataattatagtgggtttttggacattctctgtatgctaagcaccttccagatgggcttcctgacaagagatccgtggcctgacccacactgatttgaaataatgatgaaaattcaactttcagaagcaaaggctgtagttcctctctggcttctaccacagtcagtaaccagtccagttccttagagagtcagtcaccttagtacacattccagcggagccaagacagtatagtgctccttataaacatggaagggcagttcctacccagcgagtcactgcgggcttggtgcctctactgaagcgcaggctcaaccaccgttcaccgcggggagcgtcctcaggctctcgcgagccactgctgcgcgtcgcgtccaaggtttacggtaagcgcggcgctcaggacgaccacgtggcggcgaaacaccggccggcgggaatgcgcggaatgcgcggtgcggcctcgcgcgctccccaagccgtgaccccggagttcccggcgcgcgtttgtgggaccgcggaggctagtgccatgggtccgcccgcgcgtccaagccaccaagcaccacagggagcaggggccccatggagggctcagcacgtgaggctagacaaccttttccaaaacctggggctaggtttgccctccctgtttgggctccatcacagatctggaacccgcttagtccccattctaaagcccccactgatctggattaagaatggagatgcctggttttgcagggaagcaggtcaaagggctctgcgccctgaccgcccttcggagtgctgagggaccagtgccaggggctgaaagaccccagttccagcagctgcgccctgggatcgcatgagggttcgctcaccacgattgagccacgtggtcctgcctggccactggtggctcaccttggcccgagtgcccgctccccaccatttagtctgggaagggccgagggccaaagcccaaaaggaccctagggttcttcagagcacctgtgattcgttcagagagctggagaccgagcagacatccctccttcaaattgcatctctacccttgggggtccctggagccaggcttgccgctccagagctcattgcacggcgcgcgtctattcgctctgggtggtgggatttagggactgaaacttatttggtaaggcacgcttgggaagataggatgcgacggtcccaggtgtgcacaggggatgagctgagcatacacaccttagccgaagggtgcctgaaatccgctcagggtaacctaggcggagcagccgtgtagcacgtgggctgccacgcgcgccccaaaacgccttctgggtgaggagagggaagccgtaatgcctccggaaccttggggtccatattcggaagtgttttctctgggcgacttgaaggctaaattaacaatggctagctggagcagaaacagccaagtcctttcaagttgccgccaggtatgcggctgcaggtgaccccacctaggtgcgtccgctcttctccaggaggggctacagccagaggctcagtattgccgcccagccccgcacccctaacccgagccccgcgcttagtcgcgagggttcctcaatgaacgcgctccctcccacttctcaatgaagttcccacagccagggatagtggcaaacgcaagactaaatctccgctctctttggaaccttggctccagtcaggtgggggtaggggtagggttcgaggaggcaggaaatccgaaaggggattaaagttactttgagattttctttccaaataacgtggttccctctcggctgggcaagtggccttttgtctccaaaaggtcactgacaaataagcgcagaacactttaagcccagagcggacagttcctgccacgagattttttttaaagccaatgtaaagttaaaattgcaaaagaaagtgggtgtttgtgtttaagttactatttcgctggaaaataaaaatccaagttctttctctgagattcctaaagcagttgtcccggaaagaactctgaattgcagcccacctcctgggctcgggattcggacaagcagggtttccaggatggaggatgggcgctccccgccgggtcccaaattcctgcgcctcccctacgggttcctggacggctctacacgcccgccaaccggacttgcacttttgctcctctccctgagcgcagagctcaacgaagttcctcgtggagatctgcccggtccgcctagtaacagcactgagtccggattggctcatgcaaatttcagtttcctggtctttcccgcggtggcggtggtggggggtggctgcgggtcgctagctcgtgctgcagggtgggcgagcccctttatgccccgctgcccttggtggcgcaccctggctaggctagcctgctcagttcgcaggcactcagccgcgggtgatagcgcgcagccctataaatcatgcttactgccgcccggtagggattttatgaatgaaaaggcagcctggccgccctcgtgcttaggctaaggctcccaggcttggcggggcctgtggccagagcaagcgtgggcactctgcccgggccacccaccaccttcggagctacagtggaatcactgtcccgaagggtccggactttagggaccccaatgtcgggggagggggagcggaaggcatgagctcggaaggtgaggggtttgcgtcttgtgtgccgcctggacgccgtgcgctcctttaccagtttcttctgggacacgaaagtattccgtgggaaatgtgtgtgaatagttcgcctagcttgaagtcgggtattgtgaaaacgtttccaaaactagggaactaaataatggacgaaggtggtggaaccgctttattctaaaaatattttatttgaatctataaattataaacttaggagtccattcagttaaccacgaccatctatagattctctttaaatatcaccttatcggctcacaagtttatcttgattctcaccagccgccccccccccccaactcaagactgcaattctaaaggtggagaaacaccaccaccctcaacgaagccaatcaagaagcttccggtggtctggttcctggaagggcgactaataacttgcagcgatttacttttcttaattaaaaaataaattaggaaggagcctatcgtgtctcaaccttttcttcaacggtttatttttcttgggcaaaccgcctgcagtggaggagggggatactgggggaccctggccaggataaaccggtcactgtatgaagacaaatctcagatcccaccccaccccccagcgaggaggaatagatgaaataatggccaccatcttgagctgttgctggaattttcggggttttattttatttttgagcgagcgcatgctaggctggggatcctttaaagttcagatacccctctggccctttgcaaccaccccagtgcgccaggatggagcctgcacgagagcttagggctcgtctggcatcttcgggtgttacacagttcctgaattttacacgtgttgatgaaattgaaagaagacagggacgctgggatttctaagcaatgggtccgcctgtgggtgcctcgtggcgtcctcggaaacgcacccattctcccggtttaagaacagggtgtccttgcacccccaggctccccttccatacattcttccttggcttgcgtgtggcctggcctccctcctagctgtcctcctgtccagagccgccactaccccacctccacaggtctcggaggaccctcttagggaaagaagcccccctcccccttgccccgctctttcccagtttggagagaagcagtccgagcgatttgcatatctacgaaggctgagggggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttattgcaaagcaaaaagtgtttattaataattgggggcagggcagggagcggcagtaggggcgctgggacaggcacgaggggcctcgtggcggccgggaatcactaaataagacagtgtgaggaatatttggggtgggggattctttgttcaaacagcggacctgggtaccccgcacacgctgcctggcccagagaaaacgccaggctgcaaggtcgcgtggccccctagtcaatgagactgactgttgtgcgtgcggttctggatttggaggaacctgtctaggtcaaactgggggcggagggggacaaaagcacattttcagatgttcagcaggagactcaggggtcccaaaatattttaaaataatttttaaagtgaggcataatgcccttgtagaggcaaacagcgcccgcaccctgcaaaaggggggccccccggagtttgagttgctggagctcaccccccaatgtccactgagctcctgaccctcggcttggatcaagggtcgtccgatggttattttcaggtcgtttttaggcacctagttattttttaaatatttttaaatattttttgaaaagatgacgtctgggaaatgcagcgcggcggcctgggacgccaccattgtgtctcgcgtgcgctcgagcggcgcccagcccccggcgccccgccagccccgcggtggggttctctggcttgtggcttcctaatttcaacaggggaccggggtctccgtggccaccattgcttctaccggccccgccagctgcccaaagactttccctttcagtttcagggtgggtgggcactgggaaccctcggagcaggagcgcatcccagggagttggccaccggaatccctctctgtgcaatctaggaaaagggaatggggtcgtatcgagcgacgcccccctcccacgttgacggtcagggtccggatccccgcaggtctgtgaggagcagaagtgcgaagaggaggtcttcccgctggccatgaactacctggaccgcttcctgtccctggagcccctgaagaagagccgcctgcagctgctgggggccacctgcatgttcgtggcctctaagatgaaggagaccattcccttgactgccgagaagttgtgcatctacactgacaactctatccggcccgaggagctgctggtaaccacgtaacccaccaccgacaatccctctttatgctgggtggtgggagctgcaaatggcaggagatccagccatccatggacagatctcctgccccacgaaaggcacccgcaccgcaccgcacgacaccgaaatggcagtgagcagaatgccaacccattctacctctgtgcccgccctctttccgtactggactccccaccatgtctgtggtgaaaccactctgaaatgtgggcggtgtgcgccccctagcgacgtgcaggccacggcgctggcggtgggagattctttttgtccgcagtctgtccccttagtatttctacaggcacattttgttgtttacctgtatggggtcccgggttgacccaactctttagaccttctcgaatcagcctgccttccttttgaccgtgttcctcattctctgcagcaaatggaactgcttctggtgaacaagctcaagtggaacctggccgccatgactccccacgatttcatcgaacacttcctctccaaaatgccagaggcggatgagaacaagcagaccatccgcaagcatgcacagacctttgtggccctctgtgccacaggtaaggctccacccccattcttcccaggaagagcgggctccttgccactccccctggggttaaggcctctttccttgctatctattctgagcccagggtgcagatagtttgttggagagatagatgatactgggtggcacattctcttggctagtatcttggagacctaacagaatgacacagcttccctgtgccaacctttccactgccaggaagtggtacggccacagcatgctttctgaagaggtttttgcctcttttcctaggcttcctgccttgcctctgttcttaaggagctcgagctatagagcacacacacacacaccagcttctcccaggctgagccacctgctaggggttcctacatggatgggacaaatggtccagcctcagccccacgagctacatacagtacagccccagagcaggaacttaagaggccccaccaggggtactgcaggccagtactttttggctgagtcctgcctgggagggttggctggaaacagagaaactagaacctccctatgactcctccaagggaccctctctggccccagaccccaggtagattaggctgacataagtcatggtagacagccatgcaggaacccacacacatagacaaccctgctacttctgagtggtttcagtactacttctgacagctgctcctcacctctaactgagaaccctacccaggaggcttagcaatattgagggggtgtggtgttctcccacctgttgaggacccccttcctctgtggccctgatcagacctcagttgctatagctgtttggcctgtgatgtcagaagggccggtagagtatctccccccacccccaacctccacctcacccccgctgtctcagtgacatcttcttatgtctgacagccccatagccagtgtttctaagctgctggtgtgagaatttggaaattctagcttgccaactacctactgagagtgctgagcccgccccaagggtaccaaacaagggggtggcagatgggagtagcaaggccatcggtaggctggaaggatctaaggggtgggggtggccctgctggcagtcagggaggcagctggctggggttcctctgaggagagcggagcctttggaagctccaggcagccttttatggagctgaaagtgccttcagagaggcagcagagtttcccagagataacttggggatggagaggcacaacctcccccaggatagttctggcagtagtgtgcccctcccgggacccctagatgccagcagagtaatcagtaagcgctatatctgggtacagctggactcagctcttccagctctccttactgcctttgtctgtgcccctggaatacaggtgggggtaaaggacagcttggtgacctgcggtaggccagtgttctgtggtctggagcatttgtttctctgtaggagcaaccagctcctttgtcacacgggaaccactttgggaagaggccagtgtgacatcaccgtgaatggaaagatgctaacatcaaggccaggagatctgtcgtctgtgtgacaggggttccccctataggagatgggaaggcataacttcccttctgcaaaccgccccccccccaacctggattcctgactgcagttgaacaatgtgctagctagggttggggttgttaacacaggtggccagagcgctgtgtggatggatacagacagtgggaaactgaacttaatgaagtatgtaggtgtcagacatgccactaagccagggtacacctatgtcatcagcaaccagtgttagtagctagggatccttataggacataacagatcttgctactgcccgtgggagggagaaaaacaggctctggaaggggctggggactcctggtcctgctggctggagtctcactccctgtaaaagggctgtttgtgatttgaacttgactccatagccaggttttggttcactggactcactagcatgaactgtccttggtgacacctggaggtattgcttgtctgctggatccctttaacagccaaagctgtatgttctctcagggtggtccccagagggccacctcgctacagcaactctctgccttcctgatcccattccttccagcctccttgatcccaggctctgggtgacacacaagatgattgatgggagctgacatctgttcattcttgtgtcctcctctggcctggaagccctgattcgcaggccaagtgaccagctgtccctgtcactatttctttgttggacgtgacagggaagcagttttcagactcatctttggtgggtttatgcggagaggcattccatcggtgtgacatacaactgcaggatgctgagtccagtggacctgagaggtgtggagttggtgaccccagatgaagtcctaaaatgacaccccactacttcccagttgggacatgtacatatgagagtccctaagactccagggcccctcatgagggaccttggcctggagatctgaggtggctattcccagctccctctgagtctattcctactgggttttcctggactggggtcacatgtcttccccaacctgggtcagtaagccgggaaggctaactcccttctgtggagtctagcctggcctctgaggaacctgggcctgtcatctctacagctttctcctgtgtctgagatgtgtctctagtccttggggtgctgccaggctgactctggaagagacagagatccctgcctcccacctcagccgcgcaaatactgggatgcagatgtgaaagcaccacaccttcatagattccatcctcttagggcgacatagccaacccctccttgatgtttgctggaagtgctggggattgaacccggtgtgtatgccaggcagcattttaaagtttgagccaaggccttattgacaggtagcatcaaggctctggcctggacaccgtaatcctccgatgtgctggggtctagagatgcagcactgtgtgcacctagtgccacttaggtgtctccaagggagctagagttgatgtgggcatccattggaagggcttgaagaccagccccgaggctgtgggtgggagctgaatcataggcatgtctctgtccctctcgctgtagatgtgaagttcatttccaacccaccctccatggtagctgctgggagcgtggtggctgcgatgcaaggcctgaacctgggcagccccaacaacttcctctcctgctaccgcacaacgcactttctttccagagtcatcaagtgtgacccggtgagtaagtctcatcaaaggaggctacagctggcaagggcctgggaaccttggtgggcagtgccaaggcactgtgtgactgggctggagctgagaggtgccaaatctgggtccccacgagcctcttcccagagtcatgggtcccaaaggcatagagggctgtggtgtggtgacagtgcccctgcaatgtgtatgggtagtggcatgtgaagcccggtctggcccagccagcataggaccatatctccctcagtgcagacgttggggattgaatccataaaggactctggtatagacctacacattctagaactttctttgtgtgagagaggggtttgcatcaggcagactgtgctacgtctaactgtacctttctgccaaggagtacagctgatcatgcttggggctctggccgtgaatgttttctcaagggcatcacaagttggcatagacaggcaaaagtccagttctggcttgaacttcagttgggggttcaatggaggtcagagccactggcatgtggaaggcttccaggtgtgacagctgttctgccctgcctggcatcagccacagggacaccccgtgccccattcctacatatctcaattgtagaacatgcagcccccttcccctaagtgtctggggctcctgagaactgagaatagggtatgtgggcaggttggagcccacaggcttcagagagggaagggtgtctgtgggtccatactaggctacttgggcctcactttctccatctgtgaaatggggccattgcccttccatcctctagccatggtgttcatcaaacaaagggggaacaatacacaagttttgaatgtgggggcttcccaggtgttccccaggaatcctcctggcttcaggaatatagacagtgccctagcttcagcctgcctaggcagggcttcagttcatgagtcttattcctgggcaaatgctttccagaccctacctgtgctggagctgtcctctctcagaggccacccaaggcaaaaagttatgagagatagacgctccttgtggggaagttcagggtacagcctgggaggaggaacctagagagtagcagtacctttctagtctctggcagctctcaccggatttaggggtggcttggggagtttcctcaagccttgctcttagcaaagcctgcctcgcaggtcaaggccctggccaccggcctctggctaaacaaggaccccctccatctccgcccgcctctccaggactgcctccgtgcctgccaggaacagattgaagcccttctggagtcaagcctgcgccaggcccagcagaacgtcgaccccaaggccactgaggaggagggggaagtggaggaagaggctggtctggcctgcacgcccaccgacgtgcgagatgtggacatctgagggccaccgggcaggcgggagccaccaagtagtggcacccgcaaagaggaaggagccagcccgggtgctcctgacgacgtcccccttggggacatgttgttaccagaagaggaagttttgttctctttgttggttgtttttccttaatctttctcctttctatctgatttaagcaaaagagaaaaaaatatctgaaagctgtcttaaagagagagagagagagagatagaatctgcatcaccctgagagtagggagccagggggtgctacaaaaatagaattctgtaccccagtaatcaactagttttctattaatgtgcttgtctgttctaagagtaggattaacacaggggaagtcttgagaaggagttttgattcttttatatgttttaaaaaaaaaagcttaagaaacattgctttaaaaaggaaggaaaaaaaatacagcaaaccattgttaaagtagaagagtttttaggttgagaaatgtactctgctttgctgaaaagccacagcttaggccctcagcctcactccctggcttgctcagtgcctacagccctgttacctgatacctgtgctttatcccaggggtgggcagacctcttaaccttatagatggtcagtgcgacctctagtggtctcatggcgtgtggcacaacccccctccccagggctcagcttaatgtgccctctccccccaacaacctgcaggttcacagcgccagccacacagcggtagggatgaaatagtgacataatatattctatttttgtaaccttcctattttgtagctctgtttagagagatgctggtttttgcctgaaggccctgcagcctgcccacatcaggttaaacccacagcttttgtgtgtggtttgttttgttgtgttttctttctctatgttccaaaaccattccatttcaaagcacttttggtcagctagctggaggcagtgttgctggtgtgtgttggggggaggggttctaatggaatggatggggatgtccacacacgcattcagatggctgtacaacaggttgtagggctggtagtatgaggtgcttgggaagttttgttgggtcaagaagagagaactctgttctcgcaccaccgggatctgtcctgcaaagttgaagggatcctttggtgccagctggtgtttggaagtaggaaccatgatggcattacctggacaaggagattggggacaactcttaagtctcacacaggaggcttttaaacactaaaatgtctaatttatacttaaggctacagaagagtatttatgggaaaggctgcccatgaccagtgtgactcaaagcaatgtgatctcccttgattcaaacgcacacctctgccctgctggagaaggtttagggccatgtctgagagattggtcttttattgggcaacggggggggggggggggtccttaaaaaaaaaaaccacaaagacagagatttggtctgcttgactttcccaacccaattggccccattggagagccatccaaactgaggaaaattaggggactccaaaagagtttgattctggcacattcttgccgctgcccccaagttaacaacagtaggtaatttgcacacctctggctctgtgcctttctattaggactttttggcaaaaggtggagagcgggaggcttaagaggggatgtgagggaagaggtgaaggtgggaccacatgggacaggccacggctcctctcatggcgctgctaccgatgactcccaggatcccaggcgttcagaaccagattctcattgctttgtatctttcacgttgttttcgctgctattggagggtcagttttgttttgttttgttttgcaatgtcagactgccatgttcaagttttaatttcctcatagagtgtatttacagatgcccttttttgtactttttttttttaattgtgatctattttggcttaatgtgattaccgctgtattccaaaaaaaaaaaaaaaaaaaaaaaaacaggttcctgttcacaatacctcatgtatcatctagccatgcacgagcctggcaggcaggtgggcggtctgcctccagggatcctgggaccctgatggcgatcgtcctgtcatgctgggcccttcatttgatctgggacatagcatcacagcagtcagggcacctggattgttctgttatcgatattgttacttgtagcggcctgttgtgcatgccaccatgctgctggcccggagggatttgctctgagtctccggtgcatcatttaatctgttaggttctagtgttccgtcttgttttgtgttaattacagcattgtgctaatgtaaagactctgcctttgcgaagccagctgcagtgctgtaggcccccaagttccctagcaagctgccaaaccaaaacgggcaccaccagctcagctgaggcatcccagccaggcaggacccttgagggccgctgtgtccatggtgatggggtgaggttttggccaaaaggccaaagactggtggtgggtccacggaatctgccctgtgacatgaaaggctttgagggactctggctggtggccaggttggctttttgtatttctggttgacacaccatggcgcttcccagcacagacatgtgaccagcatggtccaggaaaaaaaaaagacaaaaaatctagaaaataaaattggtaaaatctcagctcactgttgtctgtgttttctgggaacaggagtggggtgatgccacagccatgtggggtggcatctctggccctggcaccaacctgggattcccaaggggaagggtgtatgcaagtgacagccaagagcaaagtgggagcctctggcgtcagggaggccagcgacagccactgatcagaagcggctctgggtccatcactgccagctcaccctcctgcttatttgcagatggaagatcaacagaacccgcgttcactgccccttgtctggcgcaaatgggtgtttgctctgggtgaatcaccgtttcttaggtgctgccaagcgcccagagagccatgcttagtgttagggccaagacccaaggtggcctttcacatagttctgcagacctgagtggcctggcaagactcctgtgatgtcttcggggtggcagttactcatgactagtattgtttccaaaccctgtggggacaggtggcttttagacatcatcttctacaaggtagcttttgggtctcagcttggctgttttggtgcctggtgggcccctgcccttctggaaagtggagggtgtagaggacacctggtctgagtggtgccacccaatgatgaaagcagaaagagatggacggagggaagcccacagtgaccttgccaggcgacctactcaatgagagtatatgggaacaccagagccagaggtggcttatgaagacacagtactcatcttgtaccaaattgtctgatggcaggatccagaaggtattttgtcagcccagctccatataagcatccgagccgggtccacagtcacatggcatccaggagaatgggcatggggccgtcagcattccaggaaatggccaaagggcattgaggtggaagagtgctttcccccttggttcttagaagcactggggagcgagcttatcgtgtccaggtaggctgacatgaggaaatccgctggggtgcagcagccaggcagccagtgcagcagagtggtactaggaatgcagacacaaatagcaaggggctaagcatccactcaaaggctgctgctgctgctgcagctgctgctttccaccactgcctatcaaaggtgctcatggaagggcgcccaactggaatgggcaagcatcaccatcaactgcacagggctcacacatggtgccgtctcttaacggtgcaattggcttgtctcgtcatccagtggtctgtgattcccagctgtggctgatagccaagcctcttttcttggttttagcagtgaaaccccagataccactggccactccaggctccaaccctcaagtttaactggtaacactggaggctagatcctctgctgggtgtagagatactcctgttctaagggtgatggtaaaatagctttttgagggccctcagagataaggactcagggagccagcacacccaactgtctcctctcagaagctcaatggctggttctctctctgcctctaccagctccatggtcccctgccctgtgtcctggccaggctctccttttgcaggcggcctccatcctgctgagccatcctacctctctcagccaagccaagctcttgaacctgcctggcctctctgagcctcagctccctgaactggaaagattgcccctggctccccattctgtgttgccccactgcctggacctgctccagccttcctgtttgtcctacaggactcacagtgaatgtggcccctgtggagcatgtggagcatgacattgcacaggtgactctgtgtagcctctcccctcctgactccacatcctagaaccaagtgtgaggaagttagcctgttgcccatgggtcagctcaactgctgcactttgtcccagaaagcaggccaacttcaccaaccctacagaggatctgggctgctggggcccacaaaatgccagcagtgggagctgaggactccaaggggtgggacacaggcagaagagtaggactgtgtgttctccctgcagtgccccaaagccctggccacaacatcccaggagacagtcaatgcgggttgggctgtgtgtttggtggcaaggctatgcaggccacataaggccagtgctgggagctggcactgccaagtgtgcttgccaagcaaacctgtacttgagctgataaagcagtctgttgagtgtgtggggtggggtgtataggtaacatgaggcgggcatgttgtatacagggccccacgtgggcacagcacagtgctggtgggatgcagtacccctagttctgagctgatctggcctctcttactcagggatgtcatcccaggaatgtatttgatcaaacagttgtgcaagaggacaaagcaagcacaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaagtaactgctagatccttggacttccattcacagctgctactgaaccattgttgggaattggactgtagactgtaagtcatcaataaattcctttactatatagagcctacccataagttctgtgactctagagaaccctgactaatacaacatgcatacacataaaattaaaatgtgccaggcagtggtagcacatgcctttaatcccaacacttgggaggaagaggcaggtggatttctgagtttgaggccagcctggtctacagagtgagttccaggacagccagggctacacagagaaaccctgtctcgaaaaaccaaaaaaataaaaattaaaaaaataagtaggtaaattaaattaaattaaaatgtttaaaaagaagaaatcttggctgaatattctacagttttttaagagtttgtcaaacattttgatgttacaatggccaatgatgacagtagcccctcacataaatacatagtacagagggcaaaagtgtgcacagggccagttcagaaattgctggaaaattctgtcctgaccctaagacaagtttcactgaacaatttttttatgaaaatggtcgggctggagagatggttaagagcactgactactcttccgaaggtcctgagttcaggtcccagcaaccacatggtggctcacaactatccatattgagacctgacgccccctcctggtgtgtctgaagatagctacggtgtacttacatataataaataaataaatcatcaaaaaaaaagaaaatggtcaatttttaaaatcagacattctaatataatacaaaccatagctatactaatttgacacctgttgaggcctgagagcacaacacattaaagacttggcttgccataaggaacccgtcatgcctctgtgagagcagagagctgtgtacaagatggatggacgttgtacttcttacaatgctggtctgggttgagggggtttcattcgggtgctgtgtgttggtgcagatggaatgacctcgtgcagtacagagcacagaaccgagactgcattgaagtcttgggatgcaatataggtgagcgtctagaagcacccttagatctgattatgcatttgatgtacttcatttttagacaggacctcactatgtagctttgggtggcctggctgagtagaccaagctggcctcaaattccagaggatgcatctgcctctgccttctgggtgcttggaatcaaggtatgcgtgccaccaggcccagtaaatttaattttttcaaattaattcttttctcatgtttagaaatcttttcctggtttttgttgttgtttgtttgtttgtttgtgactcctacattgggtttttgtgactcccatacagaattgggatccacagtttttaagaaactgggcactaaattacccctgccttatgcaaagcccacaaggacaatctggagagaccgcttatgtgaacagcaggagctgactctgttcagggagctaaagggtaaaactgtgtatgctggaccactccatttctgggggttcctggcaagccttaatgttactcatctggacctccctctattttcaggctgtcttgggtctttacgttgtagcttctcatggcctcctcctcagggtccactaccacccaccttaaacaatgccagttccagcctttcaagctgaaatcaagtgtaaaaggcccagccatgcttgagcaggccttccctgcacaagttcaaccacaagcaaacttctgagtgaactgggtggctaggacccttccagagcagacttggcagcaggcctctgagcttgagagcaggttccaaaactcttggtttcaagggtccgcacccactggcaacagtaaggaaccttctgggagaatgggcaagcacttcaagtcttcaatcctgcagacacttggtctttaggcactgatgcaacctctccaatagaggactaaaggacccaccatccatgaagcatggggacaggcactccagccctgcaacccaggaatggccagggtcttatggaaagtgcctctgggaagctgaccacagaaaggcaaggagtgacttcccttcttagaatattaacctgaggtcaccctaacttctaggaaatgtgagcaaagccctattcaccccagatggggctccagtgacagaccaaagtatacttctgccacagcccaatttggtgaaccaatgagtttctaagtggttagttggttataggagtgtgggagacaccccagctacagataatgatcttgtgggagttaaaaaaaaagggtccccacttctagtatactcctgaatcccctaagagctctgctgctggggacaaccaggtgaagtagtggctggaatcccagggtcctccctgccttctccctgtctgtcacccccttaccatgtggttatctctgtaactagttgccacagcaacctaccctacatcatcattaagatggtggtagagtgaactgaactacaacacagagccacaggctgctgacctttgagacaggttcctggttgtcagggctctggggtcccatgcctcattttctctgtcagccctgtgacttcagtttcctgagatacacagcaatttctagctctgctcataaagctgggagccactaaggtcagtggggcaatctttctagtcagcacactttggtcatctccaggtggaacctcaaagtgaacatgggagtctccctcccaggaagtctccctgccacctcctcaggtaactgagtgctcccctacctctgggctcccagaaggtggcagccattatcagagagcccacacggggtctgaagcatctgacagcccttcaacactgctccttctctataaatccatgctttcctagacctgctagattcaagacatgccataggctcaaatgagcaagaaactaggctggagcagcaggcacaactctcaccccactatgctttgtcccgcctggaattggccctttactgtgacctcctgcagtctctccaccagcccacgttgctgactacagtctggtacatgtagacttagtggtatggggaagtcagggcttagcaaacagaactgtggccccttcttccagtttcctcatctcactaccaggcagaggaagaaaaggtttggggtaaatagaaaataaggagggagtgagccagagtttctgggtgtttggtctcaacacaactatcctacaaacatcaccatcagcagggctgggggatggagaggtggttaagggtgcttgatgatgctcttgaagaggaccctgcttcagtcctgaccaccatatgacagctcacaagcacatggaactccagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaggcgaatttctgagttcaaggccagcctggtctacagattgagttccaggacagccagggctacacagagaaaccctgtctcgaaaaaccaaaaaacaaaacaaaacaaaacaaaactcctcactaacactagctttatacagaacttcaatctgtatttagctccaggctacaattggtcctgcagtcacagttagggattacatagtgtctctgcaggcccaaaaggccttctggatcacagtttagacagactgcaggaccattctgccaggccctctctctgtttagttacttttctgtgttgacaaaaaaaaaaaaaaaaaaaaaaaaaaaaaggcaatttgcgggatgaaggagtttattctgtccagtttataggtggcaatcattatggtgggaggcatgacagaaggagcctgaggcagatgctcatatcgcatccacggccggtgaacactgttgctcagctcactttctcctttcttttcagtccaggaccccacttcatgggacacagcgcattcaaggtgggtcttcccttctcagttaagcctccctgagaagaccctcccaggcacacccagaggtatctacgaggtgattctaaattgtctcaaggtgactatcaagcaggcagcaagctgagcagaaagacttggggaaagccagcccagaaacctctgcctcagacctccagcatgtgacaagtgattgctcataagggatgacatctaagctagagtcacaggaagccagaacagggtgggatgagtgatagaaaacagaccggtagtggggacacatagctcacaggacatggtctgagaaggcaggggattgaccagcagctcagtgattatcaaggacacaggttccactggtacctgactctgccaccttcagcgacagcttggccacagctcccacagttgtctatggcagtccaagtaacaccttcatggtacagcatccaaaagcagagcattcttctgacgacctatgccctcccctttcacagcaggtgtgactcagtggtgggaggaggcggcatgcccacgtggcagaatggtcctgtagtctgtctaaactgtgatccagaaggccttttggggtaaccaaagcattctggggacttgatggggactttgagaaagggtcaagtgggcagaggtcaaggcttgtacaggaacatggaaagttatcaggcaagcggctgtggtgatgctgatgggtgggagatctgacacctgatgtacacaaggtgaggggataggaggtagagatgaagggagaagagaggggaagagacaagagaggaactagcaactgattgatacctgtagtgaatgtgacaggcacagtaggcccatatctgtgaacctacatcttgacatgcaccatcttggcactgaaggactgctgcagctgtcagtagaaatgatcccagacagactactgctttaaaatacactatttattcttttttctgaatataataggaaagtaaaatatggtgataacagcagctcagttctcacaccgaagagtccctgatcctgggcacctgagagagtggtgctgaatacctgagaggtagccgccaggcccaggaggccaggtgcatggtgccccaagcctcagactcaaaacatatttacaaatccttcggacatacagctaggctctattctgactagattataactgaagataacccatttattttaacctgcattctgccagctggctggttacctgtgctcaggtaccatgtgtccatctcctcacatcctccctggtagatctcccacctggctctatcccagaatgctttctctctcccagatgttccgcctatttcctgcctaagccataggccataggctttttgccacaggtgaggcatccatacaacacaaagatattctctctacgaaatgcctgagagcactgtgccactcctgccagctcgtcttatatctgcctgtaaataccatgccagacacacaagctgttgctaaaggaagtacagtgtcaccaggcaagccctacacattcacagtggcggccaccaattagtcctgctttggtttccaatagttcccctaatgccactttttgtttgtttggttttgaattcactttgtagactaggctgacctcaaactgagagatctgcctactatctcttgagcactgggattaaaggcgtgcaccaccagcacccagctccattgccactccttaatgtatagagctcaccccacacctgttaggagcagcatgaaggccctgcttcagcttcctcccttgtctcgtcacccttgtcttctcagctgggcatccagaggcaaaccaagtccagtggagcctgagtcctgtgcagatagcaggaatcaggtcctccagtggtgttggcaatgacagcgcatgttggaggcagaggcaccatgtggtacttcagggcatggacctggggtgggggccagctctgccaccaggcccttagactagatgggtctattttatcacttctaagccataaggtatcctccacctctggggctgccagagggatggagtgaaacaaggaggcccaagcatggccagcagaggctcagcaggcagcaaagatcctgtcacggcttcccatgacccatttcacatcggcctgcctctgtgagtcccaccctcagggtaaccctacccagggccactcactctggccagtgacaagcggtcttttgagtgtgttgcccctgtgcagaaggcagggtggtcaggtaagccacctaggcagagactcagggaagaggccaagctggtcctcccacagaacaatggattcctctcaggcttgcctttaatcactgtgacacttaatgtgcagacatctgctcttctgtgggtcctcaaaacgcaagtccagagcctcctggagtcaccttgaagtctggctgcacgttgagcagtgagcacagctgaaagtacccaagagcccatgccttacacctcctgcacttctgctcagctttccctatcccagcacaagcccaaaggctatgtcgccttaacgtccccaacccactttcagtcattctacaagggccaaggaaacaagttcctctgggtctatatctgggcacacattgcccaacacaaccatcacatgaaccctagggcccacgccaacctggccttcaaagccccctcaggcacaccccatagac

SEQ ID NO: 978 - DNA, 3737 bp, Mus musculus
gagggctgtcggcgcagtagcagagagctacagactccgcgcgctccggagaccggcagtacagcgcgaggcagcgcgcgtcagcagccgccaccggagcccaaccgagaccacagccctccccagacggccgcgccatggaacaccagctcctgtgctgcgaagtggagaccatccgccgcgcgtaccctgacaccaatctcctcaacgaccgggtgctgcgagccatgctcaagacggaggagacctgtgcgccctccgtatcttacttcaagtgcgtgcagaaggagattgtgccatccatgcggaaaatcgtggccacctggatgctggaggtctgtgaggagcagaagtgcgaagaggaggtcttcccgctggccatgaactacctggaccgcttcctgtccctggagcccctgaagaagagccgcctgcagctgctgggggccacctgcatgttcgtggcctctaagatgaaggagaccattcccttgactgccgagaagttgtgcatctacactgacaactctatccggcccgaggagctgctgcaaatggaactgcttctggtgaacaagctcaagtggaacctggccgccatgactccccacgatttcatcgaacacttcctctccaaaatgccagaggcggatgagaacaagcagaccatccgcaagcatgcacagacctttgtggccctctgtgccacagatgtgaagttcatttccaacccaccctccatggtagctgctgggagcgtggtggctgcgatgcaaggcctgaacctgggcagccccaacaacttcctctcctgctaccgcacaacgcactttctttccagagtcatcaagtgtgacccggactgcctccgtgcctgccaggaacagattgaagcccttctggagtcaagcctgcgccaggcccagcagaacgtcgaccccaaggccactgaggaggagggggaagtggaggaagaggctggtctggcctgcacgcccaccgacgtgcgagatgtggacatctgagggccaccgggcaggcgggagccaccaagtagtggcacccgcaaagaggaaggagccagcccgggtgctcctgacgacgtcccccttggggacatgttgttaccagaagaggaagttttgttctctttgttggttgtttttccttaatctttctcctttctatctgatttaagcaaaagagaaaaaaatatctgaaagctgtcttaaagagagagagagagagagatagaatctgcatcaccctgagagtagggagccagggggtgctacaaaaatagaattctgtaccccagtaatcaactagttttctattaatgtgcttgtctgttctaagagtaggattaacacaggggaagtcttgagaaggagttttgattcttttatatgttttaaaaaaaaaagcttaagaaacattgctttaaaaaggaaggaaaaaaaatacagcaaaccattgttaaagtagaagagtttttaggttgagaaatgtactctgctttgctgaaaagccacagcttaggccctcagcctcactccctggcttgctcagtgcctacagccctgttacctgatacctgtgctttatcccaggggtgggcagacctcttaaccttatagatggtcagtgcgacctctagtggtctcatggcgtgtggcacaacccccctccccagggctcagcttaatgtgccctctccccccaacaacctgcaggttcacagcgccagccacacagcggtagggatgaaatagtgacataatatattctatttttgtaaccttcctattttgtagctctgtttagagagatgctggtttttgcctgaaggccctgcagcctgcccacatcaggttaaacccacagctttgtgtgtggtttgttttgttgtgttttctttctctatgttccaaaaccattccatttcaaagcacttttggtcagctagctggaggcagtgttgctggtgtgtgttggggggaggggttctaatggaatggatggggatgtccacacacgcattcagatggctgtacaacaggttgtagggctggtagtatgaggtgcttgggaagttttgttgggtcaagaagagagaactctgttctcgcaccaccgggatctgtcctgcaaagttgaagggatcctttggtgccagctggtgtttggaagtaggaaccatgatggcattacctggacaaggagattggggacaactcttaagtctcacacaggaggcttttaaacactaaaatgtctaatttatacttaaggctacagaagagtatttatgggaaaggctgcccatgaccagtgtgactcaaagcaatgtgatctcccttgattcaaacgcacacctctgccctgctggagaaggtttagggccatgtctgagagattggtcttttattgggcaacgggggggggggggggggggtccttaaaaaaaaaaaccacaaagacagagatttggtctgcttgacttttcccaacccaacccaattggccccattggagagccatccaaactgaggaaaattaggggactccaaaagagtttgattctggcacattcttgccgctgcccccaagttaacaacagtaggtaatttgcacacctctggctctgtgcctttctattaggactttttggcaaaaggtggagagcgggaggcttaagaggggatgtgagggaagaggtgaaggtgggaccacatgggacaggccacggctcctctcatggcgctgctaccgatgactcccaggatcccaggcgttcagaaccagattctcattgctttgtatctttcacgttgttttcgctgctattggagggtcagttttgttttgttttgttttacaatgtcagactgccatgttcaagttttaatttcctcatagagtgtatttacagatgcccttttttgtactttttttttttaattgtgatctattttggcttaatgtgattaccgctgtattccaaaaaaaaaaaaaaaaaaaaaaaagaggttcctgttcacaatacctcatgtatcatctagccatgcacgagcctggcaggcaggtgggcggtctgcctccagggatcctgggaccctgatggcgatcgtcctgtcatgctgggcccttcatttgatctgggacatagcatcacagcggtcagggcacctggattgttctgttatcgatattgttacttgtagcggcctgttgtgcatgccaccatgctgctggcccggagggatttgctctgagtctccggtgcatcatttaatctgttaggttctagtgttccgtcttgttttgtgttaattacagcattgtgctaatgtaaagactctgcctttgcgaacgcagctgcagtgctgtaggcccccaagttccctagcaagctgccaaaccaaaacgggcaccaccagctcagctgaggcatcccagccaggcaggacccttgagggccgctgtgtccatggtgatggggtgaggttttggccaaaaggccatagactggtggtgggtccacggaatctgccctgtgacatgaaaggctttgaggactctggctggtggccaggttggctttttgtatttctggttgacacaccatggcgcttcccagcacagacatgtgaccagcatggtccaggaaaaaaaaaagacaaaaaatctagaaaataaaattggtaaaatctcaaaaaaaaaaaaaaaaaaaa

SEQ ID NO: 979 - DNA, 888 bp, Mus musculus
atggaacaccagctcctgtgctgcgaagtggagaccatccgccgcgcgtaccctgacaccaatctcctcaacgaccgggtgctgcgagccatgctcaagacggaggagacctgtgcgccctccgtatcttacttcaagtgcgtgcagaaggagattgtgccatccatgcggaaaatcgtggccacctggatgctggaggtctgtgaggagcagaagtgcgaagaggaggtcttcccgctggccatgaactacctggaccgcttcctgtccctggagcccctgaagaagagccgcctgcagctgctgggggccacctgcatgttcgtggcctctaagatgaaggagaccattcccttgactgccgagaagttgtgcatctacactgacaactctatccggcccgaggagctgctgcaaatggaactgcttctggtgaacaagctcaagtggaacctggccgccatgactccccacgatttcatcgaacacttcctctccaaaatgccagaggcggatgagaacaagcagaccatccgcaagcatgcacagacctttgtggccctctgtgccacagatgtgaagttcatttccaacccaccctccatggtagctgctgggagcgtggtggctgcgatgcaaggcctgaacctgggcagccccaacaacttcctctcctgctaccgcacaacgcactttctttccagagtcatcaagtgtgacccggactgcctccgtgcctgccaggaacagattgaagcccttctggagtcaagcctgcgccaggcccagcagaacgtcgaccccaaggccactgaggaggagggggaagtggaggaagaggctggtctggcctgcacgcccaccgacgtgcgagatgtggacatctga

SEQ ID NO: 980 - DNA, 30346 bp, Homo sapiens
catgcctgtaatcccagcactttgggaggccaaggcgggcagatcacctgaggtcaggagttcgagaccagcctggccaacatggtgaaacccgtctctactaaaaatacaaaaaaaaaaaagaaaaaaaagaaagaaaagaaaaatagctgggcatggtggcgcatgcctctaatcccaactacttgggaggctgaggcaggagaatcgtttgaacccaggaggtggagtttgcagtgagctgagaccgcgccactgcactccagcctgggagacagagcaagcctctgtctcaacaaaaaaaaaaaaaaaaaaaaaaaaaaaaggggaaaaatcactccaatcatcccaagtctcagctcctactcttttgctatatgtccttcaaaccagctatgtatttattttgctgaatttatgctggttttatcttttgtatcttgctttttttcatttaatgtttttccatccagtgaacacaccctaatttgccattcccctcttcttgaacatgagattgtctctagggtatctcttgcaaataggataattgtcaatgatgtaacgggtctctatgcaacttgcaaaagtgatcagtcttggtgtcctcctcatcctagtgtttggttccaagcaacagaaaccaatgctggcagatttcagcagaaaaggaaaatcagatgcagaagataggcaggaacaagggaggcaagacagcacgaatcacaatggaagcatgctgcagatcttctctgatgagaagccagggctacccctacccatcccaacaccagaccctccagtaaaactgcagcggcccacaccaccttgtcaccagagcccacagctctatgatgggcagcacagatactgctgctcataaacttgaatgcctcacccagttctacactagaaaacatttcctaccttttctgattcttcccaccaccagctcccaattcaaaatcttgatccaaaaagatgaaatgtataaataatactatttataatgacatcaaaatatcaagtacttaagaagaaatctaataaaagatgcacaacacccaacacacacacacacactcacacacacacacctgcaattaaattaaggacaatctaaataaacagaggtctatatcatgcccatgaattgaatgactctgttagtaaaagtgtcaattccctcaaaattgatctatagatccaatacaatcccaatcaaaattccagcattgtgtgtgtgcacatgtgtaagttgattctgaaatgtttatggagccccaagggccaggagtagccagggcaaccataaaagagaagtgggttggaggatttagcccgccagatatcaagaattcgtagcgtatagcttccatgatgcttctggggtaaggactgaaaaagagaccagtggaacgggatagaaagtccagaaacaagagatttgtgttaagtgagcagattttagctgctctgttcacaaaaaaaagtaactatgtgagatgacaggtatgttacactaattcactatggtaaccattttactatgtatatgtatcttataacatcatgctgtcaagtttatttcaaaaataaattttacataaaatcttagcagtgttattcataatagacaaaaagtgggaaaattctatttttttaaagtacagaaactttattcctcaaaggggaaataggttaataataataagaagaagaattaaggccaggtgtggtggctcatgcctataatcccagcactttgggaggccaaggccagaggattacttgagcccaggagtttgagaccagcctgggcaacatagtgagaccccatgtttacaaaaattaaaaaattagctgggtgacgtgacaagtgcctatagtcccagctacttgggaggcgaaggcaggaggattgcttgagaccaggaggtcaaggctacagtaaggtatgatcgtgccactgcactccagcatgggcaacagagcaagaccctgtatctagggggaaaaaaatgataagccttgtgaaagagaaatgaaaacagcatccacacataaacttgtacctctgtgttcatcggcagcattgtccacagtaaccaaaggtagaaaccatcctaaggcccattgactgatgaatggataagcaaaatgtggtctatcaatacgattgatagtattcaaccataaagaggaatgaaccatggacacatgccacatgtgggccttgaaaacgtgatgctaagtggaaaaagccagatgcaagaggctgcatagcatatgattccatctgttggaaatgtccagaaaaggcagatccacagagaaagattagtggttgccaggggctggggaaaagggggaagaaaagggtgaataactacaaatgggtacagggtttctttggcggatgatgaaaatgttctcagatggtgatggtggctgtccaacataacaaaatccatcgaactatatactctaaacgagtgaactttacggtatgtaagttatttttcaataaagtggtttcaaaaaaataaaaaggtgaaccctaccatttctaggtgctttggagtttaccgtttttctccttgcattctggagtcagagtgagaaggcatctcagctctaccacagctgaatgatgtgttgggcttcggtttcctcatctgtaaaatggggataaagggcctctccttggagctgccatgaagattgaattagatgccctctgtgaagatgcagggcaggtggagagcacagtaagcgtctcggggggccacgccatcaccgccagcagggctcaccagtatctttgcccagagaatagccggggtctagggagcagccagggtctagggagaagggctgcttccctgtggaggctcctaactttcccatctcctccctgtttctcccctgcccaccccttactcctggaagtgtgactcgctgcctcctcccgtgactcccctacattgcatctccccagttactgtcgttatctctcatctcttctttccaaacagcctctgtctagcaccttggagctcgcatgggaattcatgggtgggtggattccaagcttggcttcatcagatgacaactaaaaggcagaggcctgggggggcaagggagctccaggatctgtctccctttggagaagcccaggttcaccttcccagcaagctgctccggccccacgcccctggccctcaataaccttcagtggctcccttcttgcagctataattcccctcttgggatgctacaaaagggattccagagatttttttttcaataactcaaaagggatggagtaaacgatatatgtgcccaggacaaggcagctaagggaaggcctcaggcttcctttgcctttgcctggaagtataccaacccgcagcccggagggccagcagagaaccaatgctcagagcctgggggcccaaggaatgctttccaggctggcggtcccaggagccccctctcccttccctatagcaagatactaagagcagaggctggcctggcaggccgtgtcgaggccctgagctcacatggccttggcagcttcttgacagtcgtgtctttttgtttccagcagtgacactcactgacccacacctttggccagcgtcccttgtgactgccccctcccgcttgagcagaatggctcctattacacaatgggtgccaggaacctggccagtccatccagagacagggcagagccctgggctaccgaccctctggggccagcagaaaccctccctatggctctgcctctcatcctggcattgacacttgtgcccttaattaaagtgcttcttttttaaatcaacatttctactccttttgcagagtaagagaaagaagagttaggggagaagaaagaaggaaggattcatggggttattttttttttttcatgtaaaagtttgttccgtgatttaaatctcatgtccacaaacagctcaggagaagtcagcatagagaagcaagctgacagattataaagtcatttgtaaaatcctctttctgcatataaactgaaatgtgtaattaattccacatactgcgtgtggcacatggccttcatcctgcataagaacaaatacatgaatgaataaatcgagcaggccttgacactcaccaggccctgtgctaaatgctttctacatattaccttaattactcctcaccgtggccttgcgaagaaaacgatcacagcccgttttacagatggggacagagatttgtccaaggccacacaactagtggcagatgtaggtctgtatgtgacattcttgttcagtttcataaatgtggctgccacctgcctgaaattttgagggaaaaaaaagtggtttggctttgcatgaattcttgaaaaagtagatttttatctttaccagcttctaagcaagctggatttattctgacagtgtccatgaaatggctacagaccatcaccgttgccaatgttgtgaacctgaacaaggcacctggtttctctgtgcctcggtttccttaccattaaacgcatttccctgagattaagtgtgtgaaactataagttggctggaggaaacacctcatagaagtgagaagatgaggatgggtggtgagtgaaggctttttctccaaaccctacaggagatggacctcaaagcaaatggccatgcttcccttagactgggtgaactggtgctgctcagggctagaagtgtgtctagaagcatggggaccaatgcagccccctccaccctagggcacataacctgtctctctcccataggatagcagagacagctctctaagtcaggattcagcgagatggtccaggaggggcctaaggattcctctgacttatccaagcctggggaggcaacacaacctagcctgtgtctcagggggccccaatcatgccctgaacctcatgagcccaggcaggcatcctgttggttaaggtcggcctcagggtccagggatgcactagattctttatcttaaagtgaccctcaagaaaaaaaaaataaaatgtagctataggcagtttctggacgttttcctatttgttaagcaccttcttgctccgagctttccagccacagtgcactggacgccatcggaaggctgcagctgctatttggtgctttaccaccgctgagaaggtggaatggtcacggcccggttctgtcactttcttcagccggacagtcgccttattacggattccagtagggccgagcacactccttcctgcccgtctttacagatgaacatgctatcgctccagcagtacaacccgccttattacgtaaaaaagcagcccctatctacccgcagggaaggagtatgttcggcaccacagctggactggtgctcgagttaagcgtcctgggaggtccgcatgcgctccggaaccgtaatgcgcgctttttctaagccttacggtaaacgcggacgcagggcaaccacgtggcggtggaaccgaggcccggcgggaatgcgcggaatgcgcggcgcggcctcgcgcggttcccgagccacggcccagggtccggcggcgcgcgctctcgcctcctcccctcacctctcccagccgcaccccggccctggccctgccacccagaactcgctgggcaagtcgtgccccgcgtgaacacacagaaggggcttggggaccgagcgcggcccatcagtccctcagaccctgaggacccagaattccctaaggggtccgaatccgagtcctgcccccagcccttaaggcacgggctccagggaccccaggggaagggcgcggggcattaggtacgcaacccgtttccccgcacctggaaaaaaactccctttccctcccctcccctgcttgttgagtgtgcggataaccagaactctaaggcgccccgtaataacgaccccgctgtccctccacccacccccaagtgccaaagcgagggatggaagcgctttcaagcgttccaagggcattgaggagcgagctggagaggcgcggggatgcggggtcctccccgcagtcttccggaaagggcgggggagggcgcggcaagttccggagtggggcatgccgtgggagcccacgagggcctcagcgcggatcctccgccggaaaaccggctcccgcgagccgccgccgcaggtttcctaggccccgcgagtcccgcagcgaagccctgcgtctccgtccgacgcgggggtctgctcagcctcgggtgggccgcggccaggcctgactgcgggggagagggccgaacgtgacctccgaggtcacccccagccagctttctctcctgtggtcggaagtggttttcttctcgatctgggcgcctactccccaccacttggtctgagaggggctggggccggaaggccagggaatctctggtggatttgggggttcatattgctcagggtaccagccgatgcgttttgaggggcgggagtcgaggaattagaatcgcctttaaccctcaagagttgcgccttcagcctcgggatcccagatgcgtcgttggagccagggccgcccccctacctgttgggtttgcgttttaactccagcgcacaccttgccggcagccctcggagctaggggaggggtctcgtttccccgcagcccgccggacagacgactggggcacgggaggggcggtggcagggtggtctgtgtgtggctgaaactaattgatctggagcggaaacgcacgtctgcggttggggcgatggggggggcggtgcggctgtccatgtgccgagcgtgtggctgtctcgggtgggcactggggccggagttcgccccggcccacctcgcagttttggggcgcctgggatcggcgctacgtaagcgaagcagagctgccatagcacgtgggccgccacgcgcaccccaaaagcaagcagtgtggggggaaggggagctcgagcgccttcggagcccaggggccggctttcggaagcgttttcccgggcgacttaagggcttaacaatggaaaactcgcggagcctgagccaagtcctttcaagtcgccgccaggtatgcggctgcaggtgaccccacctgggtgcgcccgcccgccagccgccctggtggaaaagcgggtgcgggaggtcgctggcgaaaggtcgggactggtccctgcaccacccgcccccaacccaagccccgagccccgcggcgcgcagccgcgctgagtcccggggtctgcgtcgcggcgcgccggttcctgaatgaacgcgctcccttcccccgcctgaatgaaggttcccacagccagggacggtggcgaacacgcgcctgcagcggaattcgctttctcctgaccgaccatccgcccaggccgcggtcaccggggcgggggccagggggcgaggaaagcgtgaaggtgatttcagttaattttggattttctttcaaacaacgtggttaccctcccgactgggccacttgccctttgtctccaaatggtcaccaagaaataagaacagagcactttaaatgagcccagaatccgcagttcctgcttcgtggtgggttttaagaagacagtgtaaagtaaaactgcaaccgaaaagttttttaaagttgcttttctctttggaaaaaataaaatcaaaatgctttctctgcgcttcttgaagcaatgaccctcaaaagcccagaggtattggccccctcgggggacccgggggccgccaagcagggttcccccaggtgggggctgggcagctggcgctccccgccgggccccaaattccagcgccgggcccgcaaattccagcgcctcccccgcgggttcctggacggctctttacgctcgctaaccgggcttgcaattttgcgctcgtccctgagccgggaaatcaacgaagttcctagtcgagatctgcccggtccgcctagtaacagcgccgcgcccccattggctcatgctaattccagtttcctctgtcttgcgcccgggatgggggggtgaagctccctcctggacccagagccggttgtgccggagtgggcgagcctctttatgccctgctgcccctagccgacttcggcccgcttcgcgcctcgggctgggccagggcgcacgcggggctcggggcccctcgccccacgggatgggagaggccgggtgatagctccgggccccataaatcatccaggcggccgccgggtcgggattttatgaatgaaaaagcagctgggccgcccttgtgcgcgggctgatgctctgaggcttggctatgcgggggccaacgcgattgtgggtgctcggggagtgggggggggcacgaccgtaggtgctccctgctggggcaacccatcgctccccatgcggaatccgggggtaattacccccccaggacccggaatattagtaatcctaattcccggcgggggagggggcgcgggaggaattcaccctgaaaggtgggggtggggggggtcgcatcttgctgtgagcaccctggcgaaggggagagggctttttctatcagttttctttgagcttttactgttaagagggtacggtggtttgatgacactgaactatattcaaaaggaagtaaatgaacagttttcttaatttggggcaggtactgtaaaaataaaaacaaaagttaagacagtaaaatgtccttttattttttaatgcaccaaagagacagaacctgtaattttaaaaactgtgtattttaatttacatctgcttaagtttgcgataatattggggaccctctcatgtaaccacgaacacctatcgattttgctaaaaatcagatcagtacactcgtttgtttaattgataattgttctgaattatgccggctcctgccagccccctcacgctcacgaattcagtcccagggcaaattctaaaggtgaagggacgtctacacccccaacaaaaccaattaggaaccttcggtggtcttgtcccaggcagaggggactaatatttccagcaatttaatttcttttttaattaaaaaaaatgagtcagaatggagatcactgtttctcagctttccattcagaggtgtgtttctcccggttaaattgccggcacgggaagggagggggtgcagttggggacccccgcaaggaccgactggtcaaggtaggaaggcagcccgaagagtctccaggctagaaggacaagatgaaggaaatgctggccaccatcttgggctgctgctggaattttcgggcatttattttattttattttttgagcgagcgcatgctaagctgaaatccctttaacttttagggttacccccttgggcatttgcaacgacgcccctgtgcgccggaatgaaacttgcacaggggttgtgtgcccggtcctccccgtccttgcatgctaaattagttcttgcaatttacacgtgttaatgaaaatgaaagaagatgcagtcgctgagattctttggccgtctgtccgcccgtgggtgccctcgtggcgttcttggaaatgcgcccattctgccggcttggatatggggtgtcgccgcgccccagtcaccccttctcgtggtctccccaggctgcgtgtggcctgccggccttcctagttgtcccctactgcagagccacctccacctcaccccctaaatcccgggggacccactcgaggcggacggggccccctgcacccctcttccctggcggggagaaaggctgcagcggggcgatttgcatttctatgaaaaccggactacaggggcaactccgccgcagggcaggcgcggcgcctcagggatggcttttgggctctgcccctcgctgctcccggcgtttggcgcccgcgccccctccccctgcgcccgcccccgcccccctcccgctcccattctctgccgggctttgatctttgcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtgcggggcttcgggcggctctcttaagacttccctgcaacttgttgcccagacccacgtttctttgctactcacccccctcccttctctcccgctagaactttgaagtttgccgtggtgtttctagggatccgtattttcaaaataaaaattgcgggtattttctgaaggaggaaggggtgggggtgggggtgctagaagtagcgtttcgtgggaggggagaagggggtccgggaggggtgccttcgggagaagccagtgccaggggcaccccaatgggcccgagggtgcgggctggcaggctgggtgcgctttgtgtcccccgcctgcgccccagcccggctgcgcctcagcggccgggagccgccaactccggggggagggggcatagatttgatttttaaattaatatccatggacacgtatgcaagggccgctcgtgccagtattatgcgccatctttgctcttttattgcaaagcaaaagtgtttattaataattgggggcagggtgggggcggggagcggccgccgggcgctggggccgcagctaagggccgcgcggctgccgggagcccgcgggaggggcgcagggacgcggcatgggtagttttggggggaccccgctagggaagggggggcctttgttcaagcagcgagtcccggggcgccccgaacgggcagcctgggccggagagcacggcgagctgcaaggtcgcgtggcccccaagacgccagggcttgatccccgtctgcagggatatcggcttggaggaccttctccgagcgagccgggggcctgggagcacattttcagaccttcggtgggcgcctgaggggcccgcaagtattttaaaataatttttgaaagtgcggcgtggtgcccttgcgagagggaaacgccgcccgcgcccagggggaagggggggccccggagtttgaattcctggggctccccccggagcctgtaacgaactcccaacccccggcctgggtaaagggtcgcccgagggtcattttcagggtttttttatgcacttagttatttttttaatatttttaaatattttttgaaaagatgacgtctggggaaatgcggcgcggcggcctgggacgccacctttgtgtctcgcaggcgcggcgcccaaccccgcggcccgttccgcggccccgcaccccagttggtgtcgacccccagtcagagggaccacggagctccagggcgggccagggtcccgggggccggcagcccgcgccgccgcgcacgccgcccagctgtgcccgctcccgcccccaccgtgccagcctcgcggggactttccctttcagtttcggggagggtgggtactggggacgcgcgggggagggggcgcatcacgggaagctcctgccgcccccagccccgacccctcggcgccctccagacctggcggccctgccaagcgcgatggggggtgcgggggcgtgcgggggggcggcgcgacctggcggcggcggtcacgggccccgtgcctccgtaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctggtaaccactggaccccgccgccccccgccccccgcgagccgcacgcaggaccacggggccggggaaggtgcaggcggtggcggccggcccgcctctgacatatctgctcctccgagggagggcggccccgccgccgggcgtccctgtccggggagcgggcgggatcctagccgccctcgtcccgccgccctgtgtgcgcttgcctgcgactcccaccgcgttcgcgccccgcggtgtggccgaaaagtgggcggcgcgcgccctccagcggctgcacgaggagcgccgcgctcggcgctgagcctccagttccaggtggtgggaggtctttttgtttccacttgcagagtcttttcacgcggcgggcgccttttctgttttgatctgggattgcgtgttgccccagctcccttgagtccccagcattcgccagccctcccctccaacatccaggaccgcacgagacgcaggggccagtgctctgagccggaggtgcggcgtggcccggcccccgtgctgccggcttccccgcgcccccgggctggcccgcacctcccctgatggccgctcaccctgtgttcgcagcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacaggtagggcaggcccggcagcccccggcctccccttgagagccggctccttaggtgaccctggccggcttcttgctctccacctgggtgctgtctgggaagatgtccccagaccccctcctgcgctggagagcgctcttccagctctggtgagcagaggccctggattgtttgtcgcgctggatggagggagatttgctccctcacggccaccatgcagtaccttgggcattggtgtggacggctcagcctgcctgtgtcccgttactctggcctcgtccttcaggccaggcagcctgtggccactccatgctgaaaggggtttaccttggccacagggccgcctcctttctccacccacctccagcccttcttgtgtccttaaggagcctgagctgcagaggccccctcctggcctctcccaggctgggccacctgccagaggcgcctccaggggcggggagagctgtcggcctgcctgcaccacgtgctctgggcagccgagtgcaggggtgtccagcagaggagctcggctgcctgaggccctgccaggggtgccggcagccagccgggctcagctgagccctgagggggcgcttcagagcactctcagcttgggccgccaccgtgggcagcagaagcacccagtcctcacttcccctggcatggccccagaggcccctccctgacatggccttggccccagaacccagtggggacagactcgcacatacacagggtgccgcctcctgctgtccccagccctgcctctgacccccctgtgaccgcctccttccctggcccaggaggcctggttaccttcatgggggagcatggccccatcccacccagctctgctgtggcccacctttggtcaagcctcagttgtcacatctgtttgggggctcactctgggtgacctaggccacaaggcccacggggcatcaaagaggcagtagcatcttctcccctccccagagggcagagccccccaagcctacttcagagctcccttctgacaccggtagcccgcagccggtattccagaatgggttctggtttaggcgtgaggcctcccccacctcctccacctgcttggggcatgaacccctcccccacgtttccaagcgagtccccaaggtgggcagatgaagatgccaaggatgtcgaccagtctggatgggtctggggtgggggggcatgcggcagacagggaggcattctctggctggtgctcctcagaggagagaggcctccggagactccagacagccttttatggagctgaaagtggcttcagagaaatgcaaagtttcctggagagaacgtggggcgtggttcttgcacagcctccctacagggtggctccagcagtggagctcccctcccaggacccctgggtgctagtgggaggcagtgggcaggtgcagattctcgtccttcccactactgcacaccctttgtctgcgaaggcgcccccagcggtgggtgaaggaggagggacacttggggacccagctgtgcacgtgctctcagtgactgtggagtccactccagggtgggtcccgagggaggggcaggagaccaggggacccacccctgcaaagtgctccgggtcctgacccgtggccaccccatggaacgtaactgagcagccagtgccttgttcctgctggacatctgtggagacaagagtgacttacggctgcttaaagtcagaaacaggttgaaggaggtggaggcgtgggaaagagtctaggaaggtgtttttgccctccacgtggcaaaggttacatttaaaggtgatgctgggtgttctccctgcactaggcattcctggccccaggtccccagcaggtgtgcacatgctgcatacactcacgcatgggggtttcagggcaggtgcgcccttggctccgtgggaggccaggtgaggaacgtccagtgccaaggagcttccgggacagctgtcacttccctttacaaccaggcagcggatagggtcaaatcctggagctttggtgtctaattctgggtggctcctaatctaagcacagacagcaccacacactggggtgggggcacgagcttctgaaacaacgtggccccagtgactccacgctgtgtgtgcccctggagacgggggggtgcacaaggtgcggagccagctagaacctgtcgctccctgcagaagcggtttctgtgtgcggttctgatttgcctcaatgagaaggttttcattcatggctcccggctctcagactgggtggaactgctcccatttaaaggggaaaagaggtggctcggctcgttaaggatttctttttctaagttgttacggcgcccagcagccggctttgtctccccttcagggtggctgcctttcttcccggcccctcgccggcggccctctctttaacaaggccgaagttgtttattctctcgggatgaagtctcggatgggccgccacacccctggcggcccgtgggggcccctctccctttgtgcctgggtcggctcccattcagctcccccgaccccccttgttcccgggcgctcagtggcgcgagatgaggcgatggggccgacaaagatgccacactcatccctgccgacctccggctcccagcccagggcccctggttcctgtgcagaattcctcgtgggtgtgacaaaaggctgcccccaggctccgctggggtgggggccaggccaagaggcacatcccacactggcccacctgtccacggtaggcgcatgactgccctgaggaggggaggccggcattccccgccacaaaccaggacgtaattggtggcagggctctctgtggaaagagccagtctgctgtttgtctaggaggtcagtcacagaggccccgagacgcccactactgcagcctggcaggcggatgagcccagtatctggcagtgaccagagggagttttgtgcagaccacaaaggctgatgggctgccctagattggtgtccctcttggaagtgggcccagatgtgcgggacagtccccaggaagccccaggtgagggcactggtgccctcttgggaaagctgctccctcctggggcccggctcccggcccagtcctccaggggtgtcccatggtgactggtgctaggaaccccacacctcttcccttacttgggaagtcactggaattgttgggctacatcagacggcccagaaaagtgtttttgtcatcggccagaaataggagagttgtgagtagagggcccgggtggagttggggtgtacttggtctgtgctctgaaggtcactgtgacagtcatggtcccatggtaaggggcatgggttgctggaagagctcttccttcccgagtgagccaagccgggctctcctggcgccagggcctgagccgcagccacaccacagccgccctgaaggctgccggccagggcttacccctcaagggacacggaatggcttcatcagtaccctgcagccccgtggcctggcccgggtggaggcctaggcttcagccatgcgatgtcccttcagaatatgacttgtctgcaatccctgctgctggggggtggcaggtacttggggtgagggttagggtcatagaagcgacatctctacgtcctcatatttgcgtcatctaattttgtttttgtgaatacgtgataacattcacaaggctcaagatgctaaaaggatgagaaggcagtgatgtccccatcacctgtcctgtgtcttcccgtggctttctctttccttggttatgtttgagtcaacagtggggctgacgttccaggagggtccgtgggccaggctcttgctctccgagtgcccagggatggctggaggctgaggagggcctggatgtggagcctcagataccaagtgcttcccttcaggccgggccgcttgctcagagccagcacacagggatgcccggatcacgggggccctgagagggtcccctgctcacagcctccttccctctctccttctgcctcagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccagtaagtgagggtgatgtcccaggcagccttgccggggcttacagggggagacacctagtgccacggaaatgccgaggctggtgccaaggcccccaagggtgacaaggttggggctggggctgggcccctcggaccccaggccacagactgacagggcaccggcttcttccactgctcctagaacttactgactggctgggaggtcctcacagccttctcacgtcccctggggcttccaggagccgtagagtttctgggcgaagcgtccgggacggaggccccaggcggccccagccaatggtctgtgtggtgatggtgtgtggggttaggcccaggcgagctttgtttgggccacaatgtgcgtggccaataaatagatgcttgaaaagggctcctgtgaggtccgagacaccggacaacgggcggatagagacagccttgttgtttacggcctctttgagaggctgctgctgttaaaccctgggatgactgtgtctttcttcttaaaaatgccattgttttattcccgagtcttttcttaaagaaagaattaaaatgacaatcaaaagggtttgtggcatttaccaaattagaccagagaggtggccgggtcagccgccggccccgcggtgtgtgagggagtgaccgcctgaccccagcttggggctgggtgggcctgcaagacccgttttggctctggcctgggccgcctcttggtggtctgccctcgagcctcccggggactccgcacgggtctcagcagatgctatctagggtccacctgcctgtcccctgcctagtggtgcctctgtcccggggacactgggagtagcggctgcccagcccatgtgtgtctcggaagaggaagaagcttttttgccgtgggacaccgaagttggcaggggcctcccttctgtgttctcggccatggcctcccttgcaccctgccccgtgttatcctttgggggtggtgaggtgtcctcacccgctgtagggtggaggccagcagcccgcagctctctcaggaaaatggctcagaaacaccatcgaggcctccagaagcccagcaaagagaaagcccctccatcaaaatgaaactcgcgtctgcacttttcatttcgaactccacgccctgagtgaaaaccgcttccccgccaggggtgactgccctgggatgttgctgtcttcgggcagttgtgggaagttgggcgctggcccttatttgagtagagaccatcttaactagattggaggcacacgtctcacagctgacagacacacggggtgaagttacccgaggcggagtccactctgcctgatcagctagtgaccaacgtagctgagcccagactcagaaaaaccgtccacagcagaggcccctgcattttctagggcgtgttctagaattttctttggtgggtggaatgtccatctgtgcaaatcgggtgcgcagtgccacacaccagtgacttttcgcggaggagcgtgctgcctttttggagcttctggctgtgggagaacagctttgtccaccggggtagccttgcaggcagctgtggggccagaggaatgaaggaaggtcctggagtctagctgcatgtgtgaccctggagtgggtcatgggcgagggacgggccgcaggtgaagaatccctggatggagctgccaggcccctggggctgagaattgaagctggctggtgttttaggttgaacgtcaggagtcttgtatctcaccccaggcctctggcctcagtttccccatctgtacagtgggactgtttgtgcagccagcccggccagcttcatttgccatgatgagaatttatctgaggggcgggagaggaaagccctccctataaaggtacaggcgctaaaatgtcatgacctcagtggtccacctaaaagtcgttctggcctgggtcatcgcctgtcgtgctatgcctttgtccagccccttctggttgggagttaagtggcacctgtgcggcacgtggtggggctgtggcccagccctgctccttgtggaaggtctgtttcctgggctgcctagagacttggcttgaagccctagcgtggcttcctggcagttgggacacacacagccccaacacatggagccggttctccatccagaagcccccgggcagtaagcagccacttcaggctgcgtgggacttgcccgtggtggagcctaggagaggcccctggctgggcgtggcgttccagatttcacggctgctctttcccactgacagtgtggtgtggacgctgccaagggagtctggagccccagagggtggaggtgcaggacttccaggagcgtccgtcgcactccacccgagggcgagcacctcagtggccgcagtgggtggatgcatgctgtgccaggctgatggctggccccggggcacaggcctgagcgggagaggatggaggggagggatcaatggtccaggtccccctggccacccagcattcatcctcagtcatgcacggcccaaggcttcgacagccattgatcatggaaggccaggttcacctcaagggctgccacatggagaggttaagtctgaaaaggctgaaaaggcagggttaaaagggcctcctgtccagatcagatggcactgaattccccagggagctggcacggccagtgggaacaggcggtgaaggcgctgttggacatggggacgggcagggggtgtgcagggtgggcgggcaagcatctggtgtcttgtggctccagagaccaggtgggaggtggaggcgtttggtcctgagtgtcctgacaggtgatggcagctcccacatctcgctcaggttcagaggaggcagcatgggccgagggacagtttttggcttagtcttgctcttataaaggcttccgggtcatggcacctgggaaggggccctcgctgcaggccccttctaaggaccccctcttcccacctctccccaccctctctctctcaggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccagcgtggtgcctgcctctttgcttcctgggctggccgtgagccagggacgcgtgtcctggtgccctagaaccagggcagggtggcaggcttggcggatgtgggaggccgcagcctgtcctgtgcgctgtgggaagttcagcagcatcctgacctccatccccgggatgacagtcacgccacccgccgtgacaaccaagaatgtctcctgacactgccacatccccgggggtggggacagaatccagccaggagcaggcacacccctcccaactgggaggaagccctcagcacaggtgtgtgaggtgggaggcggtgtcctgtccccgggaggctccagagaataatttgcaggctgcctggctgggtgagcccacctccaaccacgcgagacaacagctccggcctgggtgacgtgagcggtgcccattgatggggaacatcttccccctcttccttgccccaccagtttgtcttcccgggttatttgcagataggaaaataaataaagccggcattcgttaaccctcttctggcgcaaactgctgtttgctctggatgaatcatggtcctttggcgacgccaggctccgggagagcaaagcaccgtgtcagggccatgatccggggtggcctttcactgggatcgtggggacctggaggccgccttataggacacccatgacgcccacctctggatttcaggtgcacgtgactggacttaacttcaaaccccagggtggaggcaggtagtgggagtgccctgggaaggtgtcctcggaccttggtcactgctcctgaacccatctgtgaggctggtttgtcctcatcccaagctaagtggaagctcaggtcccaagccaccgatgggtgctacttgtcagctgcaggttgaatctccgtggcctttatgaagcacctgctgtctacccttcctgccttgtagagcactcctcccagggctcaacagtggggccggggtggtcggtgtgttggctccacaggcgcctgccctgggaggaaggtggggtgtggagggaaacgcttggcccctgtaggtctccaccagcctctcccctgagggtgggggctccgggagccttcctcgagggagtcctatattgagtgggtgggggagcctgcaaggtgcccctgacaggtcacatcagaaagagctcaagggacagtcggagccagaggtgacactggtggccactcgggtggctcacaaggcccagctcctccttgctcctgggcaaattactctgaaggcagggaccaggtctgcaccattgcggctctccagttccaggcaatggccaggtcctgtgtcagggctggggtcctagggaagccatgtccccacccccggcctgcagctgggtttacattcatcccccgagagcacatgggtgtagcaggaggcctgtgcagagagctccgaccatcgcacagggcacctttggttgtttcacggagcaggcaagggagccatcggatcctgttaggtttgagcaaggatgtggggaagaagctggagagccactttgccatgcagggagaggagcacatgggtctagggatctactttagtgtttggaaggttttttaagatgaaagagggatgtgtaggctgataggtctggcagagccaaaaggcagcgacatgtctactgggagagatggagctgagcgcggggctcaggcagggtggcagggcagggccggggccctgggtgggtcaggtgggttcacagccaagtgtgtagagagggcttgggcccagagtgaagcagttgcaagctctcccacaacccattctctctgtctcggcatctgtggcatcccgtgatgggtgggtctgtacacaccccacccctggctgtgccacaatgggggtgtctgtacacccctcacccctggctgtgccacgatgggggggtctgtacaccccccatccctggctgtgccacgatggggggttctgtacatcccccagtgatgggtgggtctatacatcgtggttatgccacgagctccaaggctgtatcagtccgttttcacactgctaacaaagacatacccgagactgggtaatttataaagaaaaagaggtttaatagactcacagttctacgtagctgggaggcctcaccatcacggcggaaggcgaaaggcccgtcttccatggcagcaggcaagagagaatgagactcaagtgaaaggggaaacccctataaaaccatcagatctgctgagacttgttcaccaccatgggaacagtataggggaaactgccccatgattcaatcacctcccaccgggtccctcccacaacacgtgggaattatgggagctacaattcaagatgagatttgggtggggacacagccaaaccatatcaaaggcatcgtctggccactctaggcccttgttcccaactctcaaactccactgacatcacctctgtgcctgcaacccctcctgggattcagtggagacctcgtcccttgttggagtatctgcgctacccagagggtgatggtaaaaactgacctttgaggaacttcagagacaaagccttccgcagtcagctctccctgcagccccttcgcagaagcctgtcctcacacgcccgccacccctacctgccctgcctcctggcccatctccctgcagccagacagtcctcatccattcttcatcctctgcccccaacccccagccttcctatctcccttcagctccgtccaaggtccctgggactcagccccatctctccccagccttgaccccaataagctcgatgtctttgcccaggagctcctgacacaccagactgcatccagcttcctgttctgcgcttggcccaccgcctcggtccacaggaaccttcatctctgctctgactgtaaggatgggctctctgagggcttccccaccccacagcaggcaggtggttctgggagtctgggattgtcatgcctgggcaccttcctgctctggctgagcccctccaggacggaaatctcccagatttctctctgcctccgtctccccaccctggcatacagtgggtcctaggaagggggccgaatggaagggaggtcgtgtcggctcctacagggcagccccaagctgctgggctgaggtgcagagccatgggtccagcctgacccgcatgccgggagctgattccatggctggaagggtcgggggttccccaggagcccagacagcacctagagttgtcacaaggagtgaaaggccctgaggggacagaggaaggaggctgggcagagtgggcacgtggacttcggaccgcgcttgtgggataacagtggctagggctgtgcagagggtggtgcactgcccatgggagtccagagaagccaggtccagtggcagtggcatgcatccggcaatccctccggctaccctgcatgcagcgtgaccctccttgaagcaccccaggaagcagtcacagcctcgctctgcccagcattgggggcctggcctctgaatctggtggggaaggctgtgttgcctgctggcacccgctctatcaccagtcccaccataaggctagtccccaaagtcagcactgcagccagggccagcgagggccagcaagggcaggcctgtgcaggggctgcagcgtggggtgtgcgtcccgcactctgggccagcctcgcagctcacagggctctgtcatcccaggaatgtctttgatcaagagtttatgcaagacgaggaaagcaagcccaggacctctaatccgttcccacagtcccctgcccgccagggccccacaagcccagcgccacaccgccaggcctgagcagacaatagcaggcggacgggtgggcgggcagctctggggccgctggccttggggcccacatccgggagcattgtcaccgccactcacgagggcacacaaggagggctggggaagagagaatgcagagccctctgctgaaggggcttcggtgggccttgagcctttcaaagacggcggtgtccattaatccttttaatttgcacctagcggcagctgagacaagcctctcaaccggcagccactttaagagctgagtggtctaacccgaggatcagctcctattccagaccctgggccctctgagcctgtcgaggcagtcctccttgcctttgtttaatcacgggaggaatcgcagctggaggttactgagcacgcactgtgtgccttgtgctcaacaccgaacacagtttctctctgagttttgcaacgaccccatgggttggtgacagggaggggacactctggtggcagccacagacacagccctgccctcccagagcctacactctcccgcacacaatcatcccatctgctaggtcagggattggcaggttttctggaaagggccacagagagaggcttcaggctttgtgggccacaggttctcttgccctgtgcaaaagcagctgcagccgctctgtgaatgagtgagcatggctgtgtgccaataaagctttatttacaaaaataggcagcagactggattcaggctgagggtggtagtttgccgacccctgttgtagatgagtaaaccgaggcccagagaggtaaagtaactgagccaggactgcacagctagtgtgtgaccaagccagcctggtgggtcagcctcatggagaagaaaaggctcaagcttcaaaaagggaaatgcacggaggcttcattgggccatttgcagccaggccccacgcacacagctcagggccctgcttcgccagctccacctgtttcgaggctcccagtaggttgcccctgcgggcggcactgtgtcttggctgctggcctggagaagggcagccaaacaggccggcagtggacatctgagggtgaccagctgtttaaaaagaaaactcaccggcatgtataggcacacattaagcacacacgttttggagtaaaaggccctggggttggatctcggatctgcagctttccagctgtgcggcctcatttctctgggcctcaatgttcacacctataacatggggaaatcctgcaagaacacagcccatgatggggagtcgtctccatctcctactcacgacaacgaccagcacagaacgggggctccataaatctctgtcaataactgaattctttctggggtgctgaggattctatggctcaatgtgtgtgaagcactgctgagcaccgagcttggggtgcagtgatcactcagggaacgccatcatcccctcggcgcatccgcataatcaccatcagcattccatgcactgcccaggtctggaagcacaggcctccatgccacggcggccgcctgggtggtggcaccaaagccgatcttacttccctcctttggcacattaagtagacagttctgggtcttcttgacaccacggatgccccctcctggtgttgacagcacccagactttgctccagggaaccaccattcccagatctgtggtttgagtgggaccgaacccatccccagctccaggccaggtcttcataggctgaaacccaactgcacatccacacccaccagaagagcagcaagttaatggatgggtgagaaatcaaatagagccattgagtcttgaggagacattttctggagcttctgaaaaagataatgcttcccccttccttaggattcccagcagggaaacacaagcccaggggtggcactgcccccctgcagccctaagggaagactgagctgctcccaggacctcacaggggaggctgagcgtaaggccagccctgagggaaagcagggaatgggtctccagacaaactgctggatcaagcctctcctgaagtcatcccccttttgttccagaagccaatcattgtccttcattaagtcagtttgatatgggcactgtgtcatttggttttcaaagacacttaactattacagcttgtgtgtgttttcttttttttttttgagacggagtctcactctcgcccaggctggagtgcagtggcctgctctcggctcactgcaagctctgcctcccggattcacgccattctcctgcctcagcctctcgagtagctgggactacaggcgcccgctaccacgcccagctaattatttgtattttagtagagaccgggtttcaccgtgttagccaggatggtctcgatctcctgacctcgtgatccacccgcctcggcgtcccaaagtgctaggattacaggcgtgagccaccgcacccggccgcttgtgtgtgttttctacctcttctagatctaacatgttatgattgatataaacaacaggagcgactgacaaagttaccatgtgatcttggaatttcaacatgcctgtcttgcttagctgggagttccacagggtcagggaatgactcctcttggggccaccagtgcccagaagtatgcctagaactgctctgtctgaagggacaggtccctcttccatggcacacactctgtgtgtaacagagcacacgtgtgaccaaactgacctggagaaagggcctgaccacatccatatcccaagttctgaggccggatagtgcctgcaggggctgagaccaggggagaggctcaagccagccttctctggtggaccctgactcagtcctctgtgcagggcagctgcgcctcccagaaggcagaggcctcttggagagtgagccttgcggtcacagcgcctttcgggggctcccgccacttgccctcagtggcggctgagacctgggggagtccaggcaaatccctgaggaggccccacatgcaaggccagaagtgtctggatggtgtggccggcacccttaccctccagaccagcaaacgaagcccaggcagggagaggggccttgtagttttctgtggctgctgtaatgaattttcacacactcagcagcttaaaacaaccaacatttctctcatagttccagaggccagcagtgtctgcagtgcccgctctctcccagcttctggtggtttcgggcgaccttcggctcttctcagctggtccatgtgca

SEQ ID NO: 981 - DNA, 1325 bp, Homo sapiens
gcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacggctccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgcctcttgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccagactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgaggggcccaggcaggcgggcgccaccgccacccgcagcgagggcggagccggccccaggtgctccacatgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaaaaaaaaaaaaaaaaaaaaaaaaaaaaaaaaaaaaaaaaaaaaaaaaaaaaaaaaaaaaa

SEQ ID NO: 982 - DNA, 888 bp, Homo sapiens
atggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacggctccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgcctcttgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccagactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctga

SEQ ID NO: 983 - DNA, 26042 bp, Mus musculus
  misc_feature (1)..(71): "n" at positions 1 thru 71 can be any base
  misc_feature (6720)..(6747): "n" at positions 6720 thru 6747 can be any base
  misc_feature (9707)..(10000): "n" at positions 9707 thru 10000 can be any base
nnnnnnnnnnnnnnnnnnnnnnnnnnnnnnnnnnnnnnnnnnnnnnnnnnnnnnnnnnnnnnnnnnnnnnntgcttctgcctcccgagggctgggataaaggcgtatactaccacatacatcccaaaatacatataaaaattaatagagctagttgagaagtctctcctctcgtgatagtctctgatttggggatgacacctttcttgaatatttgtatcaacctatttgctgcagtgtaggtgaaggctagcccagtgtgtagatgaagtctagcccagtgtgtaaatgaaggctagcctggtgtgtaggtgaaggctagccctgtgtgtaggtgatagaattgaacttttacttgaagagtgaaagtgatttaaacaatgaggaagcggtaatgctttactcctcacagaaagtccagaggtagcctcaggactggttcagtagcttagcagtgtcactcaggcgagggattcattcagataatccactaggcccctttcttcattgcagagatggcagaggtggccccagcatcatagtagagtggttacgggcatagctttgtggtagcatttttctgtgatccctttggttgggaagctgaggcaagaacattgccagcctaggctacatggtgagaatctggtcaggcagggcacacagcagagtcctgtctgagaagggtcaaaacaaaacaaaagcgcagggcatataaaacagaccttgtttgctagagcgtttgcctagttgcccaccctgtaggaagccctgggttccctccctagcagctcacgagctgagcatagtgctacacactatagtgttccaccattcctgcactggggaggtagaggcaagaagatcaggagttccaggcccaatcaagtttaagtctagcctgaggtccatgattccctgcctctaagagagatttgaggttatcctcaactgtacatcacatgagaggctagcttgggctacgtgagccactatctgaagaaaaaaagagctaggaagatagctcagtgagatggttcagcaagtaaaaatgcatggtggacaagcttaaaaacctctgctccggggctggagagatggctcagtgagtaagagcactgactgctcttccgaaggtcctgagttcaaatcccagcaaccacatggtggctcacaaccacccgtaatgagatctgacgccctcttccacacaataaataaatctttacaaataaacaaacaaacaaaaacccctctgcttggtcctggatcctactgtggaagatgagggacacaccaggaggttgtccacaggtgcaaacacacacatatgcacacccaatgtaattggaacatttcaaatatatctgagcatggtggtaaagtgcctttaatcccagcactcaggaggcaaaggcggggcgatctgtgtgagtttgaggctagcctggtctacatagtgagttccaggacagccagggctacacagcagtgaggccctgtctacaaataaatagacagacagataaataaataagcgataaagtataacagatcagttacacagtaaggcgtataacagatccagtagtgttacacagtaaggcctgactgatagatagaccggcatacagaatgataaaatataatggggcttgtaagatgacacagcaggtagaggtgcttgctgccaagatcttcagaacctatgtaatgaaaaaagagaactaactctctcaagttgtctgctgacttctacgtacatatgcatggcatacacacgcatgcggaaacacatacacatttaaaatgaaataaaccagttataatggggagctagctatagctcagtaggtagagtgcctgtgtaacctgtaggataccctgggttcagtccacagcattgtataaactggtcaaaagatgatcatggttgtaatcctcgaattcaggagatggagttaaagagaagttggatgccgtcttcatctacaaagtgagtaagaggctagcctgggctgcatgagaccttatctgaaatatagtaatggatattgctatctcagttttgcagtaggcacaaggttgtatattcctgccgtctcagagcctcagagacagaaacaggatggacataagtttagaccagacgtattcactgtgaattctaggccaggtagacctagcaagagttgccttagaaacatcaacaaaacagcagcagcagcttttcatgaaacagattccagtctgatgtacacacacatatcaaaccgagcggctatttgttcaattcttttttgttgttgttgttgttgttgtttgttttttgtttttttgagacagggtttctctgtgtagccctggctgacctggaacacactttgtagaccaggtaggcctcgaactcagaaatccacctgcctctgcctcccaagtgctgggattaaaggcgtgcaccaccacgcccggctctatttgttcaattcttgagcatgaggctagctctatcaggagagttctgacctagaggggcatgggacttgtcatttcagagtgtggcagcctccttctgagtaccaggtacctggattgcttagtggcttgttctatcggaagctattgtacctgcccacagcaaggtggaagtgtctaagaactgaaccgatcctgagtctgcctacagaagccttcaaccaatggcagctgagaatgtggagacaaacatcttgcctcattgtgcctcagctacaatcatgatacagacagttgtaagctgccatgtggttgtgggaatcgaacctgggtcctctggaagagtagtcagtgctcttaactgctgagccatctctcgagcccttgcccagccttttttcttaaaattgtatttttaaaatttattttctgtacacaggtgtgtgagtgtgaacatgtggatcctaggggttgaaatcaatttgccggggtttgtatggtgccttctcaccagctttagagtttcttgattactagggaaaccttcctggaagcaggatgctactcagtattttgatcactcataagacatttcattgtgaagtggaaagaaaaccttcgtatgttgttttgtcttgtttgtttaatattatattctacagaacattatatacagatgtcataaggacaataaggacatagtttattatttatttacttatttttgagaaagggtctcactaagtagccctgcctggcctggaactcactatgtagtctaggttggacttgaactcacagagagccacccacctctgcttctggaatgcagggactaaagccatgagctaccatgcctagccagattgtagttttgtttgtttttgttttgtttttcaagacagggtttctctgggtagctttggctaccctagaactcactctgtagcccaggctagccccaaactcacagaggtccatccatctctgcctcctgagtgctgggattaaaggcatgcatcatcacaccagctgagtctttttttgttaggaaaatctccaagttgtctatccttgagctttgtggtattcttttcctgagactgggtctcatgtagcccaggctggcttcaaactcagcggatagctgaagatgctcttgagcttaaaactcagcttctttattttctttatttacttacttttattttgaggcagagtttctctggtgtagccctggctgacctaggactctatttgtagcccaggctggccttgatctcacagagatctgcctgcctctgtctcctgagtgctgggctgaaaggtgtgtactgttgcaccaggctagcggcttttttttttaaaaaaaagatttattttatttatgtatatgagcacattgttgctgacacaccagaagagggcatcagatccagttatagtctgctgtgagccaccatgtggttgctgggaattgaactcatgacctctagaagagcagacagtgctcttaaccattgagccatctctcttcagcatggcctttttttcttttcctctttctttttcttttcttttcttttcttttctttttctttttctttttcttttctttttaaaggcttaataactattcttttttttcttttcttttggagacaaggtctcatttttagcttaagttggccaggaattcactccatagcctaggctgaccttgaacttggggagattctcaaattgggattccaggtctgtgctaccaggcccagcttatacaattgtgtttatttctcaatttaaaaaaaatccatttttattttatgcgctggggtattttgcctgcatgtatttatgtgtacacgcatgcctggtgcctgcggaggccagaatgagcctcagagcccctagaaataaagttacaaatagctgcacaggtgctgggaagtgaacctggggcctctgcagatagcagcaactgcttttaatcgcagaacactctttctagcctttaatttctcaattgaggtaaatgttattaaaagttataaaaatgggccataaagggtatgtgttcttggcatacaagaagcccagggttcagcctcagccactattattatgttgatagttgtaaatacccatacacgaggacaaatttggcttttacaaagccaagccataatcagttggacagtggtggcgcatgcctttaatcccagcacttgggaggcagaggcaggcagatttttgagttcgaggccagcctggtctacagagtgagttccaggaaagccacggactacacagagaaaccctgtctcaagaaaacaaaacaaacatccataatcacaactcaactacctgggcacccacccccctgcatccctgcctcccctgcccctccacacacacactgtggctctggggattgaacctagggactaaatgaattccgaataagtgctttcccagtgagctacctccagctcagagaagagtgtgtgagagagtggagagggtaattgttagtatataagtaacctttttgcttttgcttttttttttttttttttttgaggccgaatctcactattcagtagtccaggctgtccttgaacctgcagcaatcctcctgcctcaggaggatgaatgttacgattacaggtgtgggctaccacaattggtttagaaactaccacatttgcatgttccctttgccccggataccgtgcaagatactttaggccctttggtcatcaaaacatcccggtagggtacggactttgttattacccaactggatgaaaagaaaaacagacacgagagaaccagtaggtttcaaactcactccagagtggcctcattccggtgttgtgtccaccttcctatttaggggtggtatctcctcatcttaatcccctacctggtttctctctctctctctctctctctctctctctctctctctctctctctctctcacacctcacacacacacacacacacacacacacacacacacacacacacacagtgggtctgagagtaagggtgaggtgaaggccctcacctgtcactctgttccccttctgggtctcagttggagagattccaatgataaagaggtgagggagtggtaggaggaaggacgctcagagtccttcatcctctggcctttccttagggcttgtgacaattacattccagctgtcctctaatttaccatttcattgagtaactttgtaattggatgcacctggcttgaagcactttgatttattccccctggttatggggagtgtgagctgggctggctctttctttccctgtctctttgtctctctcctcctccactcccctctcctcctcctcctcctcctcctcctccttcttcttcttcttattctctctctctctctctctctctctctctctctcccaccgctcttgcttgtttgtttgttttttggtagttgtttgttttgttgttgttgttttgtttttgaggcagtctcacctagcccaggctggccctgaatggctgcccaccttgcttccaccttctaagtgttgagattcccagtgtgtgtgtgactcctccaagttttgcccagttttttatgcagtgctgggaattgaacttagagcttcttgcatcttagcctaacactaccaactgagcctcattctcagccccttttttgttgctttgttctgttcttcgaagggcagtgatggtgaagccggataagcagacctctctggagttctcccggggaggcctcctgctccctcagcaaccacccttcatgtagctggccagctccttggccctgaaggcccaggacagtggggctgttgaccagttatccaagaaaccttctaggactcaactgtctctctctctgggtgccctttctcagtaggtcaatgaggaatagatcaatatacatccttgggacagcacaagaggcaatggaatgaagtggtcaagagttggtactgactgctgctttcagatctctgtggctcagcaccgcccctgcgcctttgagttctaactcagtgtgcttaattttttgtttccttcattctgtcttccaaattcttgagcatgtttgccccggcactctgggatttcaccctgtttgttattctgaagacactctcatccttttctattcccatcggtgcatatttccatttatcggtgttagattgtgaatgtcagctcagaagnnnnnnnnnnnnnnnnnnnnnnnnnnnncctttctttatataaggatgatgacgtaatcacaggtaaagataggagctgaaccaagtggattctgggaatatggtggctgttgtcttggcaacaggtgtttggggtcctgcctatgtgatgtcacgggttttggaggtcctgataccaacagtctctctctctctctctctctctctgtctctctccccccgcctctttccgccaccaccttgccactctctctcctaataaacctcaggtggaactgtttggcctggtgcagtccttctgaagctgacattcaccaaacagttggcaacaggaggtcctgatactaacacaaaaggcaaggctttctctcctcctcagttcatctctcttcctggaagctttcttccctgtttgtttgtttgtttcccaaactctaataaaatggtcttcaagcttattaaaacaaaaagaagccatgggggttagaaaggtagctcaatggtagagcgtacctacctaatatgaccagcatcgatttctcctgatgtccacccatgcaagggcatcaactctggagctaaaccagactgcagcctgcttttaccaactccgagctatgtgacctctccgtggtcacttagccatccatggtgagtattagcacccagcccctattacacagggcaaaaataatatactttctgtaaggctgttgtgaagataaaatgatttattacctctcagatatgttcagttcttggacatggtatgtgtacatgaagacctgttactgttgttggtactcacagccagttgttgtgtccagaggatacacagctacgcgggactttatctctgcccttcaggacaggaagtttggtggtgcattcctgtaatctcaatatttgagaggaagaggcagtaggattgttgcaagctgggggctattctggtctacctagagtcagagctacatagagtcaggtctataaatgtcagagctacatagtgagaacccgtgtcataaaactaacagaatgttagtgtgggtaaggcatgcaattgggaggtaaaagcaggaagatcagatccagcctcagttatatactaaattcaaagctagcctgggtgccgtaagacccttgtctcaaaaagtgtcccctccctcattcgttaagtgtaaagcttgatgtataaacatggtggtacgaatttgtaatcccagcacttgggaaactgaggcacgaagctggagaattcgaggtcagctataaaataagacaaactgtttcaacgaggagagaaaccactggggcagtgaccttctgtgactgaagcaatcccatcatgcctccttcctgtatgaaaagccatccccatatgtggattctgaccccttgctcagcgcaagactagtgtgtagaccagtgtgtagactagtgtgtagaccagtgcatagtccagtgtgtagactagtgtgtagatggatctcactgcttatatattgtcctgtgctttcctggggctcacttgggctgagcagagagagcagtgtcttagtggtgggctttcttctttctttccctcctttcctctttcctgccttccttattacatccttttttcccttgatttttgtttttgagacatagtctcatgatattagctcctcctgacctagaactcttatttagactaggctggctttgaactcaaagaaatctgcttgcctctgtcttcaaagtgctgggattaaaggggtgctctgtcatgcctgtcttccttccttccttccttccttccttccttccttccttccttccttgttatttgagtcatctgacatgggtctggctggcctggaattctccatgggctattatcatttggtttgcttggttttgtgataaaatcttatatagcccaggctgctcctgaactcattaggaagcagacagtgaccttaatcttctgatcgtttctgggttctgcagtgctggggattgagccctgggctctgagcatgctaagcaagagctctaccacctgagatatatctgcagcccaccccctgccaccgtgtgtgtgtgtgtgtgtgtgtgtgtgtgtgtgtgtgtgtgtgtgtgtgtggagagagagagagagagagagagagagactctaggcaggccttgaattgtctgtatagtggatagtggatcctggtgttaagccaacacttccctgggtctgagattactggcttgctccaccacagccagcaccaaatggctttttatatgctgattttgaccaacactgctcacacctccgttggtgcaacgcagtgtcccattcagcagacctgagaaactgcatttcttcttttgctttttattttcgttgtgtatgtgcatgaaggtgtgtgcgcacatgctacatacagccttggtgtagaagtcagaggacagcttatgggagttgctctcttctcttccatcatgtgggtcccagggatcacactcaggttgccagacttgatgccaggatagtttaccctctgagccattgaatcggacagaaactacatgctcccagatgctgctgcagatctgcgcaattcgttaaagtagacgagattctaagtcaagtttcccgacggaccaacaatgagatctttgcagctactattgtgcctcagtatcatggtctgcaaaataaagcccaactcgaggccattcctagaagccactttagggtaggagtgacccaactatgtacaaagttatgaccacattccctagagcaatgaaatatgacgtatacacgaaggaataacttttggcgcctagttctttcctgggtggctagaatcgcgacggggcccattgatggggaagagggcacccttccagaaagttctctctaccctcttggtcagaagggacccgagggcccggaagcgtgcgggccggagcccagcggaccaatggggctgcggggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatcgcaggatggagctgctgtgttgcgagggcacccggcacgcgccccgggccgggcccgacccgcggctgcttggggaccagcgtgtcctgcagagtttactccgcctggaggagcgctacgtgccgcgagcctcctacttccagtgcgtgcaaaaggagatcaagccgcacatgcggaagatgctggcatactggatgctggaggtaaggcccgaacgggtcccctctcctcaccccacccccacccccggctctgggacaaattgaactttccctgtcggatctttgcgatcccgaccacaatctgcaagatgctttggcggcccagactactggggcctggccttttcacacaggcgccctaagcagctgcctgcgttctgtccctttcctttccccaatcctgatcggcttcttctgtgatttccagtcacttggcactgtaactaaacttcactttgggtcgggaaagcgggctaagggccactctttccccagtggctttcctcggtgtctcctgcttccttcttcacccggtgctctctggagggcgcgtttggaaaaccctggcctcggccgccttagccccagaactggttcctgtgtctatcgcggggttctggcgggggaaactggtgggtgggggtggcgcaggctcggttccggtccacagggaaatgaaaagtgcgggagaccgcggcaggagttccctcccttccccctgggagtgtgtgtgcagtgggtggcggtaatgagggtaaggtcccaattctctctaggtgacccttccgtcccccttccgctcgccgtgggggaggggagtctggaatccttcgtgagcatgggcttctcttttacaccccctactccggggtggggaagagaccatgcagaggaagtgggggggtcaccttggggagggcacatcctcctcggttattgatacttgtcgctctaagtttatcccttctcggtttattttttgcttcgcattccactctccctccaccccccacccccacttctccacgctgccgtgtttcacttggtccttccctagcaatgactcgtgcgccctccctcaggtgtgtgaggagcagcgctgcgaggaggatgtcttccctctggctatgaactacctggatcgctacctgtcctgcgtccccacccgaaaggcgcaattgcagcttctaggtaccgtctgcctgttgctggcctccaagctgcgcgaaaccacgcccctgactattgagaagctttgcatctatacggaccaggctgtggctccatggcagttgcgggtgcgtgcggaaatcctcccccccccccgcccctccaccaaacatacgatcgccctatgtactagtaaaagaaaagccaagctcactccctcacccaccaaccctcccttcgcccctggctggtattttgggacaaaggccttgtagtgtggtcgtggtgcttcggttgcaagcttaaaactaaatgaatccctttcctctggccgcagtggggttccactcctaactcgccccccccccccaatagcaacaagtccaattgcgggtctatacaccagtactttgcctctgggtttacacagccaccgtgagttatttattggcagcagcagggcatgtctgcacacccccaccggagtggaatgtgcttcacgtgggggagggggctgccttgcatgagcctttatccccgtgtggactttgtgatggaaaagcctcccggagctgattaaagccaggccctgctcgctggaaggaagcgctgaggtgttttcatccctttccctcctatccccgaagacaccgctcttttctaaaccctccctttcttgtcttccttctgaaaaactcgagcagctgctctgggcccgtggaagagtttctccctttgctgctcagccaaaggccagagccgagacagacagggagctgagctgcagctgcttccgatgtgataatgatgccggtcccctggccctcccactcagaccaagggctttcataaccctgtggggagctgctgtcactcctgtggtttgggaagtggctccttggggcctcttgctgggaacttgggctgggctcctccaggcggggcaaaaaaaaaaaaaaaaaaaaaaaaaaaaatcggttgggttctgccctgccccggaggagtctagggaggaggtggatctgcttggatctggaagggagcttgaacgtcatctcccacagggtctgggggagagggtgggtgagctggcacctccctccaccttgttctgtggctggccaagccttctctgaccctgagaggagtctctgggccccatctcctagggaggagggcagcaggcagactcctgtgattggctggctgggaagctagggtactggggcccctgactgctgtgagtcggggaactggattcctcttcctgtcaagcagctctcacggatgggaggcctgagttgggaatccgggaggccccacagctctttgtgatgaatctagtttccagagccagggagcacgatgtttttgagggattgaggctgggaggtaggagacttactctttgtgaagagattaagggtggtctacatggctgtgtgtgaggggagtttttcagaataggcaaagccctccttctcctgctcgaggccctgagctgagagtggcctgcggtcagagttgtgagggactccaagaactccagcagtctaaatccacacagcagagcagaggccccagaaaggaggggaaaatccgaccagagcgccttgaaggcagggatgggttgctgctgccagctcctctgatcttggggtagggctggggtttttcatgtcatctggatacaggggagcgtgcccacctagtgaggactcccacactcctggttgccattggggtgcccctttagaggctggatgctatttggttattaggatagagcccagggtgcaagcttcaagcttccttgccttacttctggctctagtccaggctgtttctgtggggttctgtaagaagcctggggctgacacctaggtcatgggacaaagaagagggacagctgtcactgggggggtcctggaagatactgggtggggctgacatttctacctcagtgaggagtcaaacccatgagttccttcctgagataaaacaatgaagaaatcctcctgtgtgcaactcggaagtgcagctcgggccagggctaggaacttcatatgagtagactgaggttggggctcctagcctcctcctaagacctctgaatggttatgtaggcttggacaggtttctcaggggtcatctggattcatcctgtttggcttggatgcccttgtctggagacaggacccacccgtgatgtcccacaaaggggggtgtgggttgggttgggcaacctcctctttgaggaaccttaggagtggcttcatgctcattttgtttaagagacctggatgcgatgttggggaagaagagatttccgaagcctgtggaatttagagttggtctgtttcaactcacgcccgcctcagactcatgggaggattaagagggattaattcaggtcgttctagcacctagtaaccatcaatagatgcttaagtgtacggccctagttcttccctgccccaaacccgtcatcccgcggcagcagcccctgaagccagaggcagaactgtgacccttctgtcaaattctcggccccctcggccgactgctgactccatgttccttccctaacccccaggagtgggaggtgctggtcctggggaagctcaagtgggacctggctgccgtgattgcgcacgacttcctggccttgattctgcaccgcctgtctctgcccagtgaccggcaggctttggtcaaaaagcatgcccagacctttttggccctctgtgctacaggtaagagccaacctgggggaaattgtggggttttttgggaaggatacgtagtaacagccaggagatggtttcagtactcagacctgtgtacagtgatctgggaatactgaataaaagttacttgcctaaggtcttcatagcagggttttggatattttgttgttcctggtgccaggtacaccttgggtagatggaaagtttgttgtttgctcatatctcagaggaggtcgggctgtggtctggtgggtcagtgatagggtgcattcctcagtcagattgccaacactgtgagcacacaccaaccaaaccccctcctccctaggatctaccttgtccccttggctcagtgtcaccccattcaccactgggggttcccaggatgcagcctggtgtgttgtaagatggctccctttcttttcccagattacacctttgcgatgtatcctccatccatgatcgccacaggcagcattggggcagccgtgctaggcctaggcgcctgctctatgtctgcggatgagctcacagagttgctggccgggatcacaggcactgaagtggtaagtctcagcccctcgccccccttcacaaaattaaaaaaaaaaaaaaaaaagctgttcctctgaatctccagcagagggcaccatccacccgggcccccaactatgattgtacgcccttgcctgcttctctggccttttatctctggctccagtctggagaggagtgggtggggtgaaggacacttggcatgtagatacccttctcttgacatctcttgacaagtgctgtgtctcggacaggggtgggggacttggtgtcagatggagggttgctctcacacccttgccacatcctcttgccagtttctgagaactaaagacctgattcctgggctgggctgtggcctaacctccccagacttcccagtgcacagggggtggcctttccacctgcttgctgtcagtgctgtgagggagagagagaggcccaaggatgaatgaccttgtttttttttttttttctaggactgcctgcgagcctgccaggaacagatcgaagctgccctcagggagagcctcagggaagctgctcagacagcccccagcccagtgcccaaagccccccggggctctagcagccaggggcccagtcagaccagcactcccacagatgtcacagccattcacctgtagcttgagacaggccctctcaggccaccaagcagaggaggggcccctgccaccccctccctgcctctagaacaatccatgctatatctgaagcccgaggggggctctccttccccctcacaaagcccaaggggccaggtcctgcctatccccacagtgtgcactaaggggttgcatggtcatgaggggcgtcttcatggccagtcagctcctcttccttcccactcaaccagcttggctgtcctgggccatgatggtcagagaaatacaaacaggtaaaatccacacaccagcatttcttttgagtccctcttctgtccggggctccaaccttctcagttgccaaaacgccccagtaccttccaaaggtgttggcccttgcaggctccttcgggcatcccgatagaagcttatgaggagctgccctagatggcctctgtgtaatccgtactccagctgctcttagagggaacagcctaggctttggccagagcaagaacccatacactgttgctttgcttgctgcttagcttctgtgattgtggggtcttaagggtgccgtggtcattttaatttattgctttgaatacaactgtaagagggtacagtgaggcctgtaccccacaagtggtggtaaccctggcggttgctctttccctcccttcttcccctctgctactgctttgtggcccaggagctgctacagcctgggatgggggtcacgccttcctctcctcacccctccacctcatcttcatcagagcagggttaggttgggatggatcgatgccgtggaggtgacagagctatctggagagagggcaagccctagggtcacaggtctttcctcgggccacaaggtttgggctggtggcccatttctatcatgctgccttaataaagatttcggaataaaggtggctcttgtgatccctggggttgtgggagctggggggcaccaggcagctgtcttaggcagagcacttttcctgggaagggttagaaaggtgccgcctaggcagcatggcctgctttccttgtggacgaattacagcgctaaggagcagccagcattacccagagggctcatcgggagacagggctggacccttacacagaaccctaagattcatacgacatcaggcatggtgcttccttagcacactcagggcagacagaggaagagggctagcctgtgctacatagtgcagaactttggctcagcgacagcactggctactcctgagagcctggactcaattcccagcagttaaccattttaaactccagtctcagggatctgatgctgaggcacaaagctcagaatgtattaaaaaaacaaaaccggatgaatggggttagggtgtggctggaagcacttcccctagcagggaggcaggcccttcctcagtggtgctgcaaaggagcagccctgcatgggagaggagaggagaggaagagggagggaggaagggagggagagcttgagtgagctcagggagtaatttggttgggttgggctaggtttgttctctttgcttttccctaatgtttacaagatgatctactgtgtaagcaaatatgaactcaacagaccaaaccttctcagatatacaaactggattgttatagacacacgttttcaaaagtgaacgtgatacagcaaggtgacttcaagtcagtcagctgtgatgcaatggtctaagggtttttgttgttgtttttggtgaggtagtgtttcacagcagtggctggcctcaaacttacagatccatggttggctgctactaaaatttcatacagattttctcaggccattaaaataatacaaagattgtaagcctagccctcaaaaagttgaaccatcaggcaggtgggtggccaagttcaaggtcagcctggtctacagagtgagttccaggacaggcagggatacacagggaaaccctgtcttaaaaaaccaaaaccaaaaccaaaaccaaaccagacagtattctttgctcattagttatgcagacacaggaacctgacctggcgtctcagccagcctaaagctctggttgcttgatagctaggaagaaatcccattttttcctgattctgttgtgtcactgtcccctagcaagggcctgcaatatagtcttccctgacagtgaaccactgccacttttccaacagacacctttccaacatggcagcagaatctggcatccctagagtcggccctgactgtacgtcatggtaggagtcaggggcgcgtgtgcatacatttcctgtgaagaacaaaggaagcaagagtctagagacacaactttgaagaataaggtggggtgaggtttctgtgggaagtaagaacccgctcttctgagctggggacagggaggagccagcagtgactcccacctctcccgtgggtgacaggggagagaggcagggacctccagggaccaaaacacaagagctgcgataaataaatgcctgttttctccgcaccccagcgagcttacacagtatctggagagagcagaccttataccaactgccaggtgggttgtggggtcgctgaaccgaactgaggtaactccggttagcttccagaagtgagcagggaccaaagcctaaaatggcagagaaagccaaccagatgcagtcctccctgcccaggattaggccacggcagccatagtagcccttcagtgtcttgacctaggtctttaactataccagctggggtcctggggtggtcctgcgccccctgggccaacacaggtgactgttctcattccatggtgacaccaccatcctccacgtctctggggacagcgctctgaagctcacgcctgatctcaggggacagctgcgggtggggctgcagccgaagcagctccaggagggcctccttctgctctgtggccaggtcagccttatagcgctgcgctagtgtcagcaggcactggtgccagaggacaggcagctggcgcttttccgtccggaaggccagaaagtggaagaccagagcgtcgagcacgcggtagggcaatgcgtacttcttatccagcagcaggcgcaggaagatgctgttggcaccgctgtattccatttctgcgatcttcagcatggccgcactggaagggaaggtggagtcacaggaattaggccacacctatgggagtcctcttcttacactgagccttacttcagtgttcccaagggggccaccacaggctgctcacctgttgattactatgctcctgagagtttctaccatctccatccatctgccccacccacacctctgcctctggctcggagagcaagcaatccctgtgtttaactacagatcatgtccaaatgtctcacgatccgcacattttagcacactttcttcctagatgcccatttacacacgcagtcattcaattatactagctaccaggaccctggcccctgctcttgaagacctactattctgttggagtaatcatacacccactgacataaacggctagactcgaggtaatcatagctcattctccattcgcaccctcacgaccaagttccggcctctctatcacacggctcctctctgaccatcctcctccacctccccaccactacctggagtgcagcacggggatggagcacttggtgatgatgctgcccacgatgatggcttcacggagggtacaggtgccggactcacacagtgggatcaggattcctaggcagagtcagatgcagtggcttttagaccggggtgagggaaatgaggcgcagcccccagcagccccaggcatcaaggacccccaatgatctgccaagtaagagccccaccccctcctttctcccctgcttctgctctacctttgaaccaggctccaggcttgaacagggccttcttgagcgccatgtagaggtgaaagttgagtcgtttgtattcagcaatgtcatctcgcactcggggaagcaggacaaggttgtagaagcgctgagccatgcgctccttcaagttagaggcaaaaatcctagcagggtaggagtttccaagttaccagagagcctgaccctggccctttaagaatcatcgcggatggtgcattcgagaggttttatagtcagacacggggacagcgtgttttatagtcagagctgtagcatgggagtgaaagctcttcccactgaagagtaccacaggacttggtcatgaaaaacctggtgagatggctcagtgggtaggagcacccgactgctcttctgaaggtcaggagttcaaatcccagcaaccacatggtggctcacaaccatctgtaacaagatctgacgccctcttctggagtgtctgaagacagctacagtgtacttacatataaaaaataataaatctttaaaaaaaaaaaaagaaaaacgaaagagcagggggctggagagatggctcagcggttaagagcacggcctgctgttccagaggccttgagttcaatccccagcaaccacacagtggctcatagacatctataatgagatctgatgtcctcttctggcccgtaggcatatatgtagacagaatactgtatagataataaataaatcctaaaataataataataataataataaaataaaaaccaatagactatagtttcccctctaaaaaactaaaagccaaaaacccataagactgaaagtgactgagttcaaggccagcctggtctacagagtgagttccaggacagccagggctacacagagaaaccctgtctcaaaaaaaaacaacaataacaacaacaacaaaaaaaaaagactgaaagtgagaatatggaaaatgacatacaagaaaatggaatctaaagtcaaacttgaatatgcagtcacacctgaaaataggtttaaaatccccagaaagaacaaagttaagggagcagcaggagcgagtccaagggaggcccatgggcaactgaacagctctggcaggcaaagcccgcaccccccacagcccacaacctggcccatcaatgatacctggtggcttgatacatggcggctgcagtccaggcctcaggctcagtgacatagaggatctgctcccagttggacagtgcagggatgaccttaaaagccttgggcagtttcccactgcggtacttacataacacctggggtgagagaagcaaaatcgccaactgtgctggggtcctggccctgttgctcactcatctccagaaccatctagaaagcctcgttctccgggtgaccggagtttagtagacttccagggtcaataagagacagtgcaagaacctgagcctatcagctctcccccaatcctgttctgatcgccatggcttatttggtgggggccatggatgagagcccaccccgagtcaggatatcccagcacacacaccacttagctcttacctcccggactcctcggtaaacttccaggacccggggatccagctgaggcatagggaagcccgatacctctgacatgacagtctccacctctgtctgcttctccgtcaacttctccatgatgatatcagccagggtgcgcctatggagacacgggaaaaagagaggtggaaagaattggggtcactttccatgaaactgtaacgtcccctcaacctgttttttatctttgttgttgttatttgacacaggggttttatgtctagctttgcctgtcttagaactggctctgtagacaaggctgacctcagactcagagatccacttgtttctgcctcctttgtgctgggattaatggtatgcctggctctgtttattaaaaaagaaaggcagtagtggtggtgtaagcctttaatcccaacacttgggaggcaggcagatctttgtgagttgaaaggtcagcatggtcttcatagggagatctaggccagacagcaagccccgtctcagaggggaaaaagaaagtcacaaaacatccccaaacaaaacaagaatgcttcacaaacttgcatgtcctccttgcatgggggccacgtccctgtcactgttctaattttagtgtacgggaagctggaagcgagcaatgtataattcccctggacgctgacaaatctcgatcccgctgggatgcacagcctcagttcccctctatgtccatttagccgcctcaaagtgctgcagagcacgggccctggatgtctctgcatctgacgcagagccagagtggtggggacgttaggcccttaggccctgaagtcagctccggctcttctggtccttgtatgatcctgggcccgtcacttgactcctctaagcctcagtttcctcatctgtaaactggggaagtaaaaggacccccctggacagtcagctgaagggtaaaatctaagactgcagcaggcccgactctcagccagagccagcaggtcctgagggctgtttacttcaagctcacctcccactgctcacacaacggggagcaacttctgagtgcagagtggagctctgtgccaggcagcgctggtgcacacctttcatcccagcgctcagaaggcagcggcaggcagagttttgtgagttcaaggccagcctatcctactcacccagcacttgcctagcaaggatgagacctgggttctggcttccagcacaaggggaaaaagtttctctgcagtctttttctgtgccgagcagcactgaatctgacactttccagacttgtgtcctgtggtctgcatgacactggtggcaggtgcttttattcccccgcactgcccaggccggggaatcgagactcagggccaaccaacaactctcctaagccctaagactttctcagggaaagggtaaattttagtctttcgacttctagtttgggtgcttcgcagcgtcttcaatgtgccttaagtgacaaggcctgattgctgtgttcccaaagacccttagcctggtttctgaagatgccagcagccactgctcaagagtgcccacggtccccctttccaccatgttgtcacttccgtatagcaactgcagaaaacattctgctaagtttgtcagatcaagagccactgggtatgaggtgctgcccgagagcctttggggggcacatcacaccccatgaccattctcagagctgtcagacaccttcaggggacagggttctcctgtgttctctgaacccaagctgctcatcaccgtactattaatgatagtggtgtactacaccccactctgaagaataaactggttgagcccctttgccctaagcccagtcctctcaatgaggccagatccatctgaatggaaccaagaatctgaccacaggcagcctaaataactgcatgtttagaagtagcatttataacacatgggggtacgtttgtggttctacccagaggtagttttaacccctctgggaacattttgtcagagatagctgctattggccccaacactgtaactgagatggaaaaccctgagttaaagactaagctatgggctggcgagatggctcagcaggtaagagcactgactgctcttccgaagatgctgggttcaaatcccagcagccacatggtggctcacacccacccgtaatgagatttggtgccctcttctggtgcgtctgaagccagctacagtgtacttatgtatagtaaataaatctttgggccagagcgagtggggttggccagaatgagtagaagtcctaaaattcaattcccaacaaccatatgatggctcataaccatttgtacagctacagtgtactcacatacataaataaattaatcttaaaaaaaaataagactaagctatgagagtaacgtaccaagaataaacactactaaacggatccccagctatcacaaggaaccggtaatccagaggttccagatcagatgggcaaaggggaatccgggtcactcccgttcaggggccactcttggcaatggtcagaccaacagctgtggtctggatgaactttctaccaggacccactggtccaacctttaagccttacctcacgggaggattcttgttcatgaacatttcaatggcacgctcatcttcagggtccacgatcacctctgcctggtggtccaccccggccattttggctgccttctccagggtaggccactcctcatcctcctcatctgatccatcctgtggcaatcccggccctacaagataatcccagccgcaggggcttgtgagtcagttccccattccacgtacagcacacccagggagcaggagggacacctgcagagggactatccttttgtccccagagacttggaatcttgatagaaaatacagcacacgaagcgagagatgataaggccagtaaagactggatgacatgtcccctcagtgaatggatgacatgtcccccctcaatgaccaagaaggatccattctatactacacacatgtaacctggtctgtccagatgacctcaaggaataggtactgttgctatacccagttcaaaccggggcagaagagttgatgtgcccacagtaggtaggcactgtgggtcctgacttcccactatgttgcttgcacagtggaactgcatcatgtgctgaaactaaaaccatggtggaggcagtgtgcacctcaggcacttggatgagtacagaggctgaggaggctctggatgggcagtctgggagcaagagcatgctccacgtcctggaaagtaatgctgttagagtgttgggcactaaggagccagaaaggaaacggaaagccaacctggaaggctctaaggctgggcagtggcattcggactctgatcaaccaacacatttaagttactggcttaggtagtcgaggatgacttgggagttccttgttctcgcgcctccactttccaaacacgcaccacagtgctgaaggctgagcttctgatgttgggttaatcccgtgtgttccatgtaaaggctgcctgtgtactattcacatgttaatctttgttccagcagagagctgagtacagtcggcattggtttttttttttaatgaagcatcacctgtctcagtgttgtggaaacttcttctccatcaccttctgattggtttaatcaaaagctgagtggcccatagcagggctggaaaggataggcgggacttctgggcagagataggaactctgggaaagaaatcagatgtgaggggactcaacagccagacacagaggaagaaacacgtgctgttactgaagagcagtaacgagccccgtggttgaatgtagactagtataaagcaattatgttgtatcagcgagttcggaacaaggcagctaaggccaagctttcataactaataagaggtctctgtgtcctcacttgggtgataggtgggttgagccattcctgccacatcctgaggtcctgaccatggagtcttggctgggtacttcctgagtgctgggattaaagtcatgtgccaatacaccgggctgacttttgaaataccgcacatagctggcaaggcagttgggaaagagtctaataaaccaaagtagttgaattattaccatagcaacagatcagttgctatggaagtggactaagggtatattatatagagctccagagagtacacagagcatacccagtgagagccaaggttgtttgttttaggtttattttacttttaatgtttgagtgctgactgcacgtatgtctgtgcacaagtgtgcctggtgtctaatgacatcagaagatggcatttgatcccttgcaaatggagttacagacagctatagcctgccatatgaatgccagaaaccaaacttgggttttctgcaagaacaagtgttctgaagagctgaggaccaactcttgagagttttcctctgttctctacacacatcatgccacgcacatgcacacaaaatacatgttaaacaaaggaagacaagagctatgaaatacgacgtagggaaaagagagaaaatcaggagacagtcactgacatttgtgtggtgttttgttgttgtgatcatttgctttttgtatatgagtgaaccctgcatcatggaagtgactcttgggagctgatgaccttgtttttgaaacaggatttgactgggacctggggatagctgattaggctagactggttgcccagtaggcccaagagatctgtcttctacactgtagctcagaaactacaagctgctgtgagtggaagtcagggctcatgctctctcaaagcatggacctcaccagctgtgagcattatcttatcctgtccctagcttgtggtcagacctgaaacagagacagaccagacaggacgccatcaatctctagctgctgaatggaccacagaggtcacagaattcaaagcacgatgtttccacagtgatccaggggagagaccctggtagcttaatcagggagtgtctcaggtgaatggaaagtggtctggctctgaaatactctaaagacaacatcaccaggatttactttgaagtgagaaagaggaagcctggactctgactggagcagtggagctaatgtgctaacaacctccaagtagcaaacagagagcaagtttgggaaggaagtcacaacttctgttttagatgcaatcttcttcttttatttttttttttccttctccgagacagggcttctctaggtagccttggctgtcctggaactcactttgtagaccaggctgtccttgaactcagaaatccacctgcctctgccttgtaagtgctgggattaaaggcgtgcgccaccactgccctgcttggacgcaatcttactagagttagatactagtattcaacttggagatgtcaggtagaccactggatataaagatgtgagctttcttggacgaactctgagggagaaaaaactggaagtagctgtcaaacaaatggcctcaaagtgaaattccctgac

SEQ ID NO: 984 - DNA, 1899 bp, Mus musculus
agcgccagcgccagacccgcccgcaccccgcgctctccctcacgcgcgtcgcttctcctaggactcgctaacccgcactcttgctctcacccgtgagccatcgcaggatggagctgctgtgttgcgagggcacccggcacgcgccccgggccgggcccgacccgcggctgcttggggaccagcgtgtcctgcagagtttactccgcctggaggagcgctacgtgccgcgagcctcctacttccagtgcgtgcaaaaggagatcaagccgcacatgcggaagatgctggcatactggatgctggaggtgtgtgaggagcagcgctgcgaggaggatgtcttccctctggctatgaactacctggatcgctacctgtcctgcgtccccacccgaaaggcgcaattgcagcttctaggtaccgtctgcctgttgctggcctccaagctgcgcgaaaccacgcccctgactattgagaagctttgcatctatacggaccaggctgtggctccatggcagttgcgggagtgggaggtgctggtcctggggaagctcaagtgggacctggctgccgtgattgcgcacgacttcctggccttgattctgcaccgcctgtctctgcccagtgaccggcaggctttggtcaaaaagcatgcccagacctttttggccctctgtgctacagattacacctttgcgatgtatcctccatccatgatcgccacaggcagcattggggcagccgtgctaggcctaggcgcctgctctatgtctgcggatgagctcacagagttgctggccgggatcacaggcactgaagtggactgcctgcgagcctgccaggaacagatcgaagctgccctcagggagagcctcagggaagctgctcagacagcccccagcccagtgcccaaagccccccggggctctagcagccaggggcccagtcagaccagcactcccacagatgtcacagccattcacctgtagcttgagacaggccctctcaggccaccaagcagaggaggggcccctgccaccccctccctgcctctagaacaatccatgctatatctgaagcccgaggggggctctccttccccctcacaaagcccaaggggccaggtcctgcctatccccacagtgtgcactaaggggttgcatggtcatgaggggcgtcttcatggccagtcagctcctcttccttcccactcaaccagcttggctgtcctgggccatgatggtcagagaaatacaaacaggtaaaatccacacaccagcatttcttttgagtccctcttctgtccggggctccaaccttctcagttgccaaaacgccccagtaccttccaaaggtgttggcccttgcaggctccttcgggcatcccgatagaagcttatgaggagctgccctagatggcctctgtgtaatccgtactccagctgctcttagagggaacagcctaggctttggccagagcaagaacccatacactgttgctttgcttgctgcttagcttctgtgattgtggggtcttaagggtgccgtggtcattttaatttattgctttgaatacaactgtaagagggtacagtgaggcctgtaccccacaagtggtggtaaccctggcggttgctctttccctcccttcttcccctctgctactgctttgtggcccaggagctgctacagcctgggatgggggtcacgccttcctctcctcacccctccacctcatcttcatcagagcagggttaggttgggatggatcgatgccgtggaggtgacagagctatctggagagagggcaagccctagggtcacaggtctttcctcgggccacaaggtttgggctggtggcccatttctatcatgctgccttaataaagatttcggaataaa

SEQ ID NO: 985 - DNA, 879 bp, Mus musculus
atggagctgctgtgttgcgagggcacccggcacgcgccccgggccgggcccgacccgcggctgcttggggaccagcgtgtcctgcagagtttactccgcctggaggagcgctacgtgccgcgagcctcctacttccagtgcgtgcaaaaggagatcaagccgcacatgcggaagatgctggcatactggatgctggaggtgtgtgaggagcagcgctgcgaggaggatgtcttccctctggctatgaactacctggatcgctacctgtcctgcgtccccacccgaaaggcgcaattgcagcttctaggtaccgtctgcctgttgctggcctccaagctgcgcgaaaccacgcccctgactattgagaagctttgcatctatacggaccaggctgtggctccatggcagttgcgggagtgggaggtgctggtcctggggaagctcaagtgggacctggctgccgtgattgcgcacgacttcctggccttgattctgcaccgcctgtctctgcccagtgaccggcaggctttggtcaaaaagcatgcccagacctttttggccctctgtgctacagattacacctttgcgatgtatcctccatccatgatcgccacaggcagcattggggcagccgtgctaggcctaggcgcctgctctatgtctgcggatgagctcacagagttgctggccgggatcacaggcactgaagtggactgcctgcgagcctgccaggaacagatcgaagctgccctcagggagagcctcagggaagctgctcagacagcccccagcccagtgcccaaagccccccggggctctagcagccaggggcccagtcagaccagcactcccacagatgtcacagccattcacctgtag

SEQ ID NO: 986 - DNA, 26874 bp, Homo sapiens
  misc_feature (25082)..(25101): "n" at positions 25082 thru 25101 can be any base
cacaccactgcactccagcctgggcgacagagcgagactctgtctcagaaaataaaaaaaataaaaaataagtgggatctattattattactacctaatagtattattactattattgctctggtgtgctatcaggggtgttgtgccacactggggacatactactcctgaccccccacctaaactttctttggatgccctcttcttcctgcttctctcttcttactcccacttaatctttttttttttttttttgtgtgtgtgtgtgtgtgtgtgtgtgtcgctcaggctggagtgcagtgacatgatctcagctcactgcaagctctgcctcccgggttcacgccattctcctgcctcagcctcccgagtagctgggactacaggcgcctgctaccatgcccggctaattttttgtatatttagtacagacggggtttcaccatattggccaggttggtctcgatctcttgacttcggatccacccaccttggcctcccaaagtgctgggattacaggcgtgagccaccgcgcctggcctactcccacttaatctctaaactcctgcaatcccatttctttcaccatggctgtttcatggaattcaggtgatcagaaccaccaatctccaccagtcccaggacagcccacccttcctgtcacacaaaccaccctgcctacttctgatgggtgttgcaaatgccgaggtaaaagtcttctgtcttcatgacatcttaggattcctgcatcatggaggatcatcatatcatgcactttagactggaagcttaaaagggtggcttctcggcccagcgcagtggctcacgcctgtaatcccagcactttgggaggccgaggcgggcggatcacgaggtcaggagatcaagaccatcctggctaacacggtgaaaccccaactctactaaaaatacaaaaaattagctgggcgtggtggggggcgcctgtagtcccagctactcgggaggctgtggcaggagaatggcgtgaacctgggaggcggagcttgccgtgagctgagatcgcgccactgcactccagcctgggtgacagagagagactccatctcaaaaaaaaaaaaagaaaaaaaaaagggagtcttctcatctctgacccatgtccagcatgtcccagggcttccgaaggcctgcctgatgtatggaaggcacatgataaggcacctgattgttaatgaccacagctatctttattgaccacctactatgagcctgggacagctaaagtacttttcccttattaatcccctcattcaccatatgaaataggagttgttaccatcctccttttgcaaatgagaaggctgggacggaaaagttaagtaaactgcccaggatcacacaatcacacagctggcaaatagcagagctgggcatcaacctaaatccagagctcacttacttaatgactaagccaaactaatgccagtgctatctcctgcctagaatgaggaatgcttgccagccaagaaccgaagacagctctctttttgcaggtatattgctgtagcaggttacccttccacacctgaggccctgtgtgcacctcagtcttacctgtggaacaggaatctcaagcagaatgacagaacaggaaagcctcatttattcagaacccagacagccagaaaaaggaagaaaaagcaaatgcttaaatatataggttgtattcttttttttttttttttaatcttgctctgttgtccaggctggagtgcagtggcgtgatcttggctcactgcaagcttcccgggttcacgccattctcctacctcagcctcccgagtagctgggactacaggcacccgccaccacacctggctatttttttttttttttgatatttttagtaaagacagggtttcatcgtgttagccaggatggtctcaacctcctgaccttgtgatccgcccgcctcagcctcccaaagtgctgggattacaggcttgagccaccacacccggccctgtaggttgtattcttattttatgaggagagacttgacagtttcaggctagtacctgaggtttcttttcccaagcagcttataagctagaaattgcaaactgctttttgtccctcagacctggtatataggcatattatgtgtggcttgcacggttttgttactgtttttcaactcaagtaatatagatattttaggaaatttcttttttttttgttttgagacggagtctcgctctgtcgccgcctcccaaagtgctgggattacaggtgtgagccactgcgcctggcggaaatttcttttcttttgagacacagtttcattctgtcccccgggctggagtgcagtggcacgatctcggctcactgcaacctctgcctcctgggttaaagcgattcttctacctcagcctcttgagtagctgggattacaggcgtgcgtcaccatgcctggctaatttttgtattttcagtagagatggggttccactatgttggccaggctggtcttgaacgcctggcctcgctggtcttgaacgactggcctcaagtgatccactcacctcagcctcccaaagtgctgcgattacaggcatgagccaccacacccagcctttttcttttcttttgtagtaatggggtcttgctgtgctgcctaggctggtcttgaacccctggcctcagtgatcctcccaacttagcctctcaaagtgcagggattgcaggcgtgagccatcatgcccgatctaagaaatattatcttggggaaacagggaatctatggccacactcattactatggtgtagcaaaagtctgaagctaagcagtactttttgagctttggatgggacatgtgctatctactgtgtctggccccaacagctcccttaaccccatgtgagttgccatttatcatgtggtgtatgctggtgtttttcttttttctttttttcttttttttttttttgagatggagtctcgttctgtagtccaggctggagtgcagtggcacgatctcagctcactgcaacctccgcttcccgggtcccggttcaagcaattctcttgccttagcctactgagtagctgggattacaggcacgcgccaccatgcccagctaatttttttgtattttttactagagacggggtttcaccatgttggccaggctggtcttgaactcctgacctagtgatctgcctgcctcggcctcccaaagtgctgggattacaggcgtgagccaccgcgcccagcctggtgtttttcttatatccagtttgttttattcattaactcaaaaaagatttattgagccagacgtggtagtgcacgcctatagtcccagctacttgggaagctgaggtgggaagaccacttgagcctgggagatagaggctgcagtgagtcgttatcatgccactgcttccagcctgggtgacagagtgagaccctgtctcaaaaaaaaaaacaaaaaaaaccaaaaaacttactgaacatctactatgaactggataccatcctgttttggtggtgtggtgtgggagtagacaagctgtaaacagaatatgcaagcaaagtatatgctatactagtgatcagtggtaagcagaaaaataaagcagggaaagagcataagaagtgtcagggctggggagctggcattaaaaatttaggtaggatggccaggaaaggctgtaagaggaatgcaacttttggacttcctgaaggaagtgagggagtgggccatgtggatatccggaggcagaacattccaggcagatggaacagcacgtgcaaagagaacatgtctgcccggtgtgttccatgaaccgtgtggccagagcagagtgagggagagtagtgggaaatggggtgggagtatagatgctgcagggtctttggcagtcactccaaatgaaatggggagcctctgagagtgatgggttgagactagactggagggccaagggtgggtcagggagacccggcaggaggctaccactgtaatccaggtaagagatgatgcaactcggaccggggggtagaagtggaaatcgagaaaagaaggggattggagatgtatttttgacgtagaatcaaccagaagtgggtcgcaggttggatgtgggggaccagtaaggtcaaggaagaactgagtttggacagaggaagtaacagaggaggaaaaaaagagtagattttggaaatattttgaaattattaatagctcctctgtgatctgctgatcagagtgtggggattgtgtgggatttgagaaagaggagtcaggaatgacaccaagtgtttggcctgagccattggaaggatggagttgccattttctgagataagcctgtaggaagagcgggttttttggggaaagattaggatatcagttttggagaagttgagtttaactggcctatcggacatccttgtggtgttgccaagaaggcagcctccagtataaaatggaaactaaaaacaggtcagttcacaccaactctgatttggtagtgctgcctaaagtgctgtgttgggattttaaatgcccatccaggctgtttcttttcttttctttttttttttttgagacggagtcttgctctgttgcccaggctggagtgcagtggcgtgatctcagctcactgcaacctctacctggtgggttcaagcgattctccttcctcagcctcctgagtagctgggattacaggcatgcgccaccatgcccagctaattttttttgtatttttagtagagatggggtttcaccatgttggttaggctggtctcgatctcctgacctcgtgatctgcccgcctcggcctcccaaagtgctgggattacaggtgtgagccactgcacccagccaatttttgtatttttagtaaagatggggttttgccatgttggccaggctggtcttgaactcctgacttcaggtgatccgcccacctcggcctcccaaagtgctgggattacaggtgtgagccaccgcgcccagccgaagagtgctcaatttttactgataggaatggacaagcaaagagttttaaagattaatgtgaaatattgtacaaatattacagatgctcataatagtgacctggaatactgtaagcaccgagatagctccttgattctcaaagaaaaaagctaaattatatgtagtttggtttactgcttttttttttttttttttttttttttttttgagacaggtctctgttgcccagggtggagtgcagtagtgcgatctgggctcactgcaatctccatctcccaggctcaaacaattctcctgcctcagcctcctgagtagctgggactacaggcgtgcgccactgcgttcggctaatttttatattttttttttggtagagatggggttttactgtgttggccaggcggtctcaaactcctggcctcaagtgatctgcctgcccctgcctcccaacgtgctaggattacaggtgtgagccaccgtgcccggccaactttgtgcttttaagtcccgcaatcacaactaactttttaaaaaagggttcaccacgtgccagccactcttctatgtattttaaacaaatcaacccatttcctcctcacaaccactctgtgggggggtactactgttatcaccatttttagaaaaggaaactgaggcacagagaggtggtttaacttagccaaattcacacagtgagggagtggagtggcagaggggtgtggctccaggccctggagggtcctctccatacgctagaccatgtgtttaccgttagaagccaggtcttcaggatttgctagagatgcaattctaggagtagggctcttgctgctcaaacttttgcttttcttagaggggttatggatgcatgttcataacagaaagggtactccttgagaaagggaataataataatcatttcagaaactactatctctgaatgcttgctttgtgccaggcacaggtaagacattttctgcttgtttaattttcagaacatcattatagggctattatattatccccactggataaaagaggaagcagagaggttccagtaattctctcaaagtcataagctgtggagccaggtttgaactgaaagcagtctctgactccagaaccctgtttagcacccctgttctcagccccatggctcgcttggctctccccagcatctcaatgggtctgaaggtaactaagccatggcatgtggactgtggggtgatgggcctcacccatcaccttgttcagcctctcacttctcagatgcggacttttttttttggagacagagtttcgctcttgttgccctggctagagtgcaatggcacgatctcggctcactgcagcctctggctccagggttcaagtgattctcctgctcagcctccggagtagctgggattacaggcatccaccaccacacctggctaattttttgtatttttagtagagacaaggttttaccatgttggccaggctggtctcgaactcctgacttcaggtgatccacccgtcttggcatcccaaagtgctgggattacaggcgtgagccaccgtgcctggcccagatgggggtattttgatgatgaagaggaagagaaagaaaatgtatctttcctccttggggtttcttatttggcctgtgacattccattcccacccctcctccaatttgccattttattgactttttctaactggatgtacctgggtagaaactcctcatactattggccctggtcattgctttgtctttagttttccttttagaaaaacaaaaacaaaaacaagaaaaacaagaggagcctctatttctttgaggtggaggtaactggtgaacttgtgctggtcctgcattgagctcacctgcctccccagtggccagtccttggccctgaaagtcagggatgatctagctctaggcatggctattccatccaggggtgaggcagaagtatctctcctaaagtcctgctcaccaggagctcccgtccccatactacaggttcacatccagctttcaggactagtcagtctatgtggccctccctcaattaataaatcagcaactaatttgccaggtgcggtggtttgtgcctgtaatcccagcactttaggaagctgaggcaggcagatcacttgaggtcaggagttcgagaccagcctggccaacatggtgaaatcccgtatctactgaaaatacaaaaattagccgggcatggtggtatgcacccgtaatcccagctactcaggaagctgaggcaggagaatcacttgaaaccaggaggcagaggttgcagtaagctgcactccagcctggtgacaagagcaaaactttgtgtcaaaaaaacaaagaaaaccaaaaaacaaagaaaaacacaaaaaacccttctatttgttaaaaaaaaaaaaatccaccgtgaaccaaaaattagtaaaaacaatgaactaaaattttgtttttgcaaaatgtatgataacaaaatgttaaggaaggtcatgtgccgttatggttcactgcagccttgaactcctgggctcaagcgatcctcctgcttcggtctccctagtagctgggactacaggcttgtgccaccgcacccagcttattttttttttttattttttgtagagataggagtcttgctttgttgtccaggctggtcttcaactcctagcttccagtgatcctcctgcctcagcctcccaaagtgctgggctgatgggacatttttatacatagtgccatgttactataaatgagaagttttaaaaatactgattttaaaaattaatttatgtcaagaatttttataaccaaagttaaaaaaccaaacaaaaaatatgaaaagggttaatatctttgagaggtgatgagaacttataagtcaataagagaaaacaaacatccctataaatgaataagctaaggacatgaatgggtaatgtacataagaaatgtaaatgtctagtaatatgccaaaatagatttattattactaataagccactttcactctctagttggcagagttgttttgaaaaatagatatgtaatgatggtggaaaagattggtttaactattcagcaggaaaatttggcaattagaagtgtatcaaaagccttagaatgtttcataaccttagattgggaaattccacttctagaaattaattcacttctagaaataatcatgagtgtgcacaaagatattaccacaaaaatattttacagtattatgtctaatagagaagaactagaaataatttaaatttccaccaatacaggtttgccaaaatacattttgtacattcacctaatggtatattatgtccctattacaaattatgtcctagaatatttaatagcatggaaaagtgttaacagtatttttttaatgaaaaaagcttacaaaacagtttgtgatgattccatttaaaatgtgtgtttattcatagaacaaagattagaaaaataaacattgatatattaaagggttatttcatggcaaattgcaaatgattatttcctttttttgtggcttatttgtatttttgaagttttctacaatgtaaaagaatattttatgatatgaaaactacaatacaatttataatataagaaagaataattcggccgggaacggtggctcacgcctgtaatcccagcacttttggaggccgagaccggcggatcacgaggtcaggggttcaagactagcctggccaacatagtgaaaccccatctctacgaaaaatacaaaaattagtcaggcatggtggtgcgtgcctgtagtcccagctactcgggaattgcttgaacccgggaggtggaggttgcagtgagcccagatcgcaccactgcactccagcttgagcaacagagtgagacttcgtctcaaaaaaaaaaaaaaaaaaaaaaagaataattaacagaaaatggttagacacttccttagtgtctcctaagtcaggaggaccccagtagggcagggatcctcatggcctcctcccatttggagcattattggaggtctttttcggcctcttcgtcaagtggaatctagcttccggtaaaactacaaagtaaccaaaagtttgggaggtggaagaaatgcaaccggtagatctcacagagtctgtgcaagaaactgattcaatgagaatctagtttctccgtccacagtttctccaaacagaaactaaggccgactttaggggcttgtccaaacctaggcaagcaacttaacaaggtgaggccatgactccatggcctttccgttctgttatatgctgacttagactaaagctctcatactttaaagtgcacagaaatctagttaaaatgcagattctgattcaggttaggggtgggcctgagagtctgcatttctaaccagctcccaggcgatgaccacgcacgggacaggtctgggatcacagtttaactagcaatggtgtagaacacagaatctgcagcaagaaggccagcttcccaatcctagctctgccacggaccaactgaatgacagttgcctcggtttccgagttttcgtgaagatgtagtgagtcattacatcgtgaggctttcgagcagcgttcactaagaactagctctgacattatttatcgcattccttagagcaagcagccggtgaagtagggtttgacgaatgaataagtgaatgaatgacctttggagaaaaattgtttcctgggtgactagagtccgagaagcaaaatgggagggcccgtgggtgggtaggaggcccacctcctagaaagttctctgcacccggtggtccagagggcctggagtgcccggaagccggccggcttgcgctcagcggcccaatggggccgcgggagggaggggagagcgctcagccaaccctttccgtccggggcgccgcagccccgcccctcggagcgttgcgacgtccgagcattccacggttgctacatcgtcgcgaggggcggggcgcctgtcagggaagcggcgcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtaccgcccggacgcgtccccctcccccaccgctcccgggtctggacacaccggggccgccctgtcgggacatcccggtccccacagcaatctgcaggatgctccgaggctaagactcccggggcctggcctttcactagggcacccacgccagctgcctcccttgctttcccgagccctaatcggctcctcccgacagtgactgccagtcacttggcaccctaactgtgcctctcttcgggccgagcaaacgggaccaaggacactctctccccttcggcttctcacagcgtctcccgcttccctccgcctcccggccttctccggagagcgcgcctggaaaaccctgggctcggccgcccccgcccgggagccggttcctgtgtctttcgcggggttctggcggggaaggcgatgggggtggcgcgcgccctgttccggccgacagggaaatgaaaagtgcaggaggcagcggcaggagcctcctcccttcccctcgggtgtgtgcagtggtggcggtgatgggggtgaggtcccagctctctggctaccatgggtgacccttgcgtcccacttcccctcgctgtgggggaggggagtctccgtttggaatcctccgtgagcaagggctccttggctttaccactcccccgtcaaggggagaggggaggaggccgcgcagaggaagtggggggcgtcaccttggggagggcgcatcctcctcctttattggtccttgtctctctaagtagcttaccctctctgccgtttttgctccctatcccacctcacttcagcgctcccacccccccgctgctgtgttccccacgctccagacccagcagtgactgtgcgccctcccccaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggtgcgtgtgtaactccccccacccccgacacgtattgtctccccactttccaggaaaaggaaagcttgagatatcagaggctttctgccccctggagaggaagcaaggggatcaggacctttgggaaaggaattggggtggaacaaacgatggggcattgtggtgtgatggttagtatcactcccgcccaggcttgagctgcaggcaggcattaaaccccctcctcctgacctccaggggatgccactccttcctggtctttcccccagatagcaacaagtcaaattgcatgtctacactcactagtactttgcctctgggtttacgcagccaccatgagttatttattggcagcagaagggcatgcctgcacacccccactggagtaggggagtggaatgtgcttcatgtgggggagggggttttgccttggttgagtctttatcctcatgtggactttgtgatagaaaagcctcccagagccaattaaagccaggccctgattgctttaaggaagggctgatgtatttcatcccaccttctttgcttcctcttatatcccggaagaaacagcttcttcctaatccttcctcgtcctcattctgaggaactggagcagctgctttgggcctggtggaaacagctccctcttccccccttagcccaaggcccaagctgagggacagacagggaggtgagctgcatctgcttccgatgtgataatggtgccccctcccctggcccgccctctctgaccaaggtctttcataaccctgtggggagctgctgtcactcctgtggtttgggaagtggctccctgggcctcttgctggaaacttgggctgggctcaggccgggcaggaaagtcaccggttctgtcccgcctcagaaggagcctggggaggaggcgggggagctgctggatctggaagaggttatttaggacatgcagattgtctcctagggaggctgggggagagggtgggtgagctggcaccttcctccaccttgctctgtggcgggccaagtcttctgctgaccctgagaggagtctctgggccccatctcccagggaggagggcagcaagcaggctgctgtgattggctggcagggaagccagggtactggggcccccgactgctgtgagtcgaggaacaggattcctcttcctgccaagtagctcagagatgggagtaggaggccagagttgggaatccaggaggcgccacagctctttgtgatgaatctggtagtttttggcaagtctgaaggtggagctagtttccagggccagagagcaagatgtttttggaggggttggggctggaaggtagaaggggaacttcctttttgtgaaaagatggaggtggtttgtgtgcccacgtatgagggtttttcagtacaggcaaaaagtactcttccctctgcctgagctgggggtggagtgcccaaaagacttcctagaaggtcaaggttggaagggacctctgagaactccagttggtccaaatccgtgtgcagcagaggaggctgaggcccaaggaaggagggcaaggtcctgcctcagcatcgcactgagcagatgagtgtagaacctgggtcttctagctagaccaggttgccttaaaagtcaggaatgtgatggccgctgccacctactgaagctaagcactcccaggggtgtgttctccaccagttaacactgggattctctggttgcctggatatggggaaaggtggccactttccctcaaacacaaccccttgcctccccatagggagagtcccactcccagttgccttccagatgcttccttagaagctgagtcccttctgtttactgctgagttaggagttggctcctgggacatgcactaggggtagcgttgtaatttatctgtctcacttctggctccaggccaggctattttctctggggctctgtgagggtaggggttgatttgagaggctgacacctaagctggggccaagagagagacagctgtggctggggcctggaagaggttgggtggggttgccatttctgcctcaataaggagtcaaacccacaagttccttcctgagataaaacaatgaagaaatcctcatgtgtgcaactcagaaatggggccaggtctgggaacccatgacgagtggactggggtggagctcccagccttctcccgagacctagtactggcaggtaggcttgggtaggtgaggatagggcttgatccctctggaatcatttggagccatcctgtctggcttggcctctacctatcctcctgaaagtcaagtggcatggggcactacgggttccagctaaagggggtggggtggggtgctatacctcaggacccatccctgatatcctaccaaggggatgtggcttgggttgggcaatctcccctttgaggaacctgagaaaaggctctgtggctgtcattggaggagtcatactcccttctgttgattcaagaagtgtggacttggctgggatgcagagttgcaggggaagctagtggtgatctcccctttcacaaatccttggggttgagagagtctttctgcttcatcccagaagagagcccagttcatggtgatgctgtggtatctgctgcttccgtctttcagccctggctggagaaatcctcagagccctgaatgaagtcaggagaaggcctggattattggccccttaaacataaccagacaggattaaaagggataatccatgtaaagcatgttgtcctggcacctagtaaatgatcagtaagtgctcaaagcacatgcctcctcctcttccctgccttgaactccatggtgcccggccttaaaatcagaaacagaactggggtcttgggctttaaaagtttgatgggcttccctgcctgagactttgagacttctgctttgctccctcctcttctcttctccagccactgaccccaccctttccccgctttttcaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacaggtaagagccctatgcacatttttgccaaattggaaaaatcagaagacttataagggtgagaggtaactgaagattctggtttatactgtcaaaattcctttgtgaaaattataccccctctgagcccccagtctcaatgcagaaaagcaggttataatcagctatatgggatctcagacccctccagtttgtagtggggacactgagggtatagagagaagtgacttgcccaaggtctcacagtgaacaggttgggaacagaaccccagtctcttggccctagttgtgttcccatactagggagtgtcttgtctattcccgggacctatggaaactggcagttggttctgatctctaggaaagatactctttcctgtcttcctcccttgctgatatcttgccccacccactgctggagttttccagcatgtcctctgctctactcatgctgcctggcactttccaaggagtcggaagtccatgctggccgttatccttcaggtttccttctctcatggttccctttcctcctctccaagattatacctttgccatgtacccgccatccatgatcgccacgggcagcattggggctgcagtgcaaggcctgggtgcctgctccatgtccggggatgagctcacagagctgctggcagggatcactggcactgaagtggtgagtgctgggtagctgggcagcagcctctccattcataaagtagtgctatgccctgagcctccagtagagggaaacctccaaccccaacctggtcccaagtcctggtttcacaaccttggggctttgtggctttttatctcctgccttggtctggggaagagcaagtatcttgggtggggtgaagggcactggccctaggggttcttttcttgccaagtggtgtgctggagtgggggtggggggtttggtgtcagatgcagggctgctctcacactcccttgccacatcctcttgctagtttctgagaactaaagagcgattcctggggccgggctgtggcctaacctccccagacttccccatgtgttgggagctgtccttcccctgcacctgctgccagatgctatggggggagtgtttgctcctcactcttctcccatgttcccaggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttggattggtgtgtgggtaagtctatttctgcactgtatgaggtaaggaggtggaagtcaatggtctaaagcagggatcattgagccttttctgtaaagggctggatatttaggctttgtggggtacatggtctctgacccaaatatagtcagttctgctttataatgtgacctatgcgttcctaaaaatcactatgccatgcaaaattgcacaataaagaccacaggtctcatgggaaaaatggggcttgaagcacaacactcaaatgagtgacacatttaaaaaaaaaggatagcttggtttttacatatgtcaaatggttgagaaattatatcacaataaatatggccttttatcttgaagacatgcactttgcttttggaagtggacgtcggaagggttgctcaacacaggtggggagatgagtgaggtagctggtacatgtttaggtgtgagttttgtgtactacttaggcttggttcagctagatacagtttcccatattcacctactatttctcgaggatgaaatcacacacaagcaaacatgaagtctgcgttatgatcaaactgttcccaaatatattaaatgggttggaacaaatgcgcaatttcgaaagcaaataacaagggttatagcaggattatacttaaactctgctgttgtagcacaaaaccagccacagaaaacatgtaaatgggtgagcatggctgttccaacaaaactatttatggatgctgaaactggaatttcatgtaattcctacctatcacaaaatactgttttaattttttccccatttaaaaatggaaaaatcattcttagctcatgggccacacaaaaatgggcacttgggctgggtgcagtggctcatgcctgtaatcccagcactttgggaggccgaggcgggtggatcacctgaggtcaggagtttgagaccagcctggccaacctggtgaaaccccttctccaccccgtctctactaaaaatacaaaaattagccaggcgtggtggcacgcacctgtagtcccagctactcaggaggctgaggcaggagaatctcttgaaccatggaggcggaggttgcagcgagccgagatcatgccactgtactccagcctgggcgacagagcgagactccgtctcaaaaaacaaatcaacaaaaaaaggggcacctggccctagtttactagtcactagtctaaagctttcattggctgaaaagccagaaagggagcctgtttgatgctagctctgatctaaccattcttgggcccagccttattctctggccttttttttttttttttgagacagtcttgctccgtggcccaggctggagtgtagtggccccaatcctggatcaccgcaacctccacctcccaggttgaagcgattctcctgcctcagcctcccaagtagctgggattacaagcacacgccaccacacccagctaatttttgtatttttagtagagaaggggtttcaccatgttggccaggctggtctcgaactcctgaactcaggtaatccacctacctcagcctcccaaagtgctgggattacaggcgtgagccaccaagcccagcctctctggcctttcttgactcttatctctgctttccccaaggagttttctcttgtagtcctttcatccactgctgagacacgaccatctttggacaacctgctcctggctgctgtagcctgtgatgggggaaggcagaggatgtgtcccctgggggctaacaaggtgagtgcagcctggagaaacaagcttggagatcaagggaggtgggtcctatataaacaggacaagaatgtcctccgtcctccaaatactaacaggagtaatgcctacctccattgactacaccaaacacagaggttcaataaatatctgtctttgcctttatccacagtgacctgacacaatagccatagaaaaagtactcacaccaagccccagctggggactgggaatgctagcatatggtatctcaagttggctctcagaactaaacagggataagggcctagaatggaagagggaaccagccagaccctcagtccttcctgtcctggactgggagccacagatgtccctgtgatctgtcactgccctgatctgggtcttcagccattaaagctcagtgtcatcttcagtcaccaacgggggtcttggtgtccttccaaacccctttggccaggacagctgactgttttcctcactccacggtgatgggaacatcttccacatcgcgggggactgcactctgaagctcacgcctgatttcgggcgatagctgtggatggggctgcagccggagcagttctaagagggcctctttctggtctgtggccaagtcggccttgtagcgctggaccaaagtcaggaggcactggtgccacagcacaggcagttcacgcttctctgtccggaaccccaggaagtggaagactagggcatccagcacccggtaaggcagtgcatacttcttatccagcagcagtcgcaggaagatgctgttggcaccgctgtattccatctcagcaattttcagcatggccgcactagtgggaaagggaggtggggtagagtaagcagggaaaacattggaagaaggatcctacttctccctctatgctttcccctttttttcttcccctctgctggcccttacactatggtattccccagggaccttctcacctacacaatcatattatactcccttgacctcagtcaccatctctacagggatccacccaaatctctatctctagcatagactgcttgtttcagtaaccaactagagtatggtccaaacatctcaacgtctccaccctaactactttcttcctgtgtttcctactcatttgtttatctatttactgagaacttactttatgccaggcactcgggccctgttgttgcacaacttacattgagggggataatgatacacctactcattggcttaaacaagcacaaacccaaggctttccttagctccttctccactctgcccattcccaagtcctggcaattccactatctggatatccactgaccagcccccttccacccccagcaatactacctggagtgcaacacagggatggagcacttggtgatgatgctacccacaatgatggcttcccggagggtacaagtgccagactcgcacagtggaatcaggatccctagggagagtcaaagggcagccactgtgagcccaggatgagaaaaaggagttacagcaggaagcattcccacccagcccagggacagctagcaatttcccacaccaggcctgctgtgttccccatagaagctccagcccttccctttcttccgtgcctctgggatcccacctttgaaccaggctccaggtttgaaaagggccttcttgagagccatgtagagatggaagttgagtcgtttgtattcagcaacgtcatctcgtactcgagggagcaggacaaggttgtagaagcgctgggccatgcgttccttcaggttagaggcaaaaatcctagtgggagttaagcgggggaagtttccaactcacacgacagtctggacccggcccattaaatatcaccatggatagtgcatacaagaggttttaaagtaaaatatgggacctttctttcagtgggggatgtgtgggagctgtgtgcatgcaacacccatcagcttagagagagaataggaggggcaatgagatatacccaaatgaggagcaccgtttgtctgtgggagagccagagctcgtgcaaactgatggctactcagcatcagttcgattctgctagccctgagcatgcctgggcagtcacagacttctgagggtcctgctacagggttgtatcccagtggctataaaagcctctcccctagaaattcatcacagagggttgtatcccagtagctataaaagcctctcccctagaaattcatcacggagggttcctaactggctaactgggtcttggccccaaaaaatgacacaggaaaagctagaaaaatgatgctataaagtagcacagagagggccctggggcaaagctcaaatgccctggggccagaggcaaggaaagcctgtccgtcccaaactcagcctgcacctataaacccaaggcccccgaacccccagctactctacctggtggcctggtacatggcagctgcagtccaggcctccggctctgtgacgtagaggatttgctcccagttggagagtgcagggatgatcttaaatgccttgggcagttttccactgcggtacttagataatacctagggatgagggaggtaaaacaatcatcgtcatccacatatggcaagcttgctgtgggctaggaacttgtctgggtgcttttaatatattaactcattgcatccccacaataacctataaggaggtgccattattatgctcattttacagatgaccagtgagagttccagtaaccgacccaaggatgccaagtcatttacaggcagagcaggaatctgaacccacacactctgcctcttaggtctgttttctactcccatgacttctttagtatgcgatgcaggcaaaaggcaaaaaagcctgtggcaggagcccacagcccccaaaggggtcttccaccatggctcccctctcagctcttacctcccggacccccctgtacacttctaggacccgggggtccagctggggcatagggaagcccgacacctctgacatgactgtctcaacctctgtctgcttctcagtcagcttctccatgatgatgtcagccagggtgcgcctaagaggggaagtgccaagaggaggggagagagggggcaaggagcactgtggtcactgtccaggaagctccagactccccacagtcccctgtgagcaccgccatactgcgatcctgctgggatatgcagcttagagttctctctctgtgcccattcatccaccacagacagaatcactgcagggtgcaaaggaactgaaagtcattccatttaggacaaagctagcagttgtacggaggttattatgaacctcaactctgaagtcagtctgcccaggttcaaatcctggctcacccactccctggtatgatcttgggcatgttactttacctctctatgcctctgtttcctcatttgtaaaatagggataataacggtacccaccttaaaagattaatggaaggattaaataagttaatgtctgttcattacttggaatggtcagtacacagtaagcgttatctatggaaatatttctaagactgattatattcttttcagcctccttaaacagtattgttgggtgtatcaaacataatcttatcttaatgattcagaattaccatcgccttgagctgtcatataatactagcatcttcagaggctgctgaagtgtatttatttattttttttgagagagagtctacctctgttgcccaggttggcatgcagtggcaccatcatggctcactgcagcctctatctctctggctcaagcgatcttcccgcctcagtctctcgagtagctgggaccacaggaacatagtacaaggcccagctagttttttattcttctgtagagatggggtctccccatgttgcccaggctggtctcacactcctgggctcctgccttggcgtcccaaagtgctaagattacaggtctgggccaccatgcccagactgaaatgtatttaaagctgcttctcagttgggcgcagtggctcacgcttgtaatcccagtactttgggaggctgagggaggtggatcacgtgaggtcaggagtttgagaccagcctggccaacatggtgaaaccctgtctctactaataaaacaaaaattagccaggcgtggtggtacgtgcctgtaatcccagctactcgagaggctgaggttgcagtgagctgagatcatgccactgccctccagcgtgggtgacagagtgagatcctgtcacaaaacaaaacaaaaaacaaactgctcctcttttctgaggtcctactcaatgccaggcactgagtttgggacttttcagtcctagagtcagcgcaacacttataggacacggaaacttatgcagacatgggaactgggcctcaggttaataactcacccaaggcctcacagctgtcaggtgggggtaagagtcaaactcaggtttttggaagtcttgagttaaggtgctttatagtaccttataatgtgcccccaaactaaatggcctctgattgttgaattcatgtggatctaggcttgctttctgaagatgccagctatcatttcttacgactgccaggagttctgattacttcaaggagcttgtctactctatttactacaagctggaaaagcattctgctaaattggtcagcattatcagtgaagtaggagttatgaggtgctgagtgagaacctgagaggctctctggggggacaagcccaagtacatactttatgacatatatttcaactgttaggcatcaatctgggagaggggctcattttcatttcttcattctgcattttcaaataagctgccacagaatttatcagcctccctgtccttttatagtatgattagcaatgagatgcattagcccaaaacagcctaaagtatcagggacaccattatgttaatatcacagggtcagaatgaactggttgaggacccttatcctagactccactcccaagggccaaaatttatgggctcaggagtttgaccacaggcagtctaaatgcctgcatgttttggagctagcatttattatagatgggaataaattagtggtcctgactaggggcagtcttgcctcccagaggacatttggcaatgtctgatgtcatttttggttttcacaactgggggaaggttgctactggagtctagaagtagagatcagagatatctactaaacctcctacactgcacaggacagcctccacacacacacaaaattacccagcccaaaatgtcaataatgctgaggttgaaaaaccttggcttaaatgaagcttaggatatgaagacttgtccaaggaagttgagcttaccgctaaaaaaactaagaataccaaaaccaaatgcaataggatggctctccccagaggtgtaaaaggggcctggaactgtttccctggcaactgggcagttgtacaacaaatggacataaggacacaatgttttttgaggctgggtcattcctactcacagtggtcctttgaggatgggccagttttgtcaaggtggtcccctacagctagcaactccagggccctttccaaaggtagggaatcataagtctgccagggaacttgttttcctgtgggaactttctacaaggactcattatcccaaatccccaggcctacctggcaggagggttcttgttcatgaacatctctatggcacgctcatcctcagggtccacaaccacctctgcatgatggcccgctgctgtcattgtggcagccttctccagggtgggccactcctcgtcctcgtcatctgatccatcctgaggcattcttggacctagaagaggggagactaaatggatgagcacagcaaaaggtagctgagggatttcgtcagtttaactttagccattatgtagtacaggcctcacatgtggttgtgatagacgcaggtatgtgcagtgaaacaaatgcattagctccctgtccccaggggcttgcaatcatgcttgagaaacaaaatgtatatacaggaaacaataagaaaagcaatggccataaataatagttaacataccatactcagttatgtagaaggaacttttttttttttttttgaaatggagtcttgctctgtcacccacactggagtgcagtggctggatctcagctcactgcaagctccgcctcccgggttcatgccattctcctgcctcagcctcccaagcagctgggactacaggcataagccaccagcccggctaattttttgtatttttagtagagttggggtttcaccatgttgaccagaatggtctcgatctcttgacctcgtgatccgcccgccttggcctcccaaaatgctgggattacagggcgtgagccactgttcccggcctgtagaaggaacttctaaacactatacccatgttaactgtttaatccttataaacccaagaagtggcgggcannnnnnnnnnnnnnnnnnnnacggtggctcacgcatgtaatcccagcactttgggaggccgaggcgggcagatcacgaggtcaagagatcgaaaccaccctggtcaacatggtgaaaccccatctctactaaaaatacaaaaattagctgggcgtggtggtgggcgcctgtagtcccagctatttggaaggctgaggcaggagaatcacttgaacccaggaggtggaggttgcagtgagccaaggtcacgccactgcactccagcctggtgacaaagcgagactccgtctcaaaaaatatatataaaattaaaaaaaataaaataaaccttcttatggaacaatggcaaataaataaataaataagaataaacccaagaagtggatactattactatacccagtttcaaatgaggacattgaagcactgagaagttgggtaatttgcccaagacaggtagtctgggtctagactgcattcttcaccactattctacacatattcgggtttgattatatgccacaatgagtagtagagacaacatatgcacttaaaggatgagtggtgaggacagttaggagctggatgggcagtttgggagcagaaggagtgtgttccagacgcagagaaaataaggcttggatataagagtctcctaggcaatagcaagaaataatgctaggtacgtgggaaaggtgaagccagactggagggcctttaaattcaggcagtagagttcagatttcaatccaccagtccatttaaatacatgaagttggctgggcgtggtggctcacgcctgtaatcccaccattttgggagaccaaggcgggtggatcatgagattgggagttcgagaccagcctgactaacagggagaagccccgtctctactaaaaatacaaaattagccgggcttggtggcgcatgcctataatcccagctacttgggaaggctgaggcatgagaatcgcttgaacccgggaggtggaggttgaggtgaggtgagccgagatcgcgccactgcactccagcctgggcaacaacagcaaaactctgtctcaaaaaaataaataaataaataaataaaaataaataggccgggcgcggtggctcacgcctgtaatcccagcacttagagaggccaaggcgggcggatcacgaggtcaggagactgagaccatcctggctaacacggtgaaaccccgtctctactaaaaatacaaaaaattagccgggtgtggtggcgggcgcctgtagtcccagctactcgggaggctgaggcaggagaatggtgtgaacccgggaggcggagcttgcagtgagccaagatcgtgccactgcactccagcctgggcgacagagcgagactccgtcttaaaaaaaaaaaaaaaaatgaagttagtccatttaaataacttctgtttttggaaggctacatgtctgggcatctggaaaggggtctaataatccaagtggggagctataatgctacgtatcaataggtcattaacaacaaaggcagtgtgtgataaacactaaataagggggaacagacattttgtctccacgttccaacggtcccccaaatttgtactttgtaggtggttctccttagtgccagaccctaactccaggtgtctcctgtaagctgctcttggatgactcacaggcacctcaaatctcacccgttatcaactaaactaattttctttccctcctaggtctacactgctaaccatccacagctcagtaaacggcaccatcgtccacccaatgctaagcctgggagg

SEQ ID NO: 987 - DNA, 2042 bp, Homo sapiens
gcgcctgtcagggaagcggcgcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatgggggcctggccatccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttgg

SEQ ID NO: 988 - DNA, 879 bp, Homo sapiens
atggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtag

SEQ ID NO: 989 - DNA, 63845 bp, Mus musculus
  misc_feature (1)..(1624): "n" at positions 1 thru 1624 can be any base
  misc_feature (18698)..(19219): "n" at positions 18698 thru 19219 can be any base
  misc_feature (45981)..(46111): "n" at positions 45981 thru 46111 can be any base
  misc_feature (58652)..(59151): "n" at positions 58652 thru 59151 can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctgccagcaaccaggcccttctggggccagttccctccgggcagatagatcagctggccccaggggtgcaggatccgaggggtcaagcccccagagtggcagctttgtgtgatggaatgaggcttaaactccagttggcaaccttcagtacattcatgggggcagccaccactgtgtgcacacaaacaagcaccactgtgcgcacacaagcaagcacctctgtgtgcacacgagcaagcaccactgtgtgcacacaagccagcaccactgtgtgcacacaagcaagcaccactgtatgcacactagcatcactgtgtgcacacaagccagcaccactgtatgcacacaagccagcaccactgtgtgcacacgagcaccactgtatgcacacaagccagcaccactgtgtgcaaccaagcaagcaccactgtgtacaaacaagcaccactgtgtgcacccaagcaagcaccactgtgtgcacacaagcaagcaccactgtgtgcacacaagcatcactgtgtgcacacaagcaagcaccactgtgtacaaacaagcaccactgtgtgcacacaagcatcactgtgtgcacacaagcaagcaccactgtgtacaaacaagcaccgctctgtgcacacaagcaagcaccactgtgtacaaacaagcaccgctctgtgcacacaagcaagcaccactgtgtgcacacaagcaagcaccactgtgtgcacacaggcacatgtgcatgctgcaccccagctttctcttacccacctccttctgggaccctgaaatctctgtgactgcttggaacatgctaagaggtccatggacaccacccagtcctgtgagtagtaagtacctcctgggctagatatgaccctcacctatagcaagtgtccgcagaaggctgaggtagccacttctagggacccacagctgagttcctgttcagtgccctggtctgtcctgcaaggtaaggacatcaaggataatgaccattagtaatggtggagaaacgaagcatctagtctagttagctgtcacggccaaaaggactcttaattaggccacgttaatctataggaagggtcatagtcaaagagggtaagtgagcatgcagcccaacgacagaaaatcggccagggaccccttggctccccacccacatcctcccagctctcacattctgatggaggacaacaggtagagactaacagcttttctgggccctggactgtctaccttgtctgaagtctacagtgtctgaagtaggtatctgaacttgacccagccctcttcctcgccttcctcctcccactcctgaagaaagcttctcacagaccaaagaagtgatcactggcatcgccaggctcctctggcagctgagaggccgtcacgcttcctccttactgggaatatctgggtcgcagaggcctccgtatgacccatactttcaccccacttactcgtaaggctggattggtgtccccaaatatgtccaatactttgagacggggtgggggtggggcctcatggccatggagattccagatgcagaggagggaactcagtgccacctttggctgtaaggaacagcctcaattgggattaggaaaatacaccatcttgaatcataaacaaacaaacaaacaaacaaataaataaataatcttgaatcacaaacaaacaaacattccaagacgggattctcagggcagttaatgtctcagcagtggctcaagagactcagtttctcccaccctggtcttaagtctctactttggtctcagtcagttgttctcacagcatccaaccaagatataacaataccccaaagcggggaaactggacagcaatttagcggactgctcactcccctaaatactttctagaaatcacaggtccgtcagctgactccccttcgtgtctcctttgagtcggtgtagcccaagcccttgcaaattgactcagactagtcagcatttatctctgagccaggtgggggagaacaaacttggttcctcatgtgcctaaataaagcctctgcctttacatatacttttatatacatatatgtgtatatatatcatcctagtcaggatttctactgctgcacaaaacatcatgaccaagaaacaaatgggggaggaaagggtttatttatcttatacttccacattgctgttcatccccaaaggaagtcaggactggaactcacacagggcaggaagcaggaggcaggagctgatgcagaggccatggagggtgctgcttactggattgcatctcctagcttgctcagcttgctttcttatagaacctgggactgccagcccagggatggcaccccccacagtgggccctcccagccttgatcactaattaagaaaatgccttatagctggatctgatggaggcatttcctcaagggaggctcctttctctgtgagaactccagcttgtgtcaggtggacacaaaaccagccagtacagttacttgcaaccataagtaactccagttccagggatcctgacctctgcaggcatcgagcaggtggatggcatacatgcatacaggcaaaacactcgtacgtgtaaaagaagataaatccaaaatagtaataataataaaaagtaactcaaaagaactttcctcctcactcagctcagctactgccaggaaccatttcagagccagcaggcatcaccactgcaggcgagggaataggcttagagagcataggaaacatgaaacatgcccagggttgtacagtacgaggcagagctgggctctaaggcaaccactcagacagtgtctccctggacaaacaaccgaaatcccataggacagatcctgagaggccagcaatgctaagcagggtttgcccaaggaccgccccccaccacctgtgacagctataaacacctgttccaggatctttgctggtgaagtagcgagggccccagcgactgtccactgaaccatctacttgtgttcagactcttagcccctagagctcatttctggtccaacctcagtttccccacggtggctgctgttggtcatacttgtctgtgaagggatggttgggggcagagatctggagggtgcaaaccaagcatgatgggcaattgtctgccctatatccatggatcagaccaggctactcgatccccccccccttttttttaaatagtgtccccaccagactcttctcccaagagtctggctggctcttaattttgctgtttagaaacatttgattttctgaggtatgcctcttccaggagaaggtaagcctcatagactcagaaccctggggctcaggcatgcttacctgggggttacctgcatatagtccttcttagtgaacaactaactacacaggacacctatgcaaagaacacctgggacctctgtaatggcatgcacatgtgtgcacaccacacacacacacacacacacacacacacagagagagagagagagagagagagagagagagagagagagagagagcgatcattgtggctggaggggctgtcaagtctcagatgcctccaggtgtcagtgacttctggccaggttgctatgttctcatctcaagccatcaggaaaggtgggtgttaccttgaggaaaactgaacccaacactggggtggacaggtctccaggaagcattaaagtgccttaaaataccacacggaacataaacccagggccctctcatctgggatctcaacaccctctctaagtctgtcagcctactctgttcttggtgccagagttctcctgagttcagttggataaagggcagcacacagcacacaggcttaggtgtgccatgtgttaactccatggcagtgttaggggcttctggccagagcctagggtaggggttggccactgatggaggtggagagactctccaaagagatgctgatgtgggagtcctacaaggggcgggggcggggtgggtgggttggcctctgatactaggacatgttagggggagaggagtgcccttgtcacagaaaaaagaagaaagccagtgtttttttgtttgtttgtttgtttgttttttaaccatccaagtcagctttgtgtagtattaatgtctaatgataaggactccctgtgagatagctaagtcccattctcacaccacaattgagggtacattcagggagcagctacctccactggccttcatttcttcttccaaaggaccccttccaaattaccctggggacctgccgctgctgttggaggatcactggaaaaaggggacacctgacatcttcaggtctggcagacctagacctagaaaggatacctgttctgggtggaaggccttggggtatcacaggtccactcccagagatgccaatctgtatcccataagccagtctgctgactgtctctagggcctgcaagtcctcccaggtgactcaggggtgccttgagcctctaagtggagcacacttgatccccaggtaagctccgaaattgcacagtagattaagggaattcactcacaaggatgcctccttagctgagatccccaaagatccaggctgcataggacctgaaggctcactcacttctgctttccagtcagcagcaatgtagcaatgtaggagccaggcagcacagggaaggctctgagctctgggacagacacctgcatctctttgggtgcttggatccccctactctttggcctttctgcaggccacaggcttcgacttctgagtcttcacttaggatgatgaggcctacctgcatgaatagcgtcgtgtctaatttttgtctccgccaacccctccatgatcctcctacttccaaggccacctgctgtctggtctcctagctgtctccaggaaactcacccgaaatcgttcgagaggctcctagagttgttaagggagacccttaaaagctcccttctcctggtcagagaccttggagtctcccgttccttctggtgttcttctgagaatctctgcttcaggtcccttgaccttcgcacctgatgcctccctgctttgcccacagtggtttttctccctccattcctacattaggctaggttggttctgagcccccacccccatcccgcagttcccagagggaacagtcccagcaaaaatacatggaactcagtgcctgagtgggagatttccccctccctcctcacgacagactggcagccgagtgagggcgggtgggggtctagcggccaaattctttgtcttcgaggtgcctcagcaggggtccggtggagcagcgcagaatacacacagccgctgaccgataactcctggagagagcgcacttcaaaaggaacctcccggcagctactgaggtgggggtgggggtccccatctcgggtctgaagtccctgtcagtcacacacagcacgcaggcttccacgtgccacatcttttgctgcaggtcctgggtcccagatgccttcccctccctcaaccaggagaccacccttcctgtccagggcgagcctcatatccaccctcattagctggtttcagagtaaaaataatcctttcccgccatgtgcagcctaccctgatgttgggtgcctatcaagagagaagatgtgtctaggagatactcgtggcaaaggggctccctcactgcctgggcagggtccattcctgcgttgccacccgcaggcaggaggaagaaaattaagcctgtgttgaaggaaggacacctggcaagagagacgaaaggactccggaatcccctcctctggggaactttcaagtgggggggaaatccccacgcaggcttctactctgcggcagcaacatgcgcggccactccccgcttctggtcccctcctcctttccttcttgcacctttgcctgtttgtttcctaccctcagaacagcacctggggctgcctcgggctctggtttgcctgtaagaggcacctgcatacacacagcccttcaagggacgaccagttttagccacaccaggacagcttcccacgtatctcgcaggcagccaacatctcacccaaagccaccaagagcctttgcccccgctctcttgggctggcacctgtggaatcttaaggatctaaatgaccccaagaagccctccagattagctcttgcctccacaccatagcggtgtgttggaggccagagaaagcaacgtccctgttttcagaaacactaattttggactgcccccccccccgccccacgctctgatgcaggactagagatttaatccgcatagatgttcagcggcctatggggagcccccatgggatgagcagcaatcaagatctcagctaaaggctacctagtaacccaaaagcctgtgaagcaagctccttgacagaagcctcagccccggggctttgcattccccgatagtggccaaccccctcctactgccctcccaggtgaatcagaaacggggcctcagaatcagccgtgccccttggggaggaatcttctgggaatgcccggcccccgggggcatttctaggggtgcttatctcagtaccatctaccagctccactagtcttcagcaggtgggggattgcctgctgttccttagccctccccacttctccccttcccctttcaacccccacctcttcctctgtctgggcgttcaccccacccccgcccctgttttccgtctcagtgtctctatccacttgtctctctctatctccccttcctcccctctttcatctctccctctacccccctccagccgaggatcgggctaggaactcgcagaagctgtgacaagcccaggcggctctctcgacccttggtgcccccaggggccagttccttgctctccttacaccagcagaagccatgtgccgagaacagaccagcaggggcagtggatccgagctgtgggcaccagcctgccggatcaaaggctaggaatgtctgctccccgtaggacttccctcagtcccatccacccctaacagcaagaaagcccgccattcctggctaggcaggtttgggtgggctccctctcttcaccgtctacacagttaagtcccaccatggcttctcctttggcttgctttctaggtcccaagccaggagcatttcaagggctgaatgtcttctgtgtccgggtagagaggctgaggtacctaggtaaggggactgaatcctaacaatctaggtatgattgggctcagacttaactcccaaactgtggagaactggtaagaagagtgccccttggaggcctgaacagttccccttgtataagagcttcagtaggtcgtagggtgaatctggtgtctgcacgggacaacgcttaaacaccaatcgccaggttttagtttctcatccgtagaagggtcgggaatataggtcagagacctggacataggggaggtagatgttcctgaagagccctcgcccccaaccactaatagacagagctataccgtgtttcactagtcccaaatgcttccatcctaagatccaagaaactgcaggtactgctgaggtccggccagcacgcctgcaggaggagaaagtgaccgaatcctcccgcaggaaatgcaaacggcggctggtgtcagttgcaggaaatgcaaaggctgcaggaggtcgcgataccaatctgactcttgacaaaagactcaaatgacactagctctgtcccccggcgccgccggctggcagaccttcagagcctcagcggactctcccgcgcgcccctcggacaccctggaagcgacctgcggccgggtggcaggggccgccagctcgcgagcccgaaaaggctggagactgggaggggttgcattttcctagcccctgatcccagtcgcgcgatctggaaacaacccctttgctttctagtctcgattccttacgggcccaagtgccaagggatcacagaaaagggagccacccatcaatgcccaagccgaccccttcaccacgtgaacgccgggtcaaagctccagctccctaaacctggctcgcgtggactgggaagggggtgtcccaggccagcagagaatccagcgtgccgggtcctcccgaggcctccgtgcgcccggggcgcaggctttgcccaagtttgccgggagatgcccttcccagagccggagttgtgggccgggcgggaggggcccgtgattgacaggctgaactacagactcatctcttaccttaggccgcgggcgctgattggctgctcgctgacatcctcaaacccggctgctcggcgctgggctccggaggggggcggctgcgggtggaggtgcgcctctgacaagcccgaaagtcatttccaacctcaagtggactttgttccaactattgggggcgtcgctccccctcttcatgatcgccggcaaacttcctcctcggcgctgcttctaatggagccccacctgctcgggctgctactcggcctcctgctcagtggcaccagggtcctcgctggctacccaatttggtggtaagacttgcctcttgtctgcctgcggccccgatctctcggccgcacccggggacggtgggaggcgctggccgggtctgggctgcagcaggcctggggctcttttctccttgcttcccgctagccccccagccgtccacccctcttggatcttctgctggtgtcgccttccgaatccaactcctggcttctcagataatcaccattttccctgctacccgccgcagaggcgggagggctctccctacccctgaaggtctctcgttcttagtcttcaccctctcccaccccaatttgggggtcccgaagaaccttcgtttgctcacacttgcatttctgtgctgtccccgcggcccggccactcctcttctccattttagggtctccgtgggtaaaattatcctgtcctttttcgccaccgcacctcttcggtgtctcggtcaagagatttcccccacaatactcgcgtttgccttcatatttgagaccttaagggctttgggaatcccaagcaggggacttagggggtatttcagtagattctccccactccgttctagattaattttgagcctctgaagtgactatagaatttgctgatcctagatgccattgctgatccgggtgtattcgttccttgcttgtccatcccggagaaaagcgaggtgggggctctttgaaaatgtacttgtttgggaggggtaggcttgctgggtttttttgagcgaaaacctagttctccatgtcaaattcgttgcttttggaagacggggaagctaggagaaagggcgagggaagggggaatgctgtccctgagaaatacggatacaaaaggcattttagtaaataaggctgggcgagcaggcggagtacttggagctgatgggtgtgtgaagggattcactggaagataaaccgccttttggaagccccagctccagagactcccctgttttccaagcctcattgctgctcctcctctgtaggtcctccggtggaagacactaaaaccagttttctaaattacaccccagccctctcagtctccagccccctgcattccggaaaactttaataaaagaaccctcccctcctgggcagtggctagagccctggggggggtgggaggtgaggaggaggaggaatttgggacctctgagtaagaaggagactggcccctggggtgaaagttagaagtgctaccagggtaaagtgctgcctacatggccccctccctgcctgctacctgcaagcctgcagtatgaggctcagagcttataaaatactgggccacaccccaagcctttttccagatgctttggggtgtctgaaggccaggggagggggcagtcatgaacccaggcacccaagccatggcctgcccaaggttctgtttagagggtccaggagttgctccttaggttgataaatacgccaaggacagaccatctttctttcctgtggacttgggctggtctggggctcctgtgtggagtctatagagcctgtgcatgctggggacagccagggattccacagtgaggttctgccaattggtgaaaggttgcctctgcctccggactttccttcccccagccaaggccaaactctgccttctcagagaccctgcggtggcgggtgcataggaagagagggtgcctggagccctagggatggcatagaggaaaaaggagagagtgggcttgctagttctgtgaactggaagagagcacttcctggggcagtaccagtaggttagatggtggtaacagtagcctctgtgtgtagtaatgtccaggaatatctaggtaaggtccccatccgacaagaaatattaggaaaacctggagggcagagacaggtcctaacataacatacatggcctgtttgggggttaaggggggaccagatggctgcttttgtctgagccatagagagtatgtatgggtatttttgagatgggtggtttgtcagtgcctgtggctacgacctctgtgtgtgtaatacagtgtgtgctctaggtcagtgaccctaagtgtctgtgtacctgtatgtctctgtgggtagaagctgttagtgcctgagacccaggcaagtgttttgtgtgaaaccttttggtgtgtgcctaggggatctgcggcccacagcagggtatgctgtatctgcatacaagtatcagcaagtggctggttctgtgatgtgacacagaagtcgagaagtatccgttgcttgtgtaaagggggacctcctggcttttgcctgtgatactggacatggcagtatttgtgtttggacttgtgtgctgtctgtgcatgtgtctgtgtgtgtcccttcacccgcgcatgccttcctgacagcgtaagggggaggcccaacaaatgtctttgtgcgtgagatcggtgttcgtggcatgaccagccatggttggaagtatgagagtgagcctgggaggcctggctgagggctgtgtccgggcccagcttctgatcgtgaccccaaatgccagtgacatagttttgtgccagtggttatgcgtctgtggtcatgtttgctgacacctgacttgtgggtgtgaagaatacctgaaaggggtgcttggtggccatcagtggccctgaggggaaagacaggcaggaagtggaggtctcagaaggtggctgcagacacaatcggtctgggatcccagctggggtgggggcagggccttccttgacaccatcaagccttgcttgcttgaggactgtggctacgagccttccctcctctaaggtcatttccctttcgtcttggagctggggcatgaatcaccttcatggggctggaagtagagagtgggtaggcctcaaattcttgattcccctcctctgccccaaggccggcagattccaggcctttgagtccgtgactgcctgccacctctttggcccacccggctctcacgttcacccagaggatttacaggggaaatggcttagctgggatttctgtccacatcaccttcagaaaggacccctactcccagtagcccatccctgcttttccttgcaagggccccaactctgagacaaggtgatgaggaaggggctctgaggggcctcttactctaaaaggaagccctgtgctccagagcctcccagcctggcagtggctccattggagcaggaccagtgacaaccagcctgctttctagaactctccttcatagtactagttagctcctagtaaagaaatctgtctttctctttcttgaggaataagatcgttctacggccttgccctgtgccatctgtgctccattggaagtgccctgaaaaaggaggcctggttggctgggtggtgtttggcagctcacttcacactgtgtggctgaggactggtgattcctccccacccccccttttgggggtcacttttctcactttttacccaaccttgcagtttagaggggaaatgttttgctgagggctccaagcctgttagggcgcctgggttctcattgcaccactccagagcccatcctccacccaagcacctatcttaagccctgcctcagtttctctatgtgtcacatcctgctgcctcccctgctcaacgcccacccaacagccttctctccgaggcttgggaactaaggaacgtgttcagtcaaacccccgtgggggtcagtgggctgggcccagggaggcacctggagactgtgggggaggaaggccccaggccaggtgttaacacttgtaacaggcaggaattacagctggctggggctagggctggtgagccgagctggctggaggctgttgatcccacagacagtcagtcagtcagacagacagacagacagacagacagacagatgggagataccagatcggatggccaagctttagcagggtggtcgctcttccagagaagatcttgccgtgggggaattcgtctggggggaaaaaagaatgatgggccccttgaaaatgagttcacagcccacccctattgtgggcggggccttgtgctacaaagggatcgcaatttggtggttggtggtagaaggttggtatccttctaatggcatcacacattgccacacaaacaacaaacaagacaactggtgaaacaccagctagtatcaggaactgtgtgtgtcctttagaaaagcggactggactttatagggaagaaggcacgtggttggggttgggatagtggttgaggggggacacagctgtcagaggaaagtcctcccctgccccctccccccttacaatctccaagtgtcttattaacagctttgggaccaagaggtaaaagctgggtgtggcccacttcttaacatagattctgaggtcttggagttttggatgtctaaactgcattgaatcctggtgtcagaagaggtgacctgggagcctaggccttcacaaagctggtacctgctgctgctaccccactgtaaactcagctagagctctctagggcccacgctcactcacttctgggcctctgctccaacctccattaaagagtcaaaacgagggccccaggtaagagtccccaagggacagactggtccaaggaagatttccccaccctctcagggcagaactcactgctcacaggaggacacagttgcctggaaggttagagcagtattcatgggcctcctaccaaaaccgcgaagagaaggccataccctacatttacccagcatccccctgttttgttttgttttgttttgttttgttttgttttgttttgttttgttgagataggatttcttcatgtagccttggctgtcctagaacttattctgtagacctgactggccttgaactcagagatccttcttcctgcttctgcctcctgggtgccgggatcaaaggcacctggccagcacccttcttgaaggctcggccaccacatgttctgtttctatatattccctctggggagaaatgtttcagcctggaagtggagagccacgtctgagttctgagcttaccatccattggctgtgtgacctagggtgactctgtccttcttcagctccctgcctctctcttgactatactgagaggtgtccattcatcttcttagagcctcggggatatgatggggactccacagcagatacttgggacctgcctgaatcagcacaccccttgatttctgtggcttggtgtacctgccctaagccccactttccacccaacactgccatgccttcttaattcacttccaaacctcacgtaagggctctctattcctctgtctctgggctgctggcaaagtgacctctccccgtctcagtttccccataggaaaaataaagttatggccgctaccccatgaacatcagtgatcaaattcaggccccagaatgctgccggaatgcaggaagtacagttcaatgtttgaacctcggtctggccctgaatccagacttgtctcttcaaataaaccctccgagattggcccccatggctctcatttcttcttgttccatgtgcttggcactggtgcccacaggcttgtaacttccttcaaaatcagaagttcagctttttaaaatattttttattatattcatgttagtggtttcctacatgtatgcctatgcaagagagtcggatcccctggaattaaaattatagacagttgtgagctgccatgtgggtgctgggaattgaaccctgaacctctgaaaggaccagtgctcttcaccactgagccatctctccagcccattgaagttcagcttttttttttttttttttttttttttgctgcctaggggaggtagggtaaggtggacagaggtggtctggggtctcccctaatcctcctgataccccacagtcttctgagctcggaaacctctgtcctctccagctggaacacagagctcccgggcctggtggggaggggtaggcttggggccctggctgctggagcagccccagcacgaggtgaagttgcttctggagctgggggatgactcagagggtgatttatagacggaaagcagaaagcttggctcctggcagaagcctgctgcttaattacattctttggggggtggaggtatgtggggcgacagcaagggagagacttctacctcgtcccctccgggcctggtacctgtgatgtcctagcaccaaatagggttcttcttagagagtgcgtcccctgtactgaatgcacggttagccactgagaagaggaagaagtgggacagaatcatcggaaggacagagtcccgtggggaccaccccagggacaggctgatggggcacacaggaagagtgggatgctgagaaggatcgctgaacctccaccctgcttctgccgaagaatccctaagccacctgggcctctgggtagccactctccacttccccttcgcgtggttgcctgtgaagaccttcaagttggcttcttgtcctgtggcttgggtcctggtagcccatgcgtgcaggagaccaggcctggaactcagagactaaactctgcgtctttgggttagatgacctgttgcgtggaagtgtgatgactgctgcaaaactgcagcggttctggtagcatcagcctcgtgctggagggaaggaaccccactaaccctgcctttaaactaactacagctagcctgtctgcccatgctgaccagtgtagtgactccaacacagccccagatactgaatttctgggtcaggggtcccaaaaggtataggacaggcaggggtaaggaggccaaggtctgcagcacctggctgcctgtttgagcttggttagtacagctggcaggacttggcaggggtcaggatggggacagcagacagctctccagttccccctgaggcaggccttctcaaaatggcctcattaatgcatgtggagtgaattccagaaatgtcaggtatactcacacatctaaagaaggatggggacccagaaatgttctgtgcttggagacaagaggagtcagagtgagggatggtttccaggtccgggatctgaactgttggacatggtcttcctattgcaaagtgatgctctgtgctcaggacagtggatgtttgagttttctgtgcctagtgggagactggaactgattccgggacagagtagagaccataaactttatatgtgagcagctttgaggtgcaagctgaattgccaaccttcccagacctcagttttctcatccaccaaatggccaataacatgccttccctgcccatggtactaatgagagctcaggatgtctgtcttaccagagtcagctcagcaactaccattgttagaaagaagaccaagatccccaccccctacccagaggaggtgcaagagtatctgtagtggatccccaatctctgagtagaatctctgggagcagagccgttgcttgggtttaagacccagtgatggcaggtgtgctccagtttcagctctggaggtccacgaagagcacataggcctgatccccactgagacccggttaggaggtctgggtggaggtgagggcaaggtaggcagctggaagcactctctcaaagcccgaggccatcaggaaatccaaacacccccagggaatgccaaggaaacccacagcggcatagccctgttccctaactgagctagagagacttgaagagaatgtcctgtgtccctgtgttggcaagggggatgggagcaacaggaccctgtgaccaggtttgttgggagggcctttctgccaaacctgcccctgggcgcagagtcccacttatctatcggagccagccgggatcagcaaggaaaaccaatcttccagagcccgctatgcatgcaaatgggggcttgtgaccatgtgaacctgcacaccgcctctctctagttcctccacacttcataacgtggctttccgagggtgtcattctgtccctctgaaacctctcatggttctgatctagaccccctttgttttattttggcctctacctgcctatacaacatgcctttcagaacccctctcccactccttcctcaaaccgaacacaaaatagtacatgaacctctgcatgcctccttcctctgacctggggaaggcagtaggacttgacccctaggttgaccagggcttatttctgctctgccaagcacaggacctggctggcttgtggcatggagctgacaaccctaaactgtgaagggcctttggtgtctctaaggcaatgggaccctcctgagcagactgccgcagccgtgctggatactgggatgtctccaccatgtccattcccttgggctttgttgctcctcctcagcccagattgaagaattctatgtatgtgttagagcttcttctatgctcacccagctcttgctatgcatataaaagtgtcaggacctagggacaggtgcctttgcatgctgtgtggctgtctttagagacctagaagatattcttccaagactaacggtgagcagctgctttgcacagaccacacgtggtgggagaagggttggagcccacattctgcctccactcggggtcaggagaagacttcctagttagaaggaggagaagctgcttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgttggggagaagctatgtatgcatttgtgggaagggggtagcttattcatgtgtgcatttgagcatggagccagaatacaacctatggtttcatatcttgggcactctgtttagctttggaaacatagtctctcactgagacattaggttccctgattcgtctaggttggttggctagtgagcctcaaggatttccctgcttctgcctccctagctttgggattacaggcacaccaccacacccaaccttttcccatgggttctgaggaatgagctcagcaattagataagccatcttccctccctagcctcagaattcatgcccatagcctagccctgagttggtgtttctgggctgttgagtctttccttgactttcacagctagacattcagcactatttcctgctgagaagccagaatgctctctcctttcttataaagcatatttcctttatgcatcagccatttaggaaccccagagctagacttgatactcgatgtttgcacctgtgctgaccttgggtgacacattcgtcttctcctttgcctgatccagtgttttcatctccattctgccatttatccagaaacattttgtattctaaactccttgcgggcagaccccatgcctggagcatctagagttcaccacgcttggtctctgtgtagcggctactgatgctccataaatatgttttggccgtcagacaggacgttggctgccagctgtgctgagttctttctgaaaagaggcaaggcagaggaaaatgagaacgaaaaattcattttgtcagcatggcagcagtatgcctgtgatccctgcactccagagactgaggcaggaggattgcaagtttgaaaccagcttgggctctacaatgagagtctgtcgacacaaaagaaagaaagagggaaaggggtgggtaggggagaaaaaaatggctgtttctgagaagcggctctgagctgacagttttgagttgggggaagcgcatcctgtatcttccccagaaaccttatctctagggatgctgtttgcaggactgacggtgctttagtctaagcttgaaggtgtcatcccacctcttgggaatctcaaacattgtagccaaggatgaccttgaccttttcctcctctttcactgccccagtgctgggcttagcccgcaccactgtgcctgggtttatttggtgttagggattgaacccagggcttcatgcatgctaggcaagcactctaccaacggagctatgcctcaggttggggactttgtgtctgccatggctgtgccttctctttgtttgctccccccaccccatgcctgtctgtggtgttctccttgggagatgactaattgatgctcttgataccacttcctaggtgacacacaagtacccaagtgccccctttccatctccccagcagctattgcagaactaccaccctgtaaaaattcagggcggcatgcggatgagagagagagaacacaggagaccacactcaggaccacatagggtggctggcctctctcaggccagacgttcccattggcaaagctgtggggaagaccccaagtagacctggactaagccacatcactgctgtggcaggaacctcacaaaaaggagaggagaacactcaatcgtgcattgtggtgcctttgaccccaacacttgggaggccaagacaggtagatttctataccttcaagatcagcctggcctatgcgggaagtttcgggacagtcagggtgatgagagaccctgtctcaataaacaaaaatagaagtagagaggagcttcagggtaggggagcacagcccgccaaccacctggcaaggcttcagttcacctctatgctcctgcccttagttggccctagacccatcccagtcccttgacttcagccaaaagagcatccaaatctactgtaggtggacctccataaggtccagaactttccaaggatgaccatgactctggcatgcctttgaagctaaagctgcaccctgtctccagaaagtgggcagccagggagcagattttaatcatcagcgaggaatccatctgtcctttttgaggttcctgcctcagcctggtgtgcacagagggaacacatcacctctgtcagccttagaagcatgctcttgttctccccattctacaggtgacaaactgagcccttgagagaaccacttcagggcctaaggctcctcaggctgtggactgaaactccaattagatgctgactgtaggaagccaggccctccagggttcacagcccctcactgatagccaggaagctccctcaaggtctatctagacttagtccaagcccagacaatttcatttggtctctgggatgtgaacatcactgaagggtctcaatctgcccttgtgattggatatgttgttcctggagtccagggcagtcctttggaggtaacctgaaagtgccattagcccaagttatgaggggggtcctgcccaggtctttggggcagagggctctgcaccactgtctgacaattgtgcccctttctctggggacaggaatctgaaatcccagggccaacacccctagggcccacacccaccctggtgatgctccaggcatcccaatatctggggaatccttcccagatgactgtaggcctcctgagctctctgggtttctacctaaagtctgttctattagagaagatgacagtactgatgacccaaaaagaggtcagggcagggtatttgcaggggctgtgggtacctggagggttagctaggtgtccagcatggtgagccctgtagaggctgagggctatttctgcccatgtcaccattttctagaatgaactccttggaaagactgattttgcttactatttaaattttgtattagtaacacacacacatatacacactttctggaagcacatggcaagactaaatcaagaaagcacatgtgtcctgtggaagtccaggacaaggatctcagtttgaatgaagagtattgacatttgttaacctgaggtgaggcagttacgtctctggtacctgacaaacactcagccttcatttaataatctcgtcccacacactctagccaggatgaaggagttggatggggaaatgggtctgtctaggttctcccagcacagaaatctcggagaaggcttgaccatcttggtgtcccccgcccccagccccctccagccttgcaacatgggctcaccctagcaggagaggagccccttgtttagcagcagtaccagggactgtcccagctgtgttcctctcaccttcagggccctctttgcttcagggcctcatcttgccactctcggtctcagaggaccttccctgtgcttgtggctttagatgatgtgaccagaagggcagcgactgcatcaaggaacacacccacctgactgtagtgttctttaaccccaaggccgaccttgaccctgcaccaccctgcaccttccagccccagcctggctctcctcctggctactctcatctctaggatgacagtcccgggcttccatctatgtagctgggtgaccttactttctctgagcctcaacttttccctctgtaaaatggggatggcaaggattaaaggatgtaacattatatgagacagacaaggtctggcgtctacacagtgagtaatgctcccatttgccatcattaatctcgctgtctattttgttgttctcgccatgcatcaccgctctgcgcttttgtgctcgcccctgccttcttctggggaggttccgaggactcctgtccgctctgtgaagtgaggttggtaccattgtctcaccagcacctgctccacctgagctcctcccggggtctcagtgggactccttcaactctacccaccttgccaggcagcacgggacaccacgcagcatctggggacaggtcttaagctgaggggcactgctgtgtgtgccctgcttggcagaggcccagtcttcctgctccaggtgtcttcctcctcccaatgtcctcctcctcctcctcctcaggaagactgactgacacttgtcatctttcttgacttctcagtcacatctcattggtatctatcttatccttccaaagaggggaccagctcttgaggacatgaattctgctgtgtgtcttggtgacccaactgagcttcatatagcaactctggggtgcagagcacagcttggggagcactgtcgttctagagattgttgagccggtgactcaggacccctcctcagaagctccggtgcggctttcgctgcttcccgtgaactggatagcagctccccctcacccatgatctcagcagggcccatccttgagcttctagcctttcgtggacacatagctctctcgctgcatttgaagaagagctgtctgtggaaaatggcacgtctcagacttgttggctggtggctctcagactttcagagcctccatttcttctatgtaaaacggcggcgggggtgccgtgttgtcaggaaaagttgtgaggtcctgctacataggggctgggctgacagggactgatcatgggtggtatgcaggtcattccagtccagcgagggttgtccagggactcagtaccgggaaagaatgcaggtcatcctgccctagagaaagggccacgcttggggaaagctatacgccttgtgatggtgtgccccaattatcaccttatttgaaaaccaaaatgggagtggctcagagcaggatgcaagtgattcagtgaggaccctggtctgaccctgtgtcctggtgtcctgctcagctcctgggaagaggtaggcaagtcagatgtggtggcttcagggagttttactggggctcctgggctggcctgtgcaggtttaatatggctgaggcatcggtcatttcatccctgagaagggtggtgagtaagccttgcctgggaggctggggccgctgtacacatctgtctttaagggaagagggccctgctgtgctgcttaaagtgtcacagacaagaatgggtggcctgtgtgtgactgatatgcatcctacacagacaccagctgttctgctgagaattggagaatgaatatgctttttattatatagtactttatgcacacaaagcaaacacatcatctatgggatgtcataacaagatgaaaccttgtgcttccccacacccggaagaaccagaacatcagcatctgtccttaggcttctccctccccaccccatcaccatctccttccacatgtgaccacatcctgattttcgccattttataaagagagatggtggagggggtggggggaatgtctctcacccagtctggaactcactaattaggctagactatccagaaagtccctaaagattctcctgttgacccttccccagtgctggagtgttaccaccacacttgtttgcatggctgctggaaatggaactcaggtcttagcttacaaagcttactgatggagccacctcctcaggccctgcacagggattccatgactgagataaaaagccggctggatgtatgggcccacacctttaatcccagcactgcagaggcagaggcaggtggacctctgagttggagttccaggacagccagggttacacagagaaacactgtctcaaacaaacaaacaaacaaacaaacaaacaataacaaaagataaaatgtaacctgagataagaatgcccacaatacatttttcactttgcttgttaaaaaaaaaaaagagagagagatagtttgtgtgtggtcttctgtggtttcctcttctttgtcttattttcgagatgggggggggggggtcttatgatatagacttagctggtctggaatttactatgtagaccaggctggcctcgagctcacagaggtctctgcctgccaagagctgggattaaaggtgtgtgccaccacatctgtctttgttctttctattttttgtttctaagttcctcattgttcctgagtctttctatatttccttcattttccccactgtagagtagtcactgtgtctgcttccttctttttgtgtacacaggagtctctctgtgcccatggaggaaagctctccctccatacacttgccttggagtggagcagtaggtcctggctgttgaatgttcttagagtgatgcctagccattcccaaacatgctcctatctccttcctctctttcctctctttcctctcttccctctctttgcccatgatcttccaaagctttttcaaactcagagcccccgttgtcccaggtctcttaccagcttggcttctgcctcgcccccacactgcacatcctccagctcttcggagcatcatttggatggagcactaggtctcaaagtgtgtctcatcacactggtcttatgtgatcctgctgggaaaggcttctagggacaagtaaatttagaagttagccttgcttgttggaatctcaatgccaccaggtacaccacagaggtgacccttgctttcatttgtctagtctttccccaaaatagctagcccaggaaatcctcctgcccctttcaaaattcagtttggtttttatggtctttattttcccaactgggaggctgcgattttttgcaatgtatattttttttaacattctgcatgaattgaggaagtttagtctagtatctccatcgcttgggggtctcgagatgatgaatgaaaaagcataagtggtgaatgaaggcagcagttagagaagcagttggctcgttgctctgtggtccagctgggtctcttgtcctgaggagtcagaagctatggacaacttgaggttgtttggcccgtgtccaaccctgcctacagtgtttctacccagccttcctccaacacccacgtggaatgagtcactcccattaagcctcctgtcactggtttgggggcatctgtttcatagggaggcctgaaacccttgcaagggcagaggctctgttccatttgccccctaggttctcaagagtggctgcttaccctctggctggtggatgagtgcagtcggaggaggtctcctgtgtatccttgccagggactagagggtactatgacagtctgcaggctctggagtcagaccagatgagccctcatagacctgccagtctccacgcctcagcttgggaactgggcatcttctcttctttccacccacaattactctactgactctgggaacagggtctcactttgtagctctggctggcctgaaactcattatgtagaccaggctagccccaacaattatgacaacctcccgcctctgcctcccaagtgtagtcatgttccactgccctggctctttgtttggtggagttctgtttgtttaaattgagacaaggtctcatggagcgtgggctagcctgggactcactataccgtggaggataaactctgatcttcctacctctctctacaagttctgggattaagggagcacacttagttaatgtgatggtagagacagaactcagggttttgtgtgcatgaggcatgaattgagctacagccccagactgtttgtctgttttgagacagggtctcatatgtagctctggttgcttgccaagtaaataagacttgccttgaacttgtggtgactcccctgctgcagcatcccagatactgggatgtgcaggtgtgcaccaccatgtgtgacattgctgggttttattttgatcctttgttcatccctacaaactagaacccataacagtgcttggttgttttggggttgggaatggagggagcgaacctacaggtaggaacttgggaagcccaagggtagccaggactttcatggctgacccaggaagctcagtatcctgagaccaagatctctttgacacagcgtggctagagcgtcctgtgctgtagcagtgtcctagaatggagggctcacagggcgtggcttactgccgtggtcctcagcctcctgcacaggatggtgtgcgctgggagatgcttgcacacagaacatttgaatcacttttccctgggcttagagcgccaggaggtcagatagcagggcctgaggatgctagaggcccacttaccattctcaggcatacaccacttggccttgaagtcggggaagctcctcagacctcattaacctcctattgtaaggagcctcaccagctccagagcacctgctctcttctcttcgcactggtcagccttagttctagatctgtcttccctggcctcccaacagaagagatagatcgtggggcactgcagacaggctgaggtgaacgtctgatgtgacacacggatgcctggggacgttcactggggagcagagaaacctgggcatttatttcatcccaggtaacgagctgtagtcccctccacaagggagaacagagcaggggtggttcagaggggtggaggcacgtaggtgagattgccaattgggtgtccaagaggcaaagatgtcattgaaatgacagagccagagaatctagtagagggagactgagatctttgcggcagaggaaggaagacattcaaagcaattcacagaccactggtcttctgagagctcgggtagtgtgagaggggaaggggagatggaggtggtggtaggctttatcctttctgcagcggtacaagctagaacgcgtggtaacagggtggtatgaatttccccagaggtgtggaaggctcctgattggtctgattcctcagcctcctcgtgagacactccatcaggttggacctgaaagtactcagatccctgccaaccgccatctttcagactcacagacagtctccacattgctgcctgagggatctgaactcagtagctgactgtcacccctgtctctgtccaccttgaccctgtgtgttggtgtcctacttacatccctatgtccaaggctccttccttttgagagcagagaaatgtacacagagcatccccttttacctccttccttcttggtccaggtcccacccactgggaataccctggatatacctcttttgcccccagtgtgtgtaatacatcaagggttacactcggttggaaggaaaaaatgattttaaagcaataacagcaacaacaatgccaagtgtggtggtatctacctgtcatcccagcatctcggaaactaaggcagggtaatttccataaattagcatagcctggtctgcatagtgagttccaggccagccagagctacacagtgagaacctatcttaaggtaatataatttaatataatataccactcccctatgtgttttgcaacccatcctgccatgtggcccctttctgtgggttttctcagctctgcttggaagttgcctgtgtccttgctattgtcctttagtccctgtgtgcatagccctgttattagattatacagtcctccgggtgaggggccatgacagcgttgagttagtgtgggacacattttgggtgcagaataagtgaattctgccagaatgagtcattagcggagagtggatggaggccgttagacacaatggcagcagcataggaggcgagatgaagccattcagacccctgtaccttctgagtctgccttctcgttggtgcagtgcattagcctgaaccccttggagcttttgaaagaataaatctcaatgagcaggttctggaaaacagctttgcagtctcaaaggtggccagctcccctgagaagcccacatccacactggttccgagaaccctcaccttctgggcttgctatcttggaagaggcccagtcacctagaattctctgtggttatttgaacccatgtgtcaacccttctgattctgggacagagctcttttgtctcttgaggatgcctgggacatggccctgctttgatacagagacataaacatcaagggtaggaaatccacatcaacattcaagagagaaaataccagtaagaaggaaggctccagtgtgagtccagcactcagcctgaacaacaagacaggctgggtgtctcagctctccactgacacactgtagagtctcccaccccaagaagtcccttcttgctttcttagcagcctcagtatctccatcaccagctgtatgatcccaaacatattacccggcctctagaacctgtgtcatcacctgtcaagtggagataataatgtcgttgggttccttggcaaattaaaggatgtatttcatgtaacgtgctttatatgataccgggcacagagtcagggctcaataaatgctggccttcacaaataataaccattgtgagtgccctggagatggtttcaccccctccactcccttacaccagagaacaggaaatcatttcctcacggccttcttaacaactgtctccccaaataagtgcaccctatattatcttattcaccctgagtgtgcacctgtaaagcggcccctttattccatttatagctgtttccacaaagaggcccccattacctcatctccctctgttttgtgggctcctcctgtctgtggccactcagggccagtgtgggttctgagggagccttggccacaggtctgtgttggcatctgccctcacgcgcacacacacacctttgtagaaaagtctataatttcttcaagctttgtggcacatgcctgtatatctgtcaattcaaaagactgagacaaaaggatagaaagtttaaaatgaactatatgtctttaatcccatcactgaagaggcagaggcaggtggatttctgtgaattcaaggccagcctggtctatattgtaagttttagatcagccccgactacatacattctcaccaaagggggtaagaaaatgaaagctcagagtgggtcggagagcttagtaggactatctatctctatctctatatccatatctatataattggaaagggctgaggaggaatagccttgcagttcagtacttgcctagcagtgtgaagtcttgggtttaatctccagtactgaaagaaaaaaaaaatctattggaatttctttatttaaatgtgtgtgtgtgtgtgtgtgtgtgtgtgtgtgtgtgtgtgtgtgtgtgtatgagagagagagagagagagagagagagagagagagagagagagagagacttttgtatacaaagcttgttcttctccagaagaaatacaacaagacatcagactatagaagcagaaatgcctgaggtatcagctgggccctgcagcctcctggggtgacaagattgggcacagtgagaggacatgggtgaacagggagggctcagcctgcagaatgtatcctttccccgctgggttatgcacaggaactcagaaagatgtgggtccctgtaagaggcacatctggagaccttgaacccaaaacttctgtggacagccagcatgtctgggagctcctgtactcaccaacatgtaaaccccacagcaagactcagcaatctgggtgtagaaattaggagaagggaaaactctcggaggaagagagatgcaaggaggaatgtgggcaagggggtggggtcccccaacagtgccaaagacaaggtttcttttgaaagttttttcatggtgaccttccttttcgaatggatgttagttagcgagcggttagcagtgaggctcttaaactccaagcttggagccgcctgtgatttatacctggcctatgtagatgagggacatgcccaaacacttttcgctcatactgctgatcaaaaacagtttggctgctgcggctgtcaagatggaggcttgagaaacctggagagctagaatgaggaaaacaccaggcttgggaagaaaggaggctgattctgggtaccaggatgtacggcgtagggcggagcagatagggcccagcgctggagccccatgagcggtcctagtctcctttggctcttggcttgctccttgaaatgaagcgaagacccactgagcacccagacttctccatcctatggtgcagacatcagactgtgaattctgtgtgtagccagcattgaggctgagctgcccttctctgagtgctagaatacctagcgggagtcccgctagcagctaggagtgtggagtgggcactcacaaacccagagaagaaaggctaggcttggtggagaaactggaagcaggagcccaagactggtggatgtgaccgtgtgggtgcggggcagggggtgcgcaggaaggtgttgaggctcgctcccgggaatgggcccgggagggaggagcaggcagcgctttgaacttgcgctcagcctccagaaggagggcgggggaagtccaggtgccggccgggctgctttcacctgcggatccttggcgctttgggggacgaggcgcaaggaagacctcctgggaatgcagtggaaatacccaccttgaaaggcaaggagcgggaacatagccctgagcgccgggtgtggcgctgctcccgcccccatccctacccgcctcacgctgcagcgcgcacctgctgctggtgctggtactggtgccagtgcccattccagggcctccccgacctgttggtgctcccagcatctgagccatcaaggttcctgcccacaggtttcatctagaagtccccacaaatgagttgggagttttctattgttcttcaaacttttattatggcaatcattaatgaaggctgtggatcttgcttggagatttagggctggcagagcatgctacaagggcctgatgttcgttcatcatcacaaagcagccggggaaatgaactaggaaagtcgaaaggggggcaggagatgtcgctcagttggtggagtgcttacctcagcatacctgaggccatggttttgataaaccccatcctacttggatggggagtcagaaaggttatagctagtcctgggtcagtcagcttattctacatagcaagttccaggccagccagagctacataacgaaaagtagaggaaaataatataaggagcaagagtttacacaccttatagtgccaccatttaaaaatgttttaaacgtgcacgtttgtgtcaaacaattacaaagaaaattctattccgcatgagcgctgagattccgatatgtaaggctgcccccaccccatcaaaccgccatgctggttaacaagacgtctaagaattcccgatgattcaggttgcctaggtgtcctcctctctgcctttacccaaagggttttcaacgcaggctccactcatttcttttcccttgtcttcattttaatctcaaagtaattcattctccttatgcccaatacactggctcttcagagagctatggtttgcagtctttgatcatgtgacctgttctcagatcatctgcctgcttctttagagtcatatgacttgtgcttctgtctctcgtcttcctgacaactgagggttacttaggcgaaccgtctttggctggtgagctttatggaggaggttgggtaccccacattgcgccatctccagccatccagctctcctgcttctttggaggtgtttaatagggtttctgagtctctttcccagatgggctggtccagcgggttaggactggagtccatgtgtctgggttttgcaaatctgcccctttgctggctgtttaagtgtctcacctgccttcctggcctcagcagtcagctgggcagtgctcatcctgggccctccaaagggcatggggagggaggtgtgggaaaaggtgagttctcatggctctggctcagcagatctgaatgtctggatctgggagttggtagttcttatagattataaccacgcctataaacatctgtatgctctcaacatctagcacacagctggcccagtgtaattgtccctgaaatgaagatctccaccaggctggtggccctcaatgagcccctagaaagatggtttctggtgtgagcttccagccaataaatagctcagctttctgcatttgaagactcagagaaagacttccccagggtgtgcagcagttgtgagaaaagtccagagagccagcagggtgtcttctgctctcagcttgtcatggcagtagcctgagtggggaggaaagactggggaggtcagtgggagcctctgggtccagtccaagggggtcctgggcccattagaaaagcagactctccacttaagtagtcaccggtgagggagggaagttgtcctctgaaaaacctcaacttttagtggagagaacggctctgtagacagctcagtagagaatgttcaagatctatcttcttctgacaagctgaagagatgaccaggaggaacagtttcaatccagaggggatttttctaacctcagatcttgaggggtgactaggagctcaccgtgagatgaatggccagggaagctgttttgtctttcaccagaacttggcttgaagggaaagctctatgagaactgggaatggttctgacctaggaaccagctgtctgctttcccagaaccattagccaggccctgccaagccctcacttcactgcacgtgggagactgccctgccggagagggtcagcagggaggaagtggtacgccgctcaaaggaaccaatgaagcacactgggcttaaggaacgtttatagttctgattggcaggtcagtaggcaaagaaataaatggcagagcccggagagaaaaggatgtgacctaatcaagctgagcttgaatttcaagccgaaagcacaggccagccagctctcagcctctctcccctaggcactcctggcttttagaattcctaccccaaacgggactcctcacacttggtcaactacagattgcctcttctgcgtagaatgggaggccccatccaatgtatacagagcaggagctgtgctggtaacagaaggcgttccagtgtgctgacggaggctcggtgaggcacagaggagttctgtgaggtacgaggagatggggctctggctcgaggttcaaaggcctggaccatcctcctttcaccttgaaccagtgaaggacattggatgagttacatcacttaaggggtgtgtgtgtgtgtgtgtgtgtgtgtgttgagaaaaagaagttaattgtcccaccaacctttggctttgacattttatgacttgatgctttcatgagtagcctctcaggcagctggctatgggaccatttacaggaggcttcgagtggctttccagggcctcttacattctgtctctcctccagcaagacataggccagccagggacacttttcaggcagaaacttctgctcagcaagcctttattattgatcaaccttcacgcagaaacccccgttctaactaaccatcgcttcagggagggtggacatgcccccactagaaaagactaaatgcagtctagcacagtcatttgcaactgcaagcaacccaagcaggcctttgatccttgatcatcttccctgtgaaacagagcctgcctaactgtggcctctggggccacaaaggcaaggatcagacctgctcagtgggggtggggaagggaagaacatggggactcacttgggaactgcttggttagaggaaatgactcagtccttgccctaacctcctggaagccctgtctctgagacagctggcacttctcagagagaccttcttggggtctgaggtgagaggcccctgacctggacctgctatctggatgttctgggctgagtttgcttctggtaagtctttctagagaaggtagactaggccaggctgcagaagcccctgtctccttctttcttgccttccactctttccccttccaattctctggatctctccctctcttcgtacagttaactaattcccttacatcctctttaggacccatcagcctgcttcatgctccaacccctaatttagccaggagggacagtccttcctccgttctccactgtgatcaactcccccttcctatgaaatggggtgggggtggtggctcatgctcaggacacctcaaaaaacaggtttcaacatttcacaggtttcaacatttttcaggcggacttgtcacacatcttatcagatcagagccttgcaagcaagccctcttcggcacagagtagatgccggtacattccagtcacgctgggctccctttggtggaaagggttcacccagcttcttagatggaggcaggattgataccacttccctctgatagggtcacccctaagagtgacccccgactgcatgtttctttccatatcatcttcttcgtcccatagatgcccagaatcccgtctctttggggtccccagcaagtgcactgcttcctataaaggttccactgggccctgaaaggagcttctagaagtatcgggtgaagatgagtctctggggttacttccagagtgtagacagtcttttggccagcagagccagtaaagttctgttgtttgagctccaccgggacctcaggaagagaggaagaaggtcaccctgccctgctcaatggctgcttccttccagaagtaatggctttgacattggatttccctcttcacgcctgagagttttgccccatgatgtgggttgccagcctggtatcacccttccttcatgttctccaaaagactctgcttccctgctcctgccatgataatgatagccttggcgacgtggcgaagacagccaaagcccagaggctcagagttcagtctgagaagcacacccggaggctggtccccaggccacagagagcggctgtagccactctcactgggtgggaggccaccctgggggcaaactccactctgtttgtcagaaaggagtctccacgggaggacctggctgtgatggcaagagctctcacctagggaggaaacagacaaggaacagagcagagggagagacattgtgatggctgaccgcacgtgcaggctgtttgcctctgtaagtgctgatgaaacgggagccaggaacacaggcttcagccctagccgtgtgaggtttgggcacaccatgctgttccggcgtcactcctccctgcctggtatatgatatcaacagtcccaacctgagatttccagctagctcagctttcccggggaccttttggaatcttcaggtctagagtgcctttccactgtacctcctgagcagctatcctcaagaggaaatgcctgccttctgggttcctctttgggctctgcacttggccatggtcttcagctgtcactgtccccaagggttccttttcccattgtttctagcctcttacagatgccatctccatggtcaccctcgttcagaccttctacatcccttctctttgtccttatccacagccttctctctgttccctgaagccttcatcttgcaatggccagtgggcccatccaccgccatagcctgttagcctctctggctcacctgaggccagcgacaccaaggcctctggtggtatcgatgtgttgccaggtcctcgaatctccttagtgccaactgtcacaccagccttccatctgtttcctagcttttgatctctagtgctgcccttgtcccattgtaggtgggagatagatcaacaaaccaaagtccagctctggatgcttcgagctctgccagcttgcccagagtggtataaaacctggcaggtggggccccttgccagcccccctcctcctgaatagtccaagacgtcaggtgagcgataaatggtaacatgggtacaccagctgttgtccccagcctcctagttcgaggctgctctctgttccaggtgcttaagtgagcccagctttaatcaccaggtgtgtagctgctcctgatcacagcagtggggacttactggccccaccctgggagactcagtgttcttccctatgctatggtaacgatgactgaggacataagtgacaagtagccaaagatcatctcctgctcacgtgtggcatccacagtaccctgatctggtaggtgcttgaagagggctcgttggcctgccgttgacagatgtctcctggcctgggtgctcctccgtggggcttcattcatctctgtgttcctagcacctggagctctgccaggtttggagtcatctctcagtaagcgatgttgagtgagcagtcgctgagtgactgtgtttaccaaggaaggacttgagcccagctgccgagaccaaaccctccagttgcttatcctcgcaggcccagactcaggcaaactggaaactcagccctgccctgggctccacccttttcccttcagcccctgtaatgtgagctaaagttatctctgttcccgatggatccagaaaggcagatagatataagggatggagagaggtccgaggacttcccatgactgtgaagggcagcatctaggttccctttgtgaactgacagccatggtgtcactcggaaacagccccttcttggtcatacggtgctgggaaaggtgtagttatgtgcagagggccctgtgtgttccagatcagcatggattcttaggaaaggtggcggcagatgcatcatgggatttctccctccttgctctttattgaagcttcctgccatggtgccagggctcacacagggcccgtagagactctagaagctgagagaaccctggcccaccagactcagctccttcccagtcctgagctttgtcctctcccttgtaataatcagcagctctaatttccctaagtggaacggcgatacttgggttctttttgtccatttctcatgattttcttctggcttctagaagtttccatattgcccaggaggtagagttctactggaccaaaagtgggttgggcttctgtctagcattgcctagaagtcagcagacagaatacctggttctgtgcccttatggggttttgggaaaccctctaccttcgtctccctcccaatgcctgggcattttatttcatgagagcctaggcttttggatcagaatcttgtggttatctctgagatcaggtgggtggctacttatcactgtaagaaagagaagggcaaagaatccggtgctcccaagaagagtaagactcatccaaactcatcccaagactaatagatgagccagagaccttctccctgtgctgtggcctggaaatacactctgtccactctgccaagtcccagagaagcttctgaaaatgtgtctttatcacaccctgggattcacaggaagggacagagaaagagcttgttggcatcgaggcaggggtcgtggccatggctgctgacctttccaggcaactgagcttccccgtgaccctagctcagaccagtgcctttctgaaagttctctgaaattaagggattcagagttgaagagatggctcagcggttggggactgactgcttttaaagaggacccaggttcaaatcccagtacccacatggctcacagctgtttataactccaagacctgacactctcacgtagacatagatgcaggcaaaacaccaatgcacataaaataaaggtaaataaataaaaacttttatagaaaaaaaattgagggattcaggtagactcggtcctggtcatttcagctattactaattgtataaatcagtgcattaggtaagttccaatgtcaggcaactaccactattatttctagaacattctcttcatcctaaacagtcattactgtggagtatgagcctacgccgagactgctggatcctgtggtatataacaaattctctttttaaatgttgtatatagaggaaaaggagggagtttgtgcttgcatccgtttccaaacaaaaatagttcaccattaaggcagcctgaacttggtgacacccccaccagcattcaccatctccctaagctctaagagcctgttgggaagctcaaaacttaaaagcaaacaaaacaagctaggctgggatacagagaaggctccctggtaggatgagcctggtgtaagcagacagagccagcctgatctcagcagggactcagtcatgcagagggatggcagagtctgtgggtctctaaggctccaggacacctctttgtaagtccctgcagcagctaagctgccctgagttctctgactagagatgctggggctagagatgctggtagactgccttctcagcaggcacaaaggcctgagtttgttccccagtactgatttaaataccataaaatcgtgagaaatggacaaaaagaacccaagtattgcctttccacttagggaagttggtactaaactggatgtggtggcccgtgccaacaatcctggcactcaggtagagccaggaggctcagaaattcaagatcatccttggctacgtagggagttcaaagccagcctgggatacatgaaatcctgtttctaaaacaaaaacaaaacaaaaaaagtctgtatttcatgaaaagtcttatatatgtatatatacttctacatttgaatgaagtactaacaagccacgtatgcattctttcggaactgctgcagatcttttctccattttccttctaattaattacatctgtaagtaaaaaaatatgaatcaacccattggaatggttatgtcgaggttggatgagcacatctgcagtcctggtactcaggtgtctgagacaggaggattgcaaagccaaggcccgcatgaaccacagactatggccatgtctcagagcaacaatatcttgggctgtagtagctcagcagtagagcccttgccttagcatgggtaaggtcccaggctccctctgcagccaggaaaactgtctgatcttgtcaccatgcacacccacccacagccctttgcagaacaggtgacaaagaactgggtgtcagtgggaagctgacagggccatggggatgtttacagtctggcctaattggacagtggcattggtcgctatcatcagcctaagccttcctgacatctatggctcatccacctggctgcttgcgtctgcctgggcctggatggtaggtggttgggatgaagacgagctgtccctggggctgaagacaacagaaccttgggtagagcagggcaagtcggggacagaagctgggtataaatagtccctgcccagctgggcaggcctggcaagccctccgtcctccccctcaccagctgccagtgccagccatgccccgacctcctttgggagcctggtcaccatctcagatcctcactggaggaagtccctcagcggaactgaggagtcttgtcctgtgtgtgggcgagacctccggctgcccgagtgggggcatcaggcaggctcttcggggtgtcctctattttcttaactggaaggccaagtgtgctggtgtatgtgtgtgaaaaatcaatagctattcctctttgtgtgtgtgtgtgtcatgctgcaaacaaatgagccagccttctgtggtgagaaggggagaagagggtacggggacactagcaaaggttacttctagcttgggagctcacagaagtctttagaagtgattcagggaaagtttgacttgggtatgggctgcagagaggcactcaaggagagggctcagcatgcgtgaagggtgtgaagctgtttcagctggcctcaaggcaaatctaatcaaagcctctcacagtggggagatggagaagatcaggagcctctcctgttgactctcccaggggcacaagctcttctgtaacggggacaagaagtgggttacactgatatgtctgcagcaatggaatgtcagccatggtgtgtgggcacggctcagggccggcagggcatgtcaggggggacagctgtcctgcagaagtcaatcccaaggccatagcctcaaggctgtccatagatctgagccctgtccccagaggccctagctaattaccacaggatatccagatagagcttgttgagacctctgaccggagcatcctggaaaccctcccatgccccttggtcagtttgaacatgcatccaagtcacacatggctttgctacgctcagcctgtcagtcacagagggatttgcttggccagccctgtcaggactgctggtgaagagactctgccgtgtcttggagccttcctcctcgtgcttgatgggaagtggctttagaaattctgatgtgctgtatcaagtcagggaactgaggctccgggaaatgaggttggcgacccggcagggaccaagtcctgagagcatggaacctgaggtggctgccattgcttgagggatcctgatgtgcatggcactgagctgtacatgtttactcttcccgcaagctctgtctcacagtggaagaaagtgtggtgtggagaagttaaggaaatcgcttggattggcagcttgaggcaggcagagcccgatgtgagctggggtgaagagacaggcttggaaggaggagggaacctaactctgggtgacaagtgtctacactgaagcccttgctggggtttcctttctagtgtcagtagggcttagggatgagtggcaggccagggctaagtgctggcttagtgtgtgagaatgagcttgatcaacaacactgcagagaaagggcctggttgggggcaggggtctgtagggaaggaagagaaaagacaaaagacatgccaagagggaggctcaactctggcactttacgacccacaggtccaggcagcttacttagctcccttgcctctgtttccccgtctgtgaaatgggatgatattgatgatgacactctctttacctcatagactggttgcgaggattaaatcagttaaagacgtaaacatttcaaactgtgcccagctcaggtcagatatacatccatgttaggtgtttttgcggggctcccctatgcctttatgtgctgtgtggcttcaggcgctaggctcaccattgtttctcactcaaacgtcagcccaccagcgggtaggcaggccaggcctgaagccacccagctccctagggacccagacaagcattgcccacgaagcagagggaaggcttgcctgggagccaggtagtctagtttctaacagcagatagaaactctataatctgggcagctagtaaagcccccactgtgtgctgggttgttatcaagcaactcaaggaagttagtgaagagttggtagtgagccgtgatggtgtgacactaatgcttcagtggtcacctcattctttttctctcactcttggccagtcccaacaggagacagtctcttgtagcccaggctagcttgcacctcctgaccctcttgcttctggctcccaagtgttcagggattactacccaccttcctagctttcccttgtcaaaagggcccagggctctggttggggagagctcagtgggagatcagttgtctggcaagcttgaggctttgagaggtggggttggggactctaagctcaggacaaggttcttcaaggccaccaattcaaacccccagttctgcctactcgcactctctcttcccagtggggaaacctggacttcatcccctgacagctgaggccagaggctgctggaagtggtgctgctgtgtgccatgttttgctggagcctctgagcagagcaaccgaggctctgggtgttgagtgtgggggaagggtgttgggaggcagctcacagcatactctgattagactctgatgagccatatacctgttcccaagaagcctagggcaagctagtttgttctggaaacccagattcctcatcaggggacagagatgatcaaaagctgatcaagtctgttacatccaaagttctaagcaactacagagtccctcaatggccgcgttcggttcacccatgccaacgaagcttttgtgtctcttctgacctaccccagagtttgcccctggccctctttccaaggctcctgcatccaggacttgaccttagctagtgcctaggtctccttcttccaggacactctgccctttattatgagcctggaagagggaaggaaaaggtagagtttctggtagtgccttgctttttctacagtagttaaccctttcccccccgagtgtacttaccggcgctgtaaaatcccaagggttgaaatgtaagaggtacaataatggggtggcttgactgaagtgagaaggttggggggatgcctgctgagagtttccttttgctcttgagttaaactagtcatcaaacggagcctctgtcgctagtgagaggggaggtggcactctagaaacttctagggaactataaagatggtggcggaggcccttgtagacagagcacttgatgccatcagagacaaacaggctcttggtgtcctctgtactcttggggaagaggctaagagggctttgtggggagagagagagagaggggggagagagagagagagagagagagagagagagagagagagagagaacactgtgctaagacttatgctcccccccccccaagatggagctgtgatcacaatggcctctgcttcctttgtcctttatatttggattccttcccatgaatggctgttagtctccacatgacccacgaatcctggagtccctgggagattgctctgcaggagccctgccatctctaccagggcaccggggcccaggcactgggcagaacttgattcctgctccaattcttcatttccaacccagggttatttttgtggcacagtacagacctacacagtgccccctcccccagaggctctgctgctccacatgcccatgtcagagggacactgcttgaaccggtgccgtgccctttgtgggacaccgtgtccccaaggaaagtcagaaagcagcacacaaggtgccaggcttctcagagccacggatcatccctcccccaccccagcccatcctctgggaagaagtgacatccatactaggccacgtgttctgtgtctacagtgccatctccattgtctgcctgcaggtccctggccctgggccagcagtacacatctctggcctcccagcctctgctctgcggctccatcccaggcctggtccccaagcaactgcgcttctgccgcaattacatcgagatcatgcccagcgtagcagaaggtgtgaagctgggcatccaggagtgccagcatcagttccggggccgccggtggaactgtaccaccatagatgacagcctggccatctttgggcctgtcttggacaaaggtacttgcctgagactcggtgggaggtggctgggagactgggggtggtgggaagggttctggggaccctgtccccttcctcccactgtgggaaaccctgagtccaagttctccctaggagggtaataaagctggtggaaagtgggtggggtccatctctggacaggacaggctgtgtccacatcggctacatcttttctagtgctacaggggggtgggtagccctgaggtgccccagtgtcctgagattggagggcaggcaccaaggagcccggagccttccttcccggatgacacagtgggggcccagtctttgatgtagacatgtgtgacatttcccttatgctgtgttaagtgctatgcaaatacagcttgggggtgggggtgggatggtgccaggcctaggtgttgtgccatggaaaaagtctctatgctctgtcaaagctgtctggtgctggtagcactacatgacccccgagggtcccctgagagttcctgttggttcccatagcctgaaagcaagacgcgtccattaaccctgatgtcctgtggatcacgctcggtgatctggaagtctgaccagctgtgaccctagtggatgaaagccggcttttgactttgcacatggggcataggagagggttgaatggggtaactgctcctaagaaggggactttggctctagaacctctcctgtccaggaatttaacggccttagctgggctggcctcgactggagttttgccagccgatgggggcgagcctgctctgagaaggttcgtaaaagctgcattcacagccaaaagggaggagtccgagagctagcgggagggtgggcgcagagtttgggagaggggagctatcccccctcctttggagaaagccctctccccctttacctgtgcttcaagtgcaaagtgtctgtacaacctacaggcagaaaacgcaggctattgtcgtgggacaggagggcaattagcaaatcaatggatgatgattctgtttacgcttctaataccaaagctaattattccttgtttacataaaaggtttggcctctaattggggccaagtggcggcggcggctggcttttcaaaactgatctcgcccgcctgttggtctcaccgccttccggcgccccacctcagtccaggtagcgtttaatcaaactgccaggcgtcccgacgcctcccccaaagcaacactggccttctgatcactcctcccacccaggatagtgtccatcgagacctttcagcatgatacccgctcgcagtgggtctgatgtttagattcgcagcagtgggttgtgccacatgcctccgtcccacagcaagagggcagtttgtgtcccagtgtgcaaggaaatatggggctgagacagtgggatttgatgaaggcagtggggtgaggttccaggaagatgtacccgcgtcccggtaccctgtgggcaggcggtgggtcctggccacttttgcgcacgtcctagcaggtgcggggtgggcggccggaaggcgcaaggccgcggtcctccgcggctccggagggttcgagcgccgccccccgccgcgcgcccgctgcggtcgccgcgcaattcacacgccctctggccgccgcctcccggggatcgcgctgcccggcgccggggctgggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctaatccccgccccgcccccgccacccccactgccccggcgctgggaactgagcgtggcggggccgggtcgccggaagccaggggcgccctcccctggggcgagagggccgggaggcctggatcaccgccgtgcgcagtcccccccggcttggctggactgctgagccagctctcgctccgcgctccccgccgggctgcgggaaaagtgggacgcgcccctgctgtgcaggtggcgcacgagggcttcgtgtctgcaaaggctgctgtggctactgagtatctggttccctgcatattcagcacgggccacgacctaggaaaggagatccggctctgaccacctgtgcagtatagcacgacccgctctgggaacctataaaaagagatggcccgggccgttggcctcgcccggccctgtctgtaaaatagggtttagaacattgtagggaataaagcacaggaaagacagatctgcgcgtatgcagtactcagggagtggctctcattgtaacaaggctggtgatgcccgctgagactctcatctctgaaccctgggcctgaggccgagaaactgccttgtctcgaccctcgtggcttcgtaggaggagggcaagaaatgggcagccatggctgaagatgctgcacctactttacagagtgtactgtgaggcacagatgagaaatctgcctacggggaactgaggttcgagtggaacgagtggattagtaggttttaggctgcaggttccagtctccagaatggaggactcagaactgttaggaggagtgtttctgaatgtgcaaggttggaggccaagagcccaaggacagggcgtggccaacctaactcttcagagagcattccggtcccaccatagacccctccatcttagtagccctgcagctctgaactcagcttgcccatccacaaagagaatactaactagggtctgaactctttagagcaacaggagggcacctggctctcttcccccaatgactggtgagcctttgcgctcttccccagccctcagggcaaggctgtgtatgtaccctaaggctccaggctgaacatcttctcacaccatccctctgcagccacccgtgaatcggccttcgtgcatgccatcgcctcggctggtgtcgccttcgcagtcacacgctcctgcgctgagggaacctccaccatctgcggctgtgactcacatcataaggggccacctggagaaggctggaagtggggcggctgcagcgaggacgccgacttcggggtgctggtgtcccgggaatttgcggatgcgcgggagaacaggccagatgcccgctcagctatgaacaagcacaacaatgaagcaggccgaacggtgagacagcgacccacaactcgggggcgggaggcactccctggacccctgccttcacggccaggttcccatccacaccccatagtaaccccctgaccaccctccttcctctcttccagctgtcctttgaataggttttttaaagtatatttactcattctcagtgtgtgtattccatgttgtgtatgtggaagtcagaaggcaacctgtagtggtcagttcttcccaccatgtaggtttccaaacttgaatcatgcttgatgctgttcctggatcttttgagaaatctgccaaggagtgcagtatggctgccccataggaacaacacccataggctacactggttggcaggctgtgcctgtgtacgtctgtgatgtggttgtgggttggggactgactctgaatccaaagtagggtttccatagcatagcccttcctatgctcgtggaacacttagctctcggcctcagtttttccatctgttcaatgggaataacagtccctagtttgcaccacttctatggatgaggtgaatgtgaagcctgctggggccgggggtgtgactagggacactggtttccacccattcttcctggcaccaagtaagagtagaggagggtgtggtacagaggggaagctttctcccggtgtgtcagtctgaactagctgctgcccctctttccctagaccatcctggaccacatgcacctaaagtgtaaatgccacgggttgtccggcagctgcgaggtgaagacctgctggtgggcccagcccgacttccgtgccattggcgacttcctcaaggacaagtacgacagtgcctccgagatggtggtggagaaacaccgtgagtcccgaggctgggtggagaccctgcgggctaagtacgcgctcttcaagccacccaccgagagggacctggtctactacgagaactcccccaacttttgtgagcccaacccagagacgggctcctttggtaccagggaccggacttgcaatgtcacctcccacggcatcgatggctgcgatctgctgtgctgtggccggggccacaacacgaggacggagaaacggaaggagaaatgccattgcgtcttccactggtgctgctatgtcagctgccaagagtgtattcgcatctacgatgtgcacacctgcaagtagtgagccaggtagggcgcggggcgggacgtgggactgccctctcctcccatccgctaggcctgctcttctgattctcggcttcccaagacgaacaagttcccaaagctgaagtcagaaactaggcttcccacgcttccacgggaatggtcttggggagcgacttgacgtatttacacgaggctcagataatgactgagggtgtgcacgtcagccacaagcaattgattaaaattcttacacaaattagcagtgatgagccagaccagatttgttcatggctgctggctgtcattagtgagcatctattcggccagaagagaggttgaggtctggtcccagccatgcccctaaaagtgtcatatctcagggcctcagtttccctactgtctaaaggagaggttcaaatgtcagaaacaggggcagggtatggtgggactggcctttaatcccagcacttaggaggctgaggcatctggatctgagtgtgaggtctggctggtctccatagagagttctaggccaggactacacagtgagaccctgagacagtcacctagtaagtctctcctaaccctggggcagagtcatttcacatcacccatgaactgagagggcaagctttgacctaacacaaatcctccagagcttgggaaggtgggtgggggaagccagatctgaagcttgggtggagcgggagcactctcaccaagtttatggagggagacaggaaagaggagagctcccagttcagagcggctggggtgagtgaccgtgggataaaagcctggtggattatgcttccaagcttcccagaggtggcctgcatgcgtgggaggaccccaagaaaggtcagcctggaagcagagtgatcctagaggctctggcatgggccagtgtgacccttgtctctgtcccctcccctgagagggctctgctagtgagtctgactctcaactggcttttcttatttgtcaaccaacaactctggcttcagcatctgttaccttccccgagcagctgtgaggaacgtgggaaaccacattggttcctggaaaagcagctttctgtccatctatggatggccagcgcagtgtgttccacccagggaccttggagctggtgacacaccagagctggtggctcatgtctgcgctctgtaagggtgggggggtacctgacatcacaagcccatctaagaagttccttgtggggcttaggttccattcccagggtccctctagaaccatacaggaggcgtgggttttctttatcaaggtcaaggctggaaggaagacagcggcgagctttagcgcttcacgcgcccactgctgaacctcgctcctcatctgcgcagtgatggcagtatggggatcttgatggatttttataaagctcaagttagtgggtgtgaatgctgctctaagtgtcagggttgccatcagcgttagcacggggttgctgcaaaggaagatcccatgggcgttctttctgcttttcaaagggatgggagaaaagtcagcaagtaggaaggttgaggtggaaggaagcagaccatgacggccgccttctctggtattcactctgacaagagttagccctgcaccccccaatatcagatagtacatacatagctctggccgttttgaggagctcttggtgtggcttcttatcactcagctagaagggccatttgtcctgaccacccatgtcactgaaggttagacttgagttaatggcctagatagacccaggggtctgcttccagaagcttcctatgtaggcttgcataggcctcagcattgccaacccaagcttgatacatggggcagtgtgggtccaagatacagagcccatgactccactccgtccttgcccatgtgggcagctgagatcttccaggcagggaaggaggtgcagggtgagcctttgttgtccagcaaatcgctccactccaatccttgcctaaaaatgatctcctaagaagaattgggtgtagctgggtagtagaacacttacacccctgaatcaatctccagtactggggagaggggaaagcagccccctttcctcacattcctaaggtagacacttgctgtttttctagtatcatgcagacatgtttttaagaagctatgcccacagagttcacagccttaatcccttcccatggggtggggggtggaggggggaggaggactggactctcaacctcacacttcctgataagaaagatccctcccactgggatgtcctttgcctctcggagcccaggtttcctcctgtgtgaagtgataaggtctgtgccctgcagggctgctcaggagccagacacagccataaagagcctgctctgggctcctggtttggagccataggccaggagatggttgagacctggttccttcctgtcctttcacccccgaaggcgctgctactgatggaagccaagggacaaatgggcagggagacagcaggcatagaaggctctggcttttttcttgcacaaaggggccacagagcagagcccagcaggccacatgcccttctctgagaagagttcagcacagtggtagcatccagtcctccctaagtggggaagacaccttctccattgcttgaggtttgtccactgtctccacttagccactagcttggtatccgagtgctggtagtttacaaatatctgatttattctttttatccctatgtcggaaaggctatgaatctagtcaccccctctaactggccctgtgtcctgggtctgttactagtcttttgtgggaccttaggcatatccaggtcgtcttgctatgcctggttcagctctgccagcagcaccagagatgagggttggctgggggttggggggtgcctggggcgtggctcagtacctcagatcccacgggatagggctgtacagagtgatcatgctcaggaaagcaccctgggagggagttcaccataactaggtagagtccgtttcttttggacaattcacggcagttgtgcgtctgatggcaggcactagccctgctgtgactggtggctcagactggcaggcttttccgtctccacgtaggaagggcaatgctcccttggttacctacagtgggcttcctcagctaggaggaggtttgagttgtgtggatgcaggctctgttcttcctgaggatggcatgtcctccctcaacagcaggctctggggcgaggagggaggcagggctggcagcgtaggcagcctgtgatctttgcatcccagggggtgatgttgacagcagttatgaggtttctgattcttcctgtttatttcccaaagggcactgggaaggggtagattgtgcggctggatccattcatcgaagtcccatgagaagcaggatctagatccaggccagccttcggcactggccagcaaggagcatggactgttgccagctgcatgtgataaacgacctggacccagccggcctcggacggacgggcggcttctttctcaactaacgtctctccccctgctctggatggtgtacggctttacagaggggctttctttatggttttaccagggtctgctggggacagactcgaggcttacctttgcacatgttaaagaaaataaaaatgaaaaaaaaaaatctaccgcaacagaacaggctgggctagtgtgagctcttggcctggtgggaaggacaagaccatggcgagattctgtgtccaagctgcctctactcgtgacattccaagatgcctctgaggtgggaactgtgaagtaggacagagccccgcagtcccctcttgtccgtcgactcccatttaaattggacataccttgtcgttctgagaaaagccatagataggtgtagctgggatgtagtgatggggaggcccctggccaacagtgggagcaagatcttgagttttgaagacctcagagttctgggcggcctgggaagccatctgcagaacagagttccttgtgggctcctgttttcgctagccctgttctgccctggagcgacagtcagatctccacgcccctttctgttgttctacagtgtccacctttactacgcgttttttttttttttttcatgatgaccttgtaaataggtcagatgtggaggcaggtctcttctggctccatccaccacacccagaaagaatgggctgctctgcccttctcagccttgctaaccagcagacaccgaggagagcagcggggcaccttagagagcaatctaaacatggttggcaggtggggagggtaaagagtcccacttcctttgtgttagaaggcagactaccctgcgtccttttctcccattggctgaagtaaccagaaagacaagagatccttaacaagcccttcttcccacttgtaaaagggatagcctatctcagttcccaaggatctggattagatagatattcaaaagaggcaagcagcgaatggaggcagctcccagctctgttcccgacgcatgatggtactggctgggtttagtaaggtgggtggggctgcacggatcaatccatcaactccgtcttaaggagaatcagaaagaggagataaaatgggggaatggggcagaacaaagaatttgtcctttcccgcttctgtctagggtctgctaatgctggcttgacgaggggtcagccacttctttcctgttgtgcagttggcttgccaagcaggctccagtaggcccttgcctgcactctctaccatgtgaccatgagcactgctctagggacacctcccatcccttcctagcaccccaaatgccccttcccatctctccttccagaagttggaaatcaagtcaactggataacgcttgtgtgaggacacttgagcagaacggatacaacaatttacaagtctcttcatatctatgtattctatattaaaagtgataaagtcatgtttccggggcgtattcaagtagctgacaagtaattatttaataatagtacatgagcgcattgtaattatcctcgccatagtcaggtaatagcatccaatgggaggtccctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatttggagaaaatctatttcatcatgcagtttttttctgttaaatcattaaagagaaggtaaacttcaaatggacacattgtacgatgtgtggagtctccagattcgtccttaggtcaagggtatctgaatgttgtgctaattaaatggccaaatttacggtcatttcctctgctctctaagcaagatgaggtatgatggacagcagatgtgacatgagccttaaagcattacttgatattaagtcagtatcaaacaaggaattgccaacttggggaagaacaaacctggtcagcaattcattcatagacttgaaaaatttcaacaacgcatgttgatgtctcagatctttctacaaggttcagcccaggtcagtgggtcacagggcctgccatagtcttactccctttctcactacatacccaactccagttgttggagaaataggaattgctcaactgtaaacaaagctggaccagaaacagataacagctgaactgtggaagaggttggtaggtaggttgaccagatggtgttctgcctgtgctctgggccaagtgacaatggaattgtaggttggtttagataggttgctgggcagagctctgggaagggcactctctccttgggctggagtttcagtgactcacccgaagcctttgcctgtcatcttgatgctgtgcagttttaggatgatgggtggtccttcacttctcagacctccctctaaaatatccccttcagtgttcctttcttctggtctaccactattagagataacgtattcacactggccataggaacatgaagcagtctgcttctgacggtggggactgccaacaccttctggccctcggttgaccatgaccgcctgagcttccatttggtgcatcttttgcccctagaaatctttttccacctatgtgaggccccttgagggtaaaagcagagctcctggcttcagtgctggccatctttgactgcatttcccttgagctgaatactcttttttttttctcgcagcactctgggttttattttattttatttatttttttgactgtataaggttgccaagtatttagatggtccctatcatacttaccaaggccatttgtctcccatgatcattgtattccattaaagagagtacaatttatagctatgctagaacactagctggaaacactggaaagaacaagtttcaagttgtgcctaagtcgtgtgtgcaccttttaatttcagcatctgggaggcagagacaggtagatccctctgttcttggcagccagtgctacacaccagacttagtgggtcttaaaaaaaaggttttgagaataatttgagagaagataaagggatatggtgaggttttttttttttattgaaagcaacactattctgaaggcaggctgtgggtaaatggatgggcacagagataggaaaaggaatcgaggagaaagacagcaagggaaacgaggcgaggctgttttgggtggagtgctggtcgacctgtgtagtgctgggcataacagcacgtaacatgggtggtgtgggtctacattaggaagtgagttcagcaaaacgtatggtgttaagccatgactggcttaacagaacttgggaggcaaacagctatctcatcactaatcaatcaccaaatgttcattatggagactgtgctggagaatcataaatacatgtcattacaatttcttgtttggacatagtctcactttgtagtgctggctatcctggaaccatgcagaataggctggcctcaatctcgtgctgatcccccttcctcgctacctctgggattagaggtgtgcacccttcctcccgatcttgggattcctgcagatcacaggtgttatccgtgctctggcatcacgacacactcacaccccctgggctgtcactggggctcagcctcagcagttgtcagcaaacgagtggctttcatcttgcaataacttctaaaatttaaatgctgcttttgaactcttagcaaaccttgcctggcttcacttatttgaaggcggcaggcggcccagctgccaggcaagcaaactgaagtcctggccttgccttctgtttggccaggtggatatttatagctgaccctgcttcagcaggcctgttgaccaggctttgattattaaatgataactgaatctcctccatgattctgtaacataaggtgggaaatgtaaaggctgctcactgtaatttttaggcaataaaaagacagccttaaaaacacatcttaggctcgatagatgccccagtgttggggaatcgagggcggggaggtgggagtgggtgggtggtggaggaacaccctcatagaagcagggagagggaggatgggatagggggtttctgggagggggaggaaagtggaaaagggctaacatttgaaatgtaaataaagaaaatatccaagaaaaaagaaaaaagtattcaaaatatatacatataaaaaaaaaaccacatcttagattctagctacagttatgcatgtttttggatagtacatgaaaaaaaaatcctcaaaagaagacaaaaatgtagtaaggaaaaaatgagctcttctttggaagatttagtatttcctgacagccggtgtgtgtgtgtgtgtgtgtgtgtgggggggggtcatcagagccctccacactgttcacagggctatgctgtgggctggaggtaggaaggcctttggggatcctcccagaactggaggtgggggcaactgctgtcccccaaattgctggacatgcctcttctctacacagcatccatttctgggcttcctggtgcaaggactggggctgtggcatctagtatctgagagatccagaaggtatgaagaacagcagggtgagctcgggggtctcaggtttgcctgcttcagagaagtcattgtaccgcaaagcagcttccacccagctcctgaacaaccgagctcatggctgcagttcagactttttaaggtaaaataggtatcaaacgtaaatatgaagattctcgtacattagcatatactaatgaacttttgaggggtttgttttgcttttgtttttggagacagggtttctgtgcagctctggttgcctggaattcaccctgtagaccaggttggtcttgaactcacagagactcacttgcctctacctctagagtgcctggattaaaggcatgcgccaccactgcccactgaactttttgttgttgttgttgttgtttgagaagagtctctctgaatgaatggttcccaaccttgctaacgctgtttgcctttaatgccgctcctatcatgatgaccctcaaccacaaccttgcttttgttggtatttcataactgtaatgttgctcctgttgtgaattgtaaggtaaatacctgtgctttctgatggtcttaggtataacccgtaagttgagaactactgtcctacagggtcttgggactcactatgtagagtaggctggcttccaactcagagatctgtctcccaagtgctgggattaaaggcatgtgccgtcagcttgcatgcgtatctgtgtgccatgtgagttacagttgtacactgccatgtgaattctgggaattgaactgagtcctctggaagagcggtaagagctcttacccactgagccatctctccagcctccttaatgtttttctaaagagatttaaaaacaaaacaaaaaaaaatctcctatgctgtaacaaagcaaggaggggtttctcttctgtggccacttcgtcatgcagccccattagtgattgatcctgttccatataaaatactggtctatacaatatttcaagtatatttactctttattgcattccttcaatttgcattacacaatataatatctttttcaatataattttggacaaaaacacaagacattaacttcgttgaacaagaaacataaattaattcatgtacgactttgttgggaggagaaaggcagaaccgcagacaacagggaccacggcggtggacagggaaccacggtactagccacgggaatcacagtttcacaacacaattcactctttcaaagccacaaaataagccagggatgaaaaccccaaacaaggtatacagacggcaagactaggagatgatttgccttctactgtggggacagtgtcagagtatcacccaggtgcccctgcggcagcaagcctcccgggcggcttctgatggctgtctttgtgtttgaagcagcagcggggagagtggcatgcgccctaagactcatctccacgaatgacgtgacgacctaattgcattccttctaacccactgattaggcaaaccaccctccaaagggctcgctgagttcctcttcgggaagaggtgtgttgagtacgctggaatggatattcgagggctgagggagaggactagggggtggcttgttctgctggagagtagtgttttatttatgtgctgcagacactacagatcacttgagatacaaggaggatgaattgtaagtcatcaggctgaggaaaaggaagacgatggcactaataggcctctaacgtcatcctaaggaactgacccacttagagccggacgctaattagaattgagaggcttgtaaattattttaattttttttctgtttagggatgtacagatttccatatgtatctttcataaggttttaacggcatctaccaagtggcaatgattagcatatctcttaccacagagcaaattaattacactcagagcatatcacagccaccccaggaatgatttgacttccgattagaaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacccaaaccctattcactaagaaacactcgaggcttcctgttctctctacattttccaccatttgtttgctatttgatgggcactttctaaaagaaaatggtcacattccgggcacttaaaagcaggttccagtgaatcatggaccatcaagttttctctgctctgtgacaaggaagtcttgtgaagcaagccaaggagagcagaccaacacgacagcctgcttccttgcttggtccctcagacccacagcacagcgaggggctagtgcgtgaaaacaaggctatacaggaaggaaggaaaccatcagcgggctcatatgcgctggggaagacttgggacctcgcagatgggtgagcactgcgtgtacttacgcgccttcttctctcatgagggccaagaatttcctcacacggtactcaggatccatctaaaaagcatcggaagaaacaaatcagacgcgcgaagctgccttttctccacaatgtgcttcctccgcaccagggaggcgcgtggtcatgtgcttcctgggtcgttcagaaccatgtcaccattccctagttgttgtttcgaagcataataaagtgggttatgttatttagaagccagtggaacttcccaacacggagaggctactggtcactcacaggcacctcagccaagcaccccctgcacccagtgtgttggtgtgaggaggagaagcacaccagccaggtgtcaccacaacactagatcgtggtcactcacggaggggtccagacatgcctgggtgcattcatggtgctataaatcatgagagtttaaatgctaaaattcatatatcttattgaaggaggaggatagaacctgagaaaccaaactgaggttgattaagtgaccaaaatacagttagaactttttgttttgtttttcgagacagggtttctctgtatagccctggctgtcctggaactcattctgtagaccaggctggcctcgaactcagaaatctacctgcctctgcttcctgagtgctgggattagaggcatgcgccaccactgcctgactagttatgactttcacatactcactgaactggcattcttagctttagtgcccttctggtgacgctgccacacctaagagagcagagagtgctgttggcctcccctctccgtacacctggcctctggtagcccgagagtcacagactcaagacaaggtggtttgatccgggtgatggttcaagtcaccattactaattatctctcctcgctgtcattctggatccaagttacttcacttcaaagtgtatcatagtcttattggcctgactagggtgtgtggggatctggaaaagaataatcacaaacaaacatctctaattactcactatgaatttgtactgtaagaaacacctcacttttaaagcatgttgcagggcagaagtctgctggcaagagggaactccctgccctccaggagtggctgggctcgcaagggctcagctcgcgcagccgtgggcaagagtgcactcagactcccctccaagcaggctggaaaagcgacagttctgtcccagcaaaacatggaacgtaagtttcaaatgtatcaaagttaaggggtcagactacaaagaactaagaaaaagtgtgaacagctaacaaaagagtcattttttttccccctctatgggactagaattacacatgaatcaattgtcaaagctttttctaaaaaatggaactggctggagctcgctggagtcagtacatgcaggtcttcgcccattaactctatttaatatgtgtgaggagcgacttactgacttgcctgtagctatggaattaagagtcaagagaaaggggaggaaaaaagcaacctagataaatgactttattccctcaggtgacatccagtcagagcacatccttaacaccgagcaagttttaacaaaatcgagtccggcgagcagagcgagtgagcatggcttccattctgctgaactgcatgcctctccactcgggctctgcccctgctcctgaggcagatctaaagagaagtcactcagctgctcggaatccatttgacgtgaaggggttcaaactccaggcctatgaagtgtcagtcgctcaagattaggccgagcgccccactctcactttctacctcacacacataagtattaacttgatcactgcgccgcaggcatcaaagggagaggaggcaggggtggggaggaaaactcgcatagtttctcctatgcaattattttaaaagattgaactgaaactggaaaaagaagggcagagctgacttctgacagatttatcttttttcggggacaaagccaatacacctgtatgtatgcctttaccaggaataagcctgagcagggtgcttagtctatgacaataatttactactcataatggaaactatataaattgacttaaaaacagttgctggaagcttgggaaacttttggtttctgaaaaaccacaaaaatctaattttaaattgagtttatcagagagagagttaagataattctctccatatttcttatttattggcctaagagcttccttcagatgtgaagctggggaaccccaatgtgagcagtgggcgcgcagggctccacagtgacacacctcctcaggtctggggatggctcactcctcattcattcacttctgctcctttcattgtatctagtgaaatttattgagctctctaatacgtgctgagctggtccaggggccagcgacagtgtgtggcagcccaggggtctgaacacacggaactcagtctacacaagtgtattatgtacatgtgtgtgtacacgttcgggcacacagaggcaaggcattccagaaggagagagggaggtgcagtccacacaagaaagttccaaaccaaaatcagtctcatctgcctgtgcctagcagcaggctgggagtcagttagtttgagatttctagggcactgggcatggcggtatgagcctttaatcctagcacttgggaaggcagaggcagggatggtctctgagttcgaggccagcctggtctgtataaagagctccaggacagccagggctacacagagacacccgtctggaaaaactaaaataaacatttttttaggagttcagtgaggggaaacgcacagtcacagcccgatctgcacaagtcggccgcatccacacttccacatctcccagagctcttagccatcagtgctgtcacatgctcaccctgaaggacggagcctcagtagtgagagagatcggggcagactcactgacagactcttctcccatctgcatgagactggggacaccttgcttccctccttcccttccagccccctcttcatcttcattgtcatcctacaacatccagtctcccctcactgaaggtaaagtttaaattatcaccaggattttgcacatctccttttattgctaagtgctgtagatgtaagccctatcctaagctgttcagggtctcactccttttctctgattgttaataaggactatgaaattgactgtacccaggtcacctctctgcagcctccaagatgttgaggagcctagggcaggggtgggagtgtcttttcctccttgttgaatgtcttccatgacggggcagttgtagttttaaattcgctttgaagccctttctgattttgagacctaatgactctctacattaagattagaagtcacgctctgctctgctcatttatttctgaagagaaagaggagaacatgggtactcctgaggcctgggagaggaaagcaggccctcctggtgtgctacagccattcctgtgactcacgcagagacgggatcgccttacctgcagggacatctcaatcaacattagtaacttcttgattcctatccagactttcttccctttgacttgctgagcaattgtggtgcgttccttatctttgaagttgcccaaaagctataaaagcaataaacaacaattagacacttttatggtgtgcacaccaacattcacctttaagtgaacagtgggaggagctacctgcctgggatgaattgacccacctagtcctgtatgaccataaaagacaaggtcttattctgtagcccagactagcctcaaactcatggtaatcctcctgcctcagcctccgcggtgctgagactacctcatctagaagagataaatcttatgctgtttttctaagggaccatcactaaactgagagacgcgtttcctagggaaaacagctccaatctatgataaatacaagttaaacgtgttagcattccttcctgggcgcagttcgtatgtgtcaaagtacgctggtcttttctctttcccaactacaacagggtgttcagacaggtgacccaggcacacttctcatgctgttggcgtctgctctgttgggagcccacggcaactctgaagttgtggagcctttaggcagcctccccgactcgaccacaccgaataacttacatcaccttttccatcagatcccatctagtcatctgtgcacattaatattaatcaacactcactcgaagactcactttttttaattaaaggctttatcatcttcaaaaaaaaaaaaaaaaaaaaaggaaacatttccacattataaagttgtgaggtttgggtagcgttcttttcttttttctttttggtagttccaaagg

SEQ ID NO: 990 - DNA, 3000 bp, Mus musculus
cctcttcatgatcgccggcaaacttcctcctcggcgctgcttctaatggagccccacctgctcgggctgctactcggcctcctgctcagtggcaccagggtcctcgctggctacccaatttggtggtccctggccctgggccagcagtacacatctctggcctcccagcctctgctctgcggctccatcccaggcctggtccccaagcaactgcgcttctgccgcaattacatcgagatcatgcccagcgtagcagaaggtgtgaagctgggcatccaggagtgccagcatcagttccggggccgccggtggaactgtaccaccatagatgacagcctggccatctttgggcctgtcttggacaaagccacccgtgaatcggccttcgtgcatgccatcgcctcggctggtgtcgccttcgcagtcacacgctcctgcgctgagggaacctccaccatctgcggctgtgactcacatcataaggggccacctggagaaggctggaagtggggcggctgcagcgaggacgccgacttcggggtgctggtgtcccgggaatttgcggatgcgcgggagaacaggccagatgcccgctcagctatgaacaagcacaacaatgaagcaggccgaacgaccatcctggaccacatgcacctaaagtgtaaatgccacgggttgtccggcagctgcgaggtgaagacctgctggtgggcccagcccgacttccgtgccattggcgacttcctcaaggacaagtacgacagtgcctccgagatggtggtggagaaacaccgtgagtcccgaggctgggtggagaccctgcgggctaagtacgcgctcttcaagccacccaccgagagggacctggtctactacgagaactcccccaacttttgtgagcccaacccagagacgggctcctttggtaccagggaccggacttgcaatgtcacctcccacggcatcgatggctgcgatctgctgtgctgtggccggggccacaacacgaggacggagaaacggaaggagaaatgccattgcgtcttccactggtgctgctatgtcagctgccaagagtgtattcgcatctacgatgtgcacacctgcaagtagtgagccagggcactgggaaggggtagattgtgcggctggatccattcatcgaagtcccatgagaagcaggatctagatccaggccagccttcggcactggccagcaaggagcatggactgttgccagctgcatgtgataaacgacctggacccagccggcctcggacggacgggcggcttctttctcaactaacgtctctccccctgctctggatggtgtacggctttacagaggggctttctttatggttttaccagggtctgctggggacagactcgaggcttacctttgcacatgttaaagaaaataaaaatgaaaaaaaaaaatctaccgcaacagaacaggctgggctagtgtgagctcttggcctggtgggaaggacaagaccatggcgagattctgtgtccaagctgcctctactcgtgacattccaagatgcctctgaggtgggaactgtgaagtaggacagagccccgcagtcccctcttgtccgtcgactcccatttaaattggacataccttgtcgttctgagaaaagccatagataggtgtagctgggatgtagtgatggggaggcccctggccaacagtgggagcaagatcttgagttttgaagacctcagagttctgggcggcctgggaagccatctgcagaacagagttccttgtgggctcctgttttcgctagccctgttctgccctggagcgacagtcagatctccacgcccctttctgttgttctacagtgtccacctttactacgcgttttttttttttttttcatgatgaccttgtaaataggtcagatgtggaggcaggtctcttctggctccatccaccacacccagaaagaatgggctgctctgcccttctcagccttgctaaccagcagacaccgaggagagcagcggggcaccttagagagcaatctaaacatggttggcaggtggggagggtaaagagtcccacttcctttgtgttagaaggcagactaccctgcgtccttttctcccattggctgaagtaaccagaaagacaagagatccttaacaagcccttcttcccacttgtaaaagggatagcctatctcagttcccaaggatctggattagatagatattcaaaagaggcaagcagcgaatggaggcagctcccagctctgttcccgacgcatgatggtactggctgggtttagtaaggtgggtggggctgcacggatcaatccatcaactccgtcttaaggagaatcagaaagaggagataaaatgggggaatggggcagaacaaagaatttgtcctttcccgcttctgtctagggtctgctaatgctggcttgacgaggggtcagccacttctttcctgttgtgcagttggcttgccaagcaggctccagtaggcccttgcctgcactctctaccatgtgaccatgagcactgctctagggacacctcccatcccttcctagcaccccaaatgccccttcccatctctccttccagaagttggaaatcaagtcaactggataacgcttgtgtgagacacttgagcagaacggatacaacaatttacaagtctcttcatatctatgtattctatattaaaagtgataaagtcatgtttccggggcgtattcaagtagctgacaagtaattatttaataatagtacatgagcgcattgtaattatcctcgccatagtcaggtaatagcatccaatgggaggtccctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatt

SEQ ID NO: 991 - DNA, 1068 bp, Mus musculus
atggagccccacctgctcgggctgctactcggcctcctgctcagtggcaccagggtcctcgctggctacccaatttggtggtccctggccctgggccagcagtacacatctctggcctcccagcctctgctctgcggctccatcccaggcctggtccccaagcaactgcgcttctgccgcaattacatcgagatcatgcccagcgtagcagaaggtgtgaagctgggcatccaggagtgccagcatcagttccggggccgccggtggaactgtaccaccatagatgacagcctggccatctttgggcctgtcttggacaaagccacccgtgaatcggccttcgtgcatgccatcgcctcggctggtgtcgccttcgcagtcacacgctcctgcgctgagggaacctccaccatctgcggctgtgactcacatcataaggggccacctggagaaggctggaagtggggcggctgcagcgaggacgccgacttcggggtgctggtgtcccgggaatttgcggatgcgcgggagaacaggccagatgcccgctcagctatgaacaagcacaacaatgaagcaggccgaacgaccatcctggaccacatgcacctaaagtgtaaatgccacgggttgtccggcagctgcgaggtgaagacctgctggtgggcccagcccgacttccgtgccattggcgacttcctcaaggacaagtacgacagtgcctccgagatggtggtggagaaacaccgtgagtcccgaggctgggtggagaccctgcgggctaagtacgcgctcttcaagccacccaccgagagggacctggtctactacgagaactcccccaacttttgtgagcccaacccagagacgggctcctttggtaccagggaccggacttgcaatgtcacctcccacggcatcgatggctgcgatctgctgtgctgtggccggggccacaacacgaggacggagaaacggaaggagaaatgccattgcgtcttccactggtgctgctatgtcagctgccaagagtgtattcgcatctacgatgtgcacacctgcaagtag

SEQ ID NO: 992 - DNA, 70419 bp, Homo sapiens
tgcctgccttggcctcccaaagtgctggaaatacaggcatgagccaccgtgcccgacctgggcagaactacattctggatgcatcttaaacctcacctcaaccctacaccctcccttttgttgtttcctttctccccacaagtcatctcagaatgaggctcccagctccaggctccagttgcaacctcacccccacctagacaaaccctcaaatcaagaaaaagaagccctggcagggcgtggtgactcatgcctgtaatcccagcactgtgggaggctgaggtggatggatcgcttgagctcaggagttcaagaccaccctggctgggcaacatgatggaaccccatctctaccaaaaattttaaaaaattagcttgttgtggtggtgtatgcctgtagtcccagctccttgggaagctgaggtgagaggatcattagatcctgggagatggaggtcgcactgagccaaaattgtgctgctgcactccagtctgagtgacagagtgagacgctgtctcaaaaaaagagaaaagaaaaagaaatccaaaggaaaaaaagagagagacagagagaaaggaaaagagaaaagaaaagaaatttctgttggccaggcccggtggctcatacctgtaattccagcactttgggataggccgaggtgggcggatcatgaggtcggcggatcatgaggtcagcggatcgagaccatcctggctaacatggtgaaaccccgtctctactaaaaataaaaaaaaatcagctgggcgtggtggtgggtgcctgtagtcccagctacttgggaggctgaggcaggggaatggtgtgaacctggggcgcggagcttgcagtgagccgagattgcaccactgcactccagcctgggagacagagcaagactctgcctcaaaaaaaaaaaaaagaaagaaatttctgtctcaaaaaaagagaaaagaaaagaaaaagaaatcctaacactcatccatccttaagtaaaagcaactcaccttgtaagtcagtctccacatttaatccaactaccctacactagacatgatgggtgaggaggatacagatagttaggaggcctttggctacaagtaacagcctcaagtgggctaacgaacaaggaaaatgtattatttcatatcacaagaagttccaaagcaggactcctctgaaggcagttagtgtctcagcaatggtgtcagagatgaagtttgtttctctctcttggctctgtcttcctctgccggtcagcttcatcttcaggcagctttcctcatagtcacagaatggctgctgcagctccaggtatcccaacccaaaacaacaatgtccaaaagcagggaaaagatatttcttactgtgtgtcattttaagagccccaaaaactcttcccagaaaccttcttgcacccttcagctgacctccctcaggcacatgtcacccagtttaggccaatccctggcaagcagaatgggtccccgtgattgacttagatcagtcaggatttacctctgagcaaggtaggggaggagtaaagaccagaacaaactgggggcctctgccatcctggaggaagggaccaccagcagtgtgagctacactaaatctaaacagaagcctgtcttccagaagttcaaaaacagcagctgaggctgggcatggtggctcatgcctgtaatcccaacactctgggaagctgaggtgggtggatcatttgaggtcaggagttcaagaccagcctggccaacatggtgaaattctatctctattaaaactacaaaaattatccaggcgtggtagcttgcatctgtagtcccagctaggaggactgaggcagcagaatcatttgaacccaggaggcagaggttgcaggttgcagtgagacaagatcactccagcctgggtgatagagcgagacttcatctcaaaaaaaaaaaaaaaaaaagagcagctgattgccacagagggagggagtggatgctcaccgatcattttacatgtcccaggtgccatttcaaacacagcagctatcactctgctgaataggcaattgtctttttgagacaagtgttattatacccattttgcagttgatgaagcaggtacagagaggttagataatatgctcagtgtcacatagtaagaggcagagctgggattcactggggttgtggtagacctgggctctaacgcaaccactcagagaggatttcccagtcagacatgtgaatccccattcaggccttatctagaagccaagacaaaggtgcataagaggtgggtcctgctgggatgtgggaaatgccaggcagatgtccctgcttagcccaagggccctcccacgtctgtgccagctgtgcctaggcccttgccagtgaggcagctgtgaccccattcccagcccactgggcctccatccatgtgattaggctcccaggactcagggcccatagctggccaccctgaggtcccagcaatgacagctactggccatactggtctgtggagaaggtggttagttggcagagttctggaaggtgcaaaccaggacttcactagaaatttcttcaccatctccaaggatattatcaggcttgttctattctatctccctaatgtgcccccacaaaagtcttccccgcaagacccctgagatggagagaacttccacacctctgttttgtttcgttttgttttgttttcttgagacagtttagctcttgttgccgaggctggagtgcagtggcacggtcttggctcaccgcaacctccgcctcctggattcaagtgattctcctgcctcagcctcccaagtagctgggattacaggcatgcgccaccatgcccagctaattttgtatttttagtagagacagggttttgccacattggccaggctggtttcaaacccctgacctcaggtgatccgcccacctcggcctcccaaagtgctgggattataggcatgagccaccatgcctggcctggttttgttttttaaggaaacatttacgtatttggtcctctgatgaatgactgtccccagcagatggcaagttccttgcaggccaaaacctgggctgcttttgctcatcagtgctcagctgccaaggggcagctgcacacagagttgctccatgaagatgcgttgaagaaatggaccaggtgaaattcacagagcacctactgtgtgcatcaaccggagctgggttataaggaagaaggcagactccttgagggtagtcccattcctcgtggagccttgtccacagcaggcatgcagtcaatgtgtgcgatgagaaatacagacactttccgccctcagagcccaggcggaaggtgggggcccatcgtgactaaggttggagacagaagagaccaaagatggctccaagcccctcctgggttgcaaccagggctccctccccttccctgcctgcttatgtcccatacacaggggagtggaaggaaaactcaggagctctagttccaggtgactgagagaaaccgtggcagccacacacagaggtctggctctaactcctcaggtaggatcacagccatgctaggagctggccttgggttagagccccaaaagccttgggcaggccagccatgtccagggatggggctcagggttatgaggcaatggcagaataaaggggcacagagggaggctgaagagaaagaaagggaaggagaaagaggtgtggcacatggctggagaggcagcacgaggggccaccaagccccagatgcccccatgtggcagtgacttcccaacaggctgcccacccttaatctcatcccactggaggcagcacagggtcctatgaaagggacacaggaaccaagcgacagagcagggtagctggggtgggttggagttgtaggggccagggccactcaagataggggcactgaggaccctgaggggccacagggagcccagacctgagtcagtggcccttctatctgagacctcggccctgcctgctccctctcctctgggcccatcatcaacagtgttttcgaggggctgctaagtgctggatccctcaccactgggggttcagcagtcttgtggagggagtttctttgtggagatttcacagttggagacggacaacatatgcaagaaactgagcagatatgtctgctatgtagtatgtataatcagccgggcatgggggcttacgcctgtaatcccagcactttgggaggccaaggcgggcgtaccacctgaggtcaggagttcaagaccagcctggccaacatggtgaaacactgtctctaccaaaaatacaaaaattagccaggcatggtggcgagcgcctgtaatctcagctacttgggaggctgagacaagagaatcacttgaacccaggaggtggatgctgcagtgagccaagatcacaccactgcatgccagcctgagcgacagagcaagacaccgtctcaaaaaaataataatatgtgtaatcacatattaatcacatcagtgtcagggctatgctggaaaataaagctgaataagaggcctgacaggacagggctagggagtggcaaggggtctggaggggcctctctgaagtggatattttgaagtgggtcttggaaggggacatcagacaacattatcccggataaatccttctggagaaggctcctgggcgcctgaagggggactgcttagcagacactgactggggcaggaagagagacctgagagagaggcttactccttgcctcaagagaagaaggaaacccaatattttgtattcaccatccgcagtctggcattccgtcagcaccattctcatttaacgctgacagctccctacaaggtggaaagtgttatctccactccacaaccgaagccagggactcagagatgacaggcaaccggccagtgcccccaccccaccccattccctcccttctaaaggactttcaccgcaaatcgctttccaaaatgctctggggaggccaggcatggtggcttgcacctgtaatcccagcactttgggagaccaagatgggtgggtcatttgaggtcaggagttcaagaccagcttggctaacatggcgaaaccctgtctctaccaaaaaaacacaaattagctgggtatggtggtgcatgcttgtaatcccagctacttgagcggcggaggcaggagaaccacttgaatatggggaggtggaggttgcagtgagccgagactgcaccactgtactccagcctgggcgacacagtgagactctgtcttaaaaatataggtcaggagttcgagaccagcctggccaacacggtgaaaccctgtctctactaaaaatacaaaaaattagtcaggcgtggtggcgggcacatgtaatcccagctgcttgggaggctgaggcaggagaatcgcttgaacctgggaggcagaggttgcagtgagtcgagaccgcgccattgcactacagcctgggcaacaagaatgaaattccacctttctatatatataatatataatatattatatataaatatatataatatattatatataaatatataatatataatatataaatatatataatataatatatataatatataatatataatatatgtgtttattatataatacatatttattataaatacatatttattataaatacatatttattataaatacatatttattataaatacatatatatataaatacataaaactgaatgccctggggagctagagctaagacaggaggaactactgccacagggagaacctctcaggtgcccacagcggcccctgtgatctcgggatccaggaagaactggtgacatccgcctgccgctggcagcctcccatatgtcagcggaagagggaggcatccgcagggtggatctggcggtgccccagtgcgccctggaccggcatcacctgggcccgctcgccctccgcctgtctggagaggagaggggagcctgaagccatgcaccccttatccccagctaagctccgggattgcgaggtagattaagggcattcactcaggagggcacctgcttaaccaagatcctccgaaatccgggctgctcaccagcaacaattgaggatgccgggcccgcagggagcggagtgggaccaggcgcgaccccttcctcgcctgctgacctcccgccttgctatcagcactgccgccagggggcgcgcccgcgccgctgggctctgagccgacctccgcgtgcacctgcgctcctttgtgtgttagattaacatctggtgcttacctactatgcgcttactcggtgcaggtcaggggcttcctgcatttccaggatgcagcctctatgccagcaaactaggctgggcagtggaaagaaatccgatttactcctgcgcccaccacccacgctagggccttcctgcttccaggctctgctgtccagccttccagtggcctctagggagctcgcctaaaaccgctctgcggttcctacagctcctaggagaaagttaaacgccctcctctccaggtcagaggccttggagccccctatgtgctccctttgcactgttcctccataagccctgtggtgttaggccttcggcccttcgcacttccccacctgcttccccgctgcaacggcttcgcctctccctttacccccccaggttggtccggctcccgactcccgcctggcagccccaagacctgtttcaagcaaaaatgaatggcacagtgcctggatcggagatttcctcctccttccccgcgacagacgggtagccccatgagggcgggcgggggcctggccaccggattctttgtctacacggtgcctccgcagggggtccagtggagcctcactgaatacacagcggcagactctgagccccgggggagtgcacatcaaaaggaacctccgagccagctagagagaggggttgggttgggactggggtccccttcccaggtctaaggtcccacacattcacacacacaacaaaaagtgcttcccacgtgccaccccatgtccccaggtccctggcccttgctgcctcttctgccctcttccaagagaccacccttcctttcagggcgatggcctcctggtccaccggctgatgcctccaccccgccctcccttcctggtcttggagtgaatttaaccctttctccaccaagtgaaaccaccctggggcttggggtacctgttagagagagggtgtttctatctgtgatgtgtggtcaggggcgcccgccctcccctgagagaaaccattcctgcgtttccacccgcggcagcgcaaggggtgcaggaggaaggaaattaaacctgtgttgaaggaaggacacctgggggaaaggaagggactcaggctccccttgtctgaggagctttcaagtggcggaaatccccacacacacctccattcactaggggcctggcagggccgctggtaggttccagtcctctcctctgtcacttcccaggcgcacatggccagctcctagattccacccttcaacccacttgtttcctgcctgatgcacatgacctgcgtctgagttctccaggctgcctggaggaggcattcaggtacacatgacccctcagggaatgatgttcttgcccacagcacccaggatgctggctgggcatatctcagccaacacacactcccaccgacagcctcggatcttttgctcccacctcacagggttggcacctgtggagtcttgaggcccagtaatgaccccaagaagccatcaagtccaggccctgtcgccccaccatactgcatccacagtggtgtctgagtggccagggaaggtagccctccccagctctcagcaccactgtcatggggctctggaactcccgagcccttgggcaggactccagcaggcagctctgatcagaaagccacctgggagccctgtgggtgggacaggactccaggtaggacctagcaggcctccatccaagagggaggtatgtggaaagctctccactgccagagccttggtcctgaggctctgcattcatggcaatggtaaccctctttccaggtgaatcagaaacagggcaccccagaatcagcccagccatgaggagcatctctagggatccccatctctgcagcccccaccaggttcaccactcctggtcaggttcacgatttttcttcgccttgcagctccttggtgctctccgcctcccccctgcccctttcttcctcacaccggtggctcagcctccccccgacagttttcttggtttctgtctcagcgtctctctcatctctgagcccctctctctctctcctcctctcggattctccttttcctccccttccttcctctctttcaacctcccctcccaccccctccagtccagcaatgggctgggaacgcagcaggagccatgacaagcccaggcggctctcccgacccttggtgcccccgaggccatttccccgcgctccctgtgccggcagcagccgcgtgcggagagggctcgccgaccagaaggggcagcaggttggagctgtgggtacggggggctcagatcaaaggccaggaatgtctggccccctggcgtaagacttccttcagccatggccctcacctcgtggaacgcccgccgttccaggcctctgtgggactcgggtcggctcattctctgccctttctgccacagttccctacacagcggtccctgctccccaccggcagtgcttccttcaccccagaccggggctgcgcagagtcctggtgcctcaggtggcctgggagggggcctagggaaaggcacccaggtgaccgggcgtgagtccccaaaacctgaccatgatgtcaataccacccagggctgagacctaattcctcgctctggagagggagaggagaggaagcaagcccgaagggggcctggaaggactcctttcctgtggggaggggtgggtaactggaggcatttggtgtccgcacagggcaagggcctttatcgccaaaccccaggctggagctccctatcagtagaaccggggcctcaggcgggacggtcgggcagtgaggggcgctccggagggcagcaaggtcttccaaggacctgggccgccctcggccagagctgcgcgtttcaccggtccctgatggtccaaccgagaatcccactgaggctgtgggtcacgcctccgacccgggccagaggtcgggcctgaacccctcaaggaggagaaagtgacccgactccgagagcaggaaatgcgactggccgctggtgtcagttgcaggaaatgcaaaggcagcaggaggtcccgataccgatctgatccctgacaaaagactcaaatgacactcggctccgtcccccggcgccgcccgcagccagaccttcgagcctccgcggacttttccgcacgttcctcggacacccgggaagtgacctcccgcggccaggacgagaggccagagagcgggcggactcgggaggctggaagctgggagggggtgcgttcccccaccctctgatcctgacctgcccgagcggggcttctggaaacatccctgtgctttctaccctcgattcctcgcgggcccacgtcccaacgggtcacggtccccgccagcaaaggagccacccgttcatgcccacgccaagccctcgccatgtgaacgcccgggtcaaagcccccgcgccctaaccctggccagcgggggaccgcggcggtagcagagggtccggcccaccgcgtccccccgaagccccgcggcgtccggggcgcgggctttgcccaagtttgctgggcgatgcccttcccggagcccgagttgtgggccgggcgggaggggcgcgtgattgacaggctgaactacagactcatctcttaccttaggccgcgggcgctgattggctgctcgctgacatcctcaaacccggctgctccgcgctgggctcgggaggggggcggctgcgggtggaggtgcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtaagactcgcctcttgtctgcccgcggcccggtttctccgccgcgtccggggaaggtgggggcgccggctgggggtgggccgctgcagggctggggctcctctcctcgcctccctccagccccccacccgcccacccctcctggattttctgctggtgtcgccttcagaatccaactcctggctcctctgataatcaccattttccctgctccccgctgcaggggctggaggacttttcccatctcagaaggtttcttattcttagatcctaaccctctgcccgtcccaatctagaggcccccgaagaccccccatttgcttgcagttgggtttctggaaatccagcactgtccctggggcccagccactcctcttctccattttggggtcttcatgggcaaaaccatcctgttccttcactgccaccccacctctgccggcgcctccatcaagagattccccataataacccccctttgccttcctatttcagaccccaaaggcttcagggctcctcccggggcaggggagtgggtggggggatttcatcagattctccccaccgctctagattcatcttgagcctctgaagtgaatatggtatttgctgatccgggatgccattgaattcggattttattcatttcttgcttgtccaccctggcaaaaggggggttccttgaaaatgtgttgtctgggaggggtaggcttgttgttctttgaccaaaaatccaattctccatgtcacatttcttccttttggaaaaccgaggaccgaggagaaagggagagggaagggagaattccgtccctgagaaatgtggatacaaaagacattttagtaaataagactgggaagccgggagcagtgcttggggggggctgtgcgtgtctggggggcctgggtgaggaataaacatcgctttgggagccccagctccaggagtccccttgttttccgagcggccccatcgccgctctcccaccctccgcaggtcccaggggccagaggggaagacactgaaaccagttctctaaattacactccgcctctccccagtctccagccccctacattccggaaaactttaattaaagaatcttcccctcctggacataggagagccttggcctgggcggggggaggtgaggaggaagaatttgggatctgtgagtgagaagtgggctgtggcccccggggtgaaagtcagaaagaagtgccaccacggtgcggtaccgcctgcaggtccccagactccctgcctttcgccaacccagagtccagggtaggaggagcagagacagcgagacttgggggccacaccccgagtcttccagttgtttggggatggcagcatttgtgtctgggtgtttggggctcctgggagagagggtggggacatggccaagggtctctgtttagagggtgctaggagttgctcccaggacagccagccaaggggaagtctttcttctgcccaacccacacttttccggggggctgggctaacctgaggcttccagcacataaagaagtccatggggtggccagggcagccagggacttcaggaaggaggttcggccagtctggggaaaggctgctgccaacaccagtccagcctcacccggccattcctgaccctcttcccattcccgggccaaggccatgccgtttttcgccttgctttcgcagagactctggtgggttgggggagggtaggaaggaaaggtttggcggcccataggtggcagggactgaggaagagagaccagtctctccggccctatgaactagaagagggcactcttccagttggtgtagattctggtgtgaaatggtatcttggggaccatctagatagggattgcccaataggaagaaacgctggggaaacctggaaggtcaagacattggccctaacataatgctagacacatggcttgtttgggaatttggtgggggacaggaatgctgctttgtctaagccaaggagagaggtgtgtgtgtgtgtgtgtgtgtgtgtgtgtgtgtgtgtgtgtgtgcgtgtgttctgggtctatgaccctaagaggtgttttctatacaccagtgtgtctctgtgtgcaaaagtgtttgtgcctgcaactgggctactatggatgtgaaatcgtgtgggcgtgttgggggatccatgcccacgacaggttgtgctgtgtgtgtctgcacacgagtgtgagcaagtggctggtgctgtgatgtgtgtatgtacatgtgtaagagacagagagaagtctagaagtatctttgcccatgtaaaggtcagagcctgtgtctgcctgtgacgctgggcttgactgtgttcatgactgggcatgtgagtgtgtgtgtgcgtgcgtgcgtgtgtgtgagtgtgtgtgtgcgtgcgtgtgtgtgtgtgtgtgtgtacgtgcgcgcgcatgccttcatgacagtgtggggaaagccccacagatgtctttgtgcatgaatatcagtgctcatggccatgacctgattgtgcttgtaaggaggagagtgagcctcaagtccatagctgtgtgagggctgtgtctgagtccgcctgtgatcctgtccccaggtgctgggcccagggctgtgtggctgtgaatatctttgcagacatctacctgtgggtatgaatgacacctgagcttgggtgtttggtgggcagccatgggcctggagggaaggtccaacaggaagcaaaagtctcacaaggtggctgcagggggcacagctggccagggatggcaagctagagaggcaggggcacaggcttccttgacaccagcttgtcctgtctgtccaggcactagagtcactggcccttctctctgaggttgtttttctttggtcttggagctggggtggagggtgagtcaccttctcagggttagggctggggctgtagggtagatgggcctctgattcctgatcccatttctgcccccactccccaacccagccccccgcctggcagtcagattccagtactttgagcatctaagcccatcttggcctgccctctttggcccacccagctcatgcattccccaggaaggatttacaggggaagtcatgtagctgggatttctgtccacgcggaccctcaagcatgacaccctgagtccacactgctcagaccccagtcctgacagaaggttgaccagaagggacagctctaaggggcctcagactgacacccctggaaggaagagatgttctccaggtagtgacagagccgggacaggaaacaacagcactgatttctcgaattccccttgtcagtcccagttagctcctggtggagaaacttgtctttcttcttcttcttgggggcgctggggtggggggatgaacctatgttattagggcctagcccagcacctgctacattccagcgatggacgtgcagatggagggggcctgctggagatcaggagctcaccctgccgctgtgtgactgaggaccagtggccacccatctgggtctgcttccttacacttcacccaggagtccccagcctgccctgcctcacagcttgggtgaaaatgttttgcagaggacaagggcagtgagctgggaaatagcacacctgagttctcgccatcccaggacccatcctcccactcgagcacctgcctaagacctacctcagtttccccatctgtcagatgtcctgctgcctctcccacccactcccacctccacccacctttcagaggcttgtgaacatgttcagtcaaaccccgtgggggtcagtgggctgggcccagggaggcacctggagactgcgggggaggaaggccccaggccaggtgttaacacttgtaacaggcaggaattacagctcgctggggctgggctggctggggctggtgaggagctgagctagctggaggctgttgatcccacagacagacagacagacagacagatgggcagataccagatcggatggccaggctttaaccgggtggtctcccttccagggcagacctttccctgggggggatatggcggggaaattagtccaggtctcttggaagttaacagccctcccgctcaccccgcccccattatgggtggggcttcggagtccagagggagcaaaattggtggccgatctgttggtattcttccgataggatcacattttgcttaaaaagaagaaaacaggtcaaacgttataataataccaagagcctgagctgagttatgtccttagaagaacctgctgtaatatgtatgtggatggcatgggggaaggggacgctctcagggaaagttctagactctcagagcattttgtcaacagctccggggccaagaggtgagagatgggtggagtctgagtatcacccccacctccaccccagggatcctgagggcttgggtctgtgatgtctgccctgcaattaatcctggcctggtgggaagacctttggcgatgaggtcaaaagaggcaggagctggactttggtgccaagtcctttaggaggtgcttgctgcagcttcaccagtggcaaacccagccaggccctaccagggcccacactctggcatctggatacatgctcagtcactgacaaaggtggagaaactgaggcagacagcgagggctctgggtggaaatctccaaagaatgcactcagcctagcaagcatctctcatcctcctcactacagaacttaatgctaataaacattaatggtacttgggcagatgtagaattggaagaagtctctccttggtctgggcaggagacaaggagccaggggataaggagccaggggatggcacaggaaaggtgacttatcacagaggaggatgcagctaacaaacccttccagggaaaaggaagtgggaaaaaggaagatttttctggtctcagaatgtgatgagccaggagttgagcagaaccttttccacctaccctgatgtgagccacagaaaccttctccagctgccaaggagggcaagacatcctccacccctcattcctaactcagggaggaggtatgcctagccccacccccaccccccgccaaaggttagagccatcctgatattacatctgtacatccatgttatcttgtatgctggaaaatggtgagagtggggagatggagagacctatgtctgaattccaagtttaataccaatggaccctgtgacctaggatgagtcccttcccttctctgggcttcattcaagtccctgcctccttctgggcttcattttccttaaccacatggaggggtcccttttgcctctcagagtcccagggctatgacaggttctgggctcgttgctgtgaagcatgacactctactgcacacattccgggcctgtattagacagtccacccgtttctttctgtggctccatctgacctaaatcgcaaagagctggctgccccactcctgccaagccaacctgcttgcacttccaaacctcgccccaaacactcccactcttctggagccaggccatctgcattcacatctggctttttcatgtactacctgggtaactagggcaagttaacctctgcaagcctcagtttcctcatctgtaaaatgagtgtaatgattgcctctatttcatagggttttgaaaatgattgagtgaatacttcttagaatgataccttgcatacaggaagcatatcgatgttagctattttcacctcctatctgcaagctattggctcactgaagccctggagccaaacttgcctcttccaagaagccctcccagatttgccccacctggctctgttttccccttttcttctttttgcctgtttgccccacagtgctttagctttattcttaagttgagggtgctgggccaggctaatctcacttcagctctttacctgctcaggaaggggagggcagggtagagaaggttgctggagtgtcccctaatcattccccgacccccagagtctgccagactcttgctgggacctagagccagggggctgggcacagaaggggtgggggaggcaggcttcccagggggagtggcaccagggccgcccagagcagcctgagcagaagttgcttctctaggagctgagagatgattcagaaggtgatttatagtcggaaggcagaaagcttggctcctggcagaagctgctgcttaattacattcttggggcgggggtaggggggtggaggtatgtgtggggaggcagcaggggccagacttctgcctcctccccatccaggccctccctgtccctttggctgtcccggctctaagcagggtccttctttatcccgctgccagagagggaattccctgctctcagtgagaggctaggccaggattgcaggaatagcttctgggagtggagaaggtgggaaaagaggaaggaagctggatcccatctcccgggacttctccaagggagactggatggcgacgggctggaaaacgggccttctgggaaggagcactgggtctcctccctgcttctgggcagcggaatagctaaggcacctgggcagagttgagtttctttctttctttctttttttcttgaaacagagccttgctctgtcgcccaggctggagtgcagtggcacaatcttggctcactgcaacttctgcctcccgagttcaagcaattctcctgcctcagcctcccgagtagctgggattacaggtgcgcaccaggatgcctggctaatatttgaattttttagtagagatgggggtttcaccatgttggccaggctggtctcgaactcccgacctcaggtaatccacccgcctcggcctcccaaagtgctgggattataggcgtgagccaccgcacccagccagagtttctagaatcttctgagaggcaactccacgctctccttcgggcaccctgtcctgctgctgcctgggagggcctgcctgcaggtttgctccttttctgttgctcaggtctcagtgggccatgggggctggagagaaggtcctgcgctcagaggctgaaacccggttcttcagcgttaggcagcctgtccctcgtgagcacagtggctaccccaggtgcacaacggttctgccagcaggcacggccccataccctcatgtcaaactaatatctcagagagtcaccccaatgccgctgggtgcagctacaatcacttccgcgccattgacaggagcccccattctgtttccatacctgctgagttgacatcagcatttcccatattaacactgacccatgcaacaacccgcccgatgacacctaaggccgcttagttccctgcatcgcagccgtgaatcccaaatccctcactgctagttcttaaggctggaaaggtgtagggcgggcaggggtagagttgctgaagccagtagtgtcgatttatctgtttgcagcctggcctgtacagccgggaggagttggcaggggtcaggatggggacactagacagctctctggttccccctgaggcgggccttctcaaaatggcctcattatgtgtgtggagtgaattccagaaatgtcaggcacacccatacatctagggaatgaaggagatgccagagcgggctctggggcgagaggggccagtgtgaggaggtgggcggcttccgggcagggagttagggcacctgagacctggctctgccaccatcttgatattaggcaacttcctgaactgttctgagtctcagtaactaggagagttggataagctgctggccaaagacttccagctccgagattgcagtcatggaggctgtattccgcgttcaggtcacccagctatttggaccatctgtgcctggtggagggggtggtcactgaaagctggtctcagggaagggtggggggtgcagagctctaaactctacacacaaagagctgtgagacagtggatgagtctcctccctccctcagttttctcatctgcaaattggatgatgataataacacgaccacctgccctgcctgcttgcagggccgtgaagagcttcaggtggaataatctttgtgggcatgccccgtgaccagttggcctcagacctgaggcctctgtgccctctgccaggggctctccattgagcatcaggacccctacaggaaggagctgaggactccttcctgaggacacttgggaagtgtcaggttctttccagagaagttaactatcactgtgagtcctagaaaagaggaataagaaggctgggcatggggcttacgcctgtaatcccagcactttgggaggccgaggcgggtggatcacctgaggtcaggagtttgaggcctgcttggccaacatggtgaaaccctgtctctactaaaaatacaaaaaattagctgggcgtggtggtgggagcctgtaatcccagctactcggaaggctgaggcaggagaatcgcttgaacctgggaggcggaggttgcagtgagccgagattgcaccactgccttccagcctgggcaacaagaccaacactctgtctcaaaaaaaaaaaaaaaaaaaagaaagaaagaaaagaggagaggaataagagctagtccctgctcagacagtgctaagaatggacctaagagcccccctgagcctctgagcttgaggagttgatatttccagcagaggaagaagtggggctggacaggggagtcctcagctccttcctgtaggggtcctgatgctcactggagagcccctgggagagggcacagaggcctcaggtctgaagccaactggtcacggggcatacccaggttcacagctcagggcatggggcttggttatcctcctggcctaatgcaaaaaccactggccagacccagagtgagatttccaaccagggacacatgggaagatgtaggtggaggtgaggggggcgagggcaaagggctgccagctggaaggggctctgctgaggcctgtagtcatcagggaatcctaatggcctgggtaaggcctagcaaactaggagacaggcacaagccattccctccagctcggctggaaaaactgcgaggactgagtgtgtgtacgtgtgtgttggggagggggatgggagcaacaggaccaagcacccaggtctgtctggaagacctttctgggaaacctgcccctgggcacagagtcccacttatctgccagagccagctgggccggcaaggaaaaccaatctcgcagggcccattaggaatgcaaatagggcttgtgctgtgagtgagcaggatcccgcctcctctccagctcccaccaatcatcttcacaaggtggattgctgagggtgccactcccctgctctgacacctcccatggctcccctcttcctatctggtactgaggctccctatgatttcacttctgtccacctgcgcagttgtaactttcacaaaccccctcgatccccccaataacccacttcaactggaatactcacctctttgcttgttcattgaaatacttccacctcctctctctgactttaaaaggcagcccaacctggggcctgttgacctggggtcagtctgctctgcgctgctcagctcggaccccacttggctcaggtcatgtagctaacagccctgaactatggagggtccttagagggtctctcaaggtggatgggcccctcgacctgagcaggctgctgtcccaggagtggagatgagccttttctccacagtgtcaattcccctgggtttctttttctttttttttaatcccagttccacttgtaaacgtttcctatttgtgtactatttccccctccatgttcaccagttcacacgatgcttaagtgtctaagtcattaattttaagattgcaattggcagaagttgtttctctatctaggaacaggttaatacgtttgttgaccatgtgctatgtgctgatccccatgcagacatcatgatttatctgaatctaattcttgccagtttatagatagggagtcccacagtgcagcctgggcatggcatgggaagccctgagcccacaccctgttggacctaaagcctttttccttctaccaccattcaggctcagttgtggacttgttattggggtaaaaatttgcttgttcatattctactttgttccccaaaggatggttttgagacaagtttacacttgaccttccactcaaaggctgatgctttgggcttatagatactatttgtgaacgtctgggaagtctcttatttggggatgtgtcctcttcactggccacctttccacaagccatcaggctgtcctcaagctgggattgcacagttgctgacagcagtggccatgtgaggattttgttgcccctgggatgggtaaggggcgaccttgatcaaatcactgcctcccgggcctcagtttcctcatctgtgaaacagaaagggtagcgtaaatgacctctcagattccttccagcactaagctctttccttctacttagtcctttttgctgctttgcatctggtctccatcatatacgtgctagaaagcagctgggcagaatcttctttcttgccctagtccaattcttgtgttggtatctctgaaacagccaattgttcatttcacttttacaattcgaccttcagctttatttctccccgaggagccagcatgctttctcctttctgataaagcatgcttccctttatgtcctggctatgagaaaactcagaggtccacctgaagccacatccttgcacccgtgtggaccttccctgatcctgctcttccgtttttattttgttattgaatctgatgtgttttccgtcatcagcctcttgagggcagacatgttggagtctttgtacctggcctgggcataatggatcctcaataaagacttgtctttgggatacacatttgctgtcaacctcttcaaatcctttctggaaagaagcaaggcacatgcgaattaaaaagcaaaataaacattgctctgggagggagttggtcctgactggatagttttgagttatgagaattccagtctgcttctgtttcttttttttctgtttatttatttacttagagatggagttttgctcttgttgcccaggctggagtgcagtagcatgatctcggctcactgcaacctccgcctcccgggttcaagcaattctcctgcctcagcctcccaagtacctgggattataggcatgcgccaccacacccagctaattttgtattttcagtagagataggatttcaccatgttggtcaggctggtatcaaactcctgacatcaagtgatccacctgcctcggcctcccaaagtgctgagatgacaggcgtaagccaccaggcccggccttctttctgtttctttactgtcagcttttccccaagtctacaaaggtcttgtcttcagagaagtcgcctcttttttttcctccatgatcttctccactctaaagctgaggttggttcctaatcttcctctagggactgtctctcgttcctggccaatgactatgtccacccctacccctggctcccttcacaactggttcctcccaccctcccttgccttggaagccgacggtgctattgccaccattccacaggtgacggagtgcccaggtagcacccaccctctctccaacagagctgctcccgtccccagcagccatcgtgagggccaagccccactctgcagatggagccccaaggaggagcagaggggagcggcggccagggatctccccattcacccagcaaggtgtcctcacaactctaaccggctctcccctcccctccgcttctgcccttgggcaacacatgtgcaggtcaccccacccagtccctgacttcggaggagagaatgtctagcctcaggctgggtggttctccatcttaactgaagcttccataggggattctggagcctttctctgctaccagtaaggatggagtctgtgacctctgcactgtcctggaagctaaagcagcctcgagaaagcagcctcttcatccccatgttacctgtgagaaaactgaggctcagctgggcgcggtggctcacgcctgtaaccccggcactttgggggacaaaggcaggcagatcacctgaggttgggagtttgaggccagcctgaccaacatggataaaccccaactctactaaaaatacaaaattagccgggcgtggtggcacgtgcctgtaatcccagctactggggaggctgagaaaggagaatcgcttcaaccgagggctgaagttgcggtgagctgagacctggccattgcactccagcctgggcaataaaagcgaaactctgtctcaaaaaaaaaaaaaaaaaaaaggaaaagaaaaagaaaaaagaaaaaaagaaaaccgaggatcacaggacccaaccaggagctgtaaggagctcggaagcaagtgggcggctccagtggcagctagtaattcctcgcttatgatgtcccgggtatcacatacattgaggaaacaaagcacacacattagctcatcctcccgacaaccccaggaggcagagactcttgttatccccattctacagatgagaaactgaggccctgaggcaccattccattgccgaaggctccatggttggtaaaccccagagctctaaacaagagacaaactgcctgaagccaggcccttcagtgacaccacaccacaccacagccaggaagttcctccttagatctgacttcagtctttccttaatccaggcccaggttttcttcctggggatgtgaatatcactgtcaagtttcagtttggtttggtttgagacaggatcttgctctgttgcccaggctggagtgcagtggtacaatcacagcccactgtagcctcaatctcctggggtgaagctatcctcctgccttagattgccaaatcactaagactacaggcaagcaccatatgtggctaatttttttaatttttatttttatttatttttgagacagagttttcactcttgtcacccaggctgcagtgcaattgcaagatcttggctcactgcaacctccacctccccggttcaagcgattctcctgcctcagcctctcacgtagctgggattataggcgcccgccaccacacctggctaatttttgtatttttagtagagatgggatttcaccatgttggccaggctggtctcaaactcctgacctcaggtgacccgcccacctcaacctcccaaaatgctgggattacaggcgtgagccactgtgcccagccttttttctttttttttgtagagatagcatctccctacattactcttgcttgaactggactcaaacaatcctcctgcctcagcctctcaaagtgctgggattccaggggtagggttccagtttgcacttgaggaccagggttcgtctcatccctgaatcttcctgtgtctggagttggttccttccagtgggttcgtggtctcactgacttcaagaatgaagccacgtacctttgcggtgagtgttacaggtcttaaggaccccaagagtgagcaacagcaagagttatcctgaagagcaaaagaacaaagtttccacagcatggaaggcgacccaagggggttggtgctgctggcttgggggtgggggggtgggcggggaggcagcttttattccctcatttgtcccagcccatgtcctgctgattggtccattttacagagtgctgattggtccattttacaaacctctagctagctacagagcactgattggtgcattcttacagagcactgattggtgcattttacaaacctcttgtaagacagaaaagttctccaagtccccagttgacccaggaagtccggctggcctcatctctcattccttctctagaacaattcctcccaggtgacccatcctctactcacctttaactacttgttcttcctcttctgatctcttaccagcttttctacaacttcctgcaagtcctatagccacagaattgcctttaaatcagggaaagagggggcctgccatcagctctctgatttagaggcttccgtctggtgtcttacagcacttcccttccccatagggcagggagtctggaatccagcatgcctgccctcaagaggcttatgacggaaaacacatcagattaaataacaaaataaaaacaggctagttgtggtggcttgcgcctgtagtcccagcactttgggaggccgaggcaggcagatcacttgaggtcaggagttcgaaccagcctggccaacatgctgaaaccccgtctctactaaaaatacaaaaattagccgggtgtggtggcacgcacctgtagtcccagctgctggggaggctgaggcaggagaatcgcttgaacccaggaggtggtggttgcagtgagccaagatcacaccactgcactccagcctgggcaacagagtgagactctgtctcaaaaaataaaaataaataacaaaaacagaagagcaggatcaaggtcaaggagaagacaaatatgcaagtcaaggtcaatgcaggtgcaaggatggagcttgccctgagtttcctcacagccaggacataagggaaaacacgctttacctgaaaggagaaggcatgctgggtcctcagggagaaatgcccgcctacagcctgtgcccaccctcttcagctgcgccatgagaatttaggctcctggagtatctggcccagacagccgtgagcctgcttccgggctctgcaggcctctgcctggggcccattctgccagggcaggccacactgcctgtggccaagggctggtcaagggaaattcatttgcaagggctgtggctggagcttgagggtgtggctggggcctccagcatgggatgcagaagggatgggcaggctgcaggcctggggctagatctcccatgtcaccattgtctagcgtgaactttatcaggtaacctagccctctaggtggcaagtaaggtttttgccaagataggaggatagaatgattgtttaacttttttttttctttcttgagacatagtcttgcactgttgcccaggttggattgcagtgacacgatctcactataacctctgcctcccaggttcaagcgattctcctccctgagccttgcgagtagctgggatcataggtgtgcaccgccacacctggctaagttttgtatttttagtagagacaaggttttgccatgttggcaaggctggtctcaaactcctgagctcaggtgatctgcctgtctgggcctccgaaagtgctgggattacaggtgtgagccgctacgcctggccaagtgattaactttttaatgaaagtacaggaaaagacgtaaactgtctttcctctgctttcaccctgcaataattggtacagaagacttctgtgaccaaatgcgtgcatacaccaagcaagctgtcaattctgcggcagacatcagccagcgtcctctaatccaattcaattctgatgatctccacctggacatagcatctgatcccataggttgaggtcttagttcccaggacagcctcccacttccagtagcaatcccaagccccaggctgctttacatgtgctcctgactgacctgctataaatcagggttcctgtgacttcctccttgggttccattaatttgctagagtggctcgcagaacacaggaacacacgtttactggtttattataaaggatattacaaggatacagatgaagaggtgcatagggcgaggtatgggagaagctgcactgagcttccacgcccttcccaggcacaccaccttccaggaacctccacgtgttccgctatccggaagcacttgaaccctgtccttttgggcttgtatgggggcttcattccataggtatcattgattaaaccattggccactagtgatcaacttaatcttcagccccctctccccttcccaaaggatggggttggggttagggttgggagtccaaccctctaatcttggccgggcacggtggctcacacctgtaatcccagcactttgggaggccgaggcaggtggatcatctgaggtcaggagttcgagaccagcctgaccaacatggtgaaaccccatctctactaaaaatacaaaaaaattagccgagcatggtggcaggtgcctgtaatcccagttactggggaggctgaggcaggagaatcgcttgaacccaggaggcggaggttgcagtgagctgagatcacaacactgcactccagccagggagacagagtcaaactccgtcaaaataaataaataaaagaaaagaaagtccaaccctttaatcctgcctgggtcttttggggtaaccaacctcaatcttgaagctgcctaggggctgccagctcttccgtcagctcattagcatacaaaaagacatcactttggagtttctaaggattttaggagttgtacgctgggaaactaggtcgaagaccaaatatatattttataatatcacaaacatgcgtacaggcgagcacacaacttgtcagtgtacagcttaatgagctggatagaatatcttatgtttaacagtttgtgaacctggcatgaaacttttcaatactgggcacatggtagatgaggcttcgttgagtggtctcaatgctacagccaggccttagggcttggcggggaaacagttccactagggtcgaactggcacagcatcgggaagaaggcttgcctcctctaatgtggctgcatcatctccatccctcccttggcagacccacagtggcactgccctccctcacagctgtggtcacttacctccaagtccctttttgttaaacttggaccatgttttagcctttctcagcctcaacggatcttcttttctgatcagtttagtcagtcttattttaatttaatttaatttaattcaattcaattcaatttgtttttcaagatagagtctcgctctgttgcccagagtggagtgtaatggcgcaatcacagctcactgcagcctccgcctcccaggttcaagctattctcctgccccagcctcccaagttgctgggattacaggcgcctgccaccatgctcggctaatttttctatttttagtagagatggggtttcaccatgttggccaggctggtctccagctcctgacctcaggtgatgtgcccacctcagcctcccaaagtgctgggattacaggcgtgagccaccgtgcccggccactttggtcatttttaaacggtctaattaggagtgcagcagcagcagatatgactgtgttgttgtatactcctcagcctggcccctgccgccctgcacccgctcctctcccaaccccaacatgggtaagcacatgggcctgggtacagcagtcctggactctagatggttctgcctttttatctgggtggacttcacctctccaagccttggttttctctctgcaaaatggggataacgagggctattgtgaggatgaaaggatataacgcatgtgagactagcacagggtcaggtgtgtactcagtgagttagacacacattttgctgacattaatttcatgttacagtctgcgttgttctcgtgcacacctcacttctccgtgcctctgtgctaccccctgccttctcttgggatgactacaaactcctgttcggtcttgaaatcatagttcagccatcacttcctctgcgcagccttccctcagcaccgcggccccagcaaaggcccttctgagcacatctatttcatggactagactgtaagtcacctgtgggcaggaccagttctccatcatctttcaacccataccaccaaacatagcacagggcacacagtggatcctcaaagacaggttgtgggatgaaaggacactgttgagagtcacctgctggtcccagactcttgtctccctgctccagctggattctcattgcctctgtgatgctctgccaggaagaccagctggtacttgttgtgtattttcctgtattctcagatacctcttcatgtgcatctgtcttgtcttcccagtgtaagagtcagcccctgagggcagggattctgctctgtaggcctctgcatcactagcgagcctcacacatcatcctgagtgttgcaggagcacagttaggaattctgttatcaggccaggcatggtggctcacatctgtaatcccagcactttgggaggccgaggtgggcggatcacctgaggtcaggagttctagaccagcctgaccaacacggtgaaaccccgtctctactaaaaatacaaaaattagctgggtgtggtggtgggcagctgtaatgccagctactcgggaggctaaggcaggagaatcacttgaacctgggaggtggaggctgcagtgagccgagatcgcgccactgcactccagcctgggtgacacagtgagactccatctccaataaataaataaataaataggaattctgttagcacttggcccaggaatcagactccttcccaagcaggctgcagttcaggctcagctggtccccactctctgggacagcactcccctcactctgtgatctcccaggaagtccggctctgggcatctaaccttggtgtggggaggcaacatagcactccagaaagagggtaggctctgtgacagaaccacctgtggtgcaaatcccagatgtccacttcatagcttctagaactttgctttgggtggttgcttaaaaatctgagtctcagtctcttcctctgtataatgggaataaaaaatatgatctcaaggtagttgtgaggttgaaatgaaataacagacagaaactggctaggcgcagtggctcatgcctgtaatccctacattttgggaggccaaggcggacagatcatttgaggtcaggagttcgagaccagcctggccaacatggtgaaactctgtctctactaaaaatacaaaaagtagccaggcatggtggcgcacacctgtaatcccagctactcaggaggctgagatgggagaatcgcttgaacctgggaggcggaggttgcagttagctgagatgacaccactgcactccagcctgggcaacagagtgagactccatctcgaaaaaaaaaaaaaaaaagtagaaataatagaaactgagttgaaggtgaatcattaaagatgttctacaggtcatctaatgtagcagggttataaaaatattctctcccaggccaggcttctttagagcagaaagatctgaattccttccaaaacagaaaaggctggcttcagggaatcccacacactttatgttggtttgtcccaaccaataagcctatctgaagaaagaagcgggtggggaggcatgtggcagaagtctgtgacttggtggacaaaaggcaatgcagactctggcatgaccttgcgttctggtatcctgttcagccagagtactcacaaaggcctccagttctcaggaagggaagggtgaattaaatgtggttagctatcagggatttttttttttttttttttttgagacggagtcttgctctgtcaccaggctggagtacagtggtgtgatcttggctcactgtaacctccgcctcacaggctcaagtgattctcctgcctcagcctcctaagtagctgggactacaggcacgcaccaccatgcctggccaatttttgtatttttagtagagatggggtttccccatgttagccaggatggtctcgatctcctgacctcgtgatccacccgccttggcctcccaaagtgctgggattacaggtgtgagccactgcgcccagcctatcagggatttttatgggggttccaaggagtggtctgtgtagatttaatatcaccctagttaatggctgaggcactggctgtgtaagcccttgctaagcacagtgagtgagtgtggctggaagtgcaggaggcctgggtgggatgcaggctgatccagggctggcagtcactgtgtgcatccaacctttaggcgagagagggctgctaaactctgagaaggaattcagggtgaagaagagctgatgtgccaatggtatggctggcacaagcctaagcagataccagctattctcctgcaagctgatcaaaaatatttttattacataatacttgacatatacaagagaacaatcatatatattagacatgatgacagaatgaaaacctgagcctcactatgtccctgaaggaccagaccgtgactaggccgtcgtgtccatctgtgggtcctcctcagcccattccccatctccctctagatgtgaccacatcctgaattttacctatttattccattacttaaaaatactggtttttggctgggcacagtggctcatgcctgtgatcccagcacttcgggaggccgaggcgggaggatcacctgaggtcaggggttcgagaccagcctggccaacatggtgaagccccatctctactaaaaatacaaaaattagctgggtgtgttagcacacgcctgtggtcctagctactcgggaggctgaggcaggagaatcgcttgaatccaggaggcagacgttgcagagagccgggatcacgccactgcactccagcctggagaccctgtctcaaaaaaacaaaaaaccaacaaacaaaaaactggttttcccaggtaataatgcctaaatgaaatgttttattttgcctatttttagcattataaaaatggtgttatactgcatgtggccctctatgttgagctattctctctctgcattgtgtttctaagtttcaaactgttcctggatcttgctgtagttctcacatgctcacagttgcataatagtccatctttagaatatacagtttatctattttgtctcctggccatggatgtgcatctcgctgtgcacagcagggaaaggtgttcatggaggtacctgcctaggcgtggaactttgggttgcaggatgtgtgaatgttgagctttacaagatgatgccaaactgttttccaaagaggttgtgcccatctgtgctgtcatctttgagattgtttttcccatggcccaaggcccttcttcccgcccgaggcaagcccactcctgaggactccactgccttgggccttcaccgtctttctctcaggatcccattccctactggaaaactctttcctttccctcctccacttggccctgaacttcccaggatttttcaaaacccagcctggagctgccgtcttcctgggagtcctctcagcctcacttccactctctcccaggtttttggaacagcttttccagacagctcttgggccagagtaggacatcgcatagtgtgtttcttataacatcagccccacataatcctgttgagaaaggcttctggagtcaaataaacttaagaatcgccacaggcaacttggagcctcttggtgtttattgttctcatttgaatattagcagctcattagcatagttgcagcactgagaggtcctgccagtgtgacccgtttttatttgtttaacttgttttccaaaaatatttaaccttggagcccttttcccattttcccccatttggaaaatgggatcgagaagattctcctgcctatttcagtcagtttggttttgtggtcttattttcctcggtaaccaagctgagagtcctctgacttctgttgtaatcatcccgtgtaaactagttcagtccagaccaccctttctggagggcttgagtggaaggaatgaatgaatgcactcaggaattaatgaatgaagcagtcagccaatcagtcagccatccagctgagccccctctcctatgcagcagccaggaaccagggactgatcaggcaccgctcatcttgcaccaggggacacccgggctgtctggctggtgaatcattctcccgtcttaggtcccctgtagttgcatttttaggatctgtcacccaatgaggctgggagcccctgcggggcaggaaccaagttgcgcttgcctctctgtgtgccccgagtgggacatacagatgggatctctcatccaactccttctgagaggggcaggagaacattgtggttaagtcttcagcctctggagccagaccagatgtgtccctaattacctgggtaatgtgggccaatctctgcctcagtttccccactgagataggggtgatgataacataccttccttacagaattattatggggttaatatgcggcaagcacacaaacagtgcctggcatagaggatgtcactggtctttattagcactatgacaatggcaaccaacatttattgtgcacctactatgtgccagggactgtgataaaagctttatctacatcatttcaattcttcctccccgcagcctctttgaagtgggggatgtttttctcattaggaagttgagtcctcccaaggagacgtggtaatgggtggtagcaataagatcaggattggggtcagccagatcacaaagccctggcctgcaggcgtggagggtgccacctaccacctgcggatgggacagctcctctgtttctttttactgataattaccctgccgacaacctgatcagttcttttttttttaatcctctattcatctcaacaaaatggaaatccatggtactgcaagggttagaatttaacatgtgtgcacacgtgtgtgtgcgtgcatgcatgtgtgtgtgtgtgagagagagagggagagacagagacagagagagacagagagcaagagtgcacaagtgaaggagaaggagttatctgagaagcctgggggttactagcaccttcatgacagaccaaggaagacagagatccccgggtggggctggctttgagactgcacagcggcagaatcgcttgtgagtcagcagtgccgcagaacagcagggtgctccggaactgggcttggtgtcgtcacccactgccccttgcacagggccctgtgtgccgggaaatgtttgcaggctggacacctgtggttgcttttaaccaggcaagtgagctgggttagaggtagccacatgttcctgagggctcgcagctttggatctgagagggttagacagggcgtcaggggctgagggtcactggaggagaatttgctgtcgtccctttgcccacgggccggctggtcttctcagaccccagaggccagctcctctgttcttccccacctcggaggggagccccagaagtcacagggtcagctgtctgctttccacactgcctagggctttattcttgcaccatccccagttctggccacaccaggggagtgagacatggggcgccggtagaggggctgaatgcgctggtgtggggtaggaggtttcggatgcacattccagagggtgtttatgggggagcagacaagcctggggattcattcctggtagggaacaattccctcagcacccgagggtgggaaatgagggccaaaatggtggctcagagggacacaggtgaggtaagcaggtaagaattcccaccaggtgtctcagaaatgtcctgggaagggcctggcatggtggctcacacctgtaatcccagtattttgggaggccgaggcgggcagatcacctgtggtcaggagttcaagaccagcctggccaacatggtgaaaccccgtctctactaaaaatacaaaaattagccaagcatggtggtgggtgcctataattccagctactcggaaggctgaggcacgagaatcacttgaacctgggaggtgcaggttgcagtgagctggaatcgtacctctgcactccagcctgagtgacagagcaagaatctgttaaaaaaaaaaaaaaaaaagaaaaagaaagaaagaaagaaaagaaagtcctgggaagctggtggaaggaggtcgagatcttcctgacctgggaaaggagggaattcccaggcatctatagaccaataggactgtcgaaagtttgactggtgtgagaatgggttaaggtgctgaattttagatttttatcctctccacggtggtacagtgtgttctgcaaacaaaggagagccagccttgaagagcccttctcagagctgactatgttctttggctcctcagcccagtgagatggccttagctctgagccctgtgcaatatgcaaactggaccagatgacccccaaggctccttctagctctgacaggtcctgtcgggggatccagcctgcatatagggcctgggcttctttcagccccatagatggtgacccctcttcaccgctagtaagattgaagctcatcagcaggacctcaggccctggcctcctttcttcttggtcccttgggttttggagttttatgtgacatcaatgtcccagaaatgcccatcctcttccttttctctcagggcacagtcccctgaggtcttgtggtttatccacccccacccctgttctatgtcctccttcacttgctctcccccacgcccctcccaccagagagtttataagctggctgtccccttgctaacctcctgctgttccctatgaacatgcctgttagatttcaccgtgtgacactgtcttggttatgtccccgtcgtgcctagttcagtgaagaacacatagcaggtgccgaataaatgcactctgctgggataaactggttatctccagagggtggggtctggacagagtggcaaaatagcgatagcatgggatttggggtccaactccacctccacttcctggccgatggcaatctgtcattggtaaactggagccggcatctctactctcagggctgttgagaggattcatggagaagctgtgtgaggaaatgctttgcaggttggaaggtgctgggaacgtgtgtcatctaccctggcctctctctcaggaactcttgcccacatttgtcagcatctgctgggtgtgttgtcttgggagaggtcttgttaaccctctgccaccttgaattctctggtcccctgaaattctttgtcctgtctcacacacaaatgcctccagccctcaggtcgggggtctcctctcctcctgcaatgccttgggcgtgggtccagccttgtctgagacacagagaaatggacctccagtgcggaagatctgcaccaacattcgaaagaaaaaagactgataggcgggagcccagcatttgaatttacagggatgttaaccccaacagcggccggagcagcagagcaggacctgagcacttccttccctttctccttagccttccatgaacatgctctctataaaccctgtcctggtaaatgtctcccctcattttttttttttttttttttttttttttagacagggtctcactctgttgcccaggctagagtaaaatggctcgatcttggctcactgcagccttgacctcctgggctcaagcaatcctcccaactcagcctctcaagtagctgggactacaggtggtcaccaccatgcccagctaatttttttttttttttaattttagtagaaacaaggtcttgctttctcggctaggctagtcttgaacacctgagctcaagtgctcctcccgcctcggcctttcaaagtgccgggtttacaggtgtgagccacctccctcagccctcactgctttttttgccatctcagtgccaccatttcctagctatgtgactttagacgagtcacttggcctctctgagcccatgtcatcatccgttaaattgggttctttggcaaattaaaggatgtattctatgtaaagtgctttacatggcaactggcacatagtcaggcctcaataaatgttaactattattattaataatggccactggccaggcgtgatggctcacacctgtagtcccagcgctttgggaggcagaggtgggcagatcacgtggtcagtagttcgaggctagcctggtcaacatagtgaaactctgtctctactaaaaatacaaaaattagccaggtgtggtggcatgcacctatagtcccagctactcgggaggctgaggcaggagaatcgcttgaacctgggaggcagaggttgcagtaaaccaacacggcaccattgcactccagcctgggtgacagagcaagactctgtctcaaaaaaataataaaatggccactctgagtgcctcagtgaataggctccttactaccttacttagagcagagttgaggaaattggtgaagttcttcactaccttattagccactctctacccaaataaatgtaccccaccttatcttattcattatgggtaatcacctgtaaaagcgttctttatttcattcacagcctgagtgtccccaaaaaggtgctccatgacgtcatcccccctctggaggacacctcctcccacccatggtgatttgagccttctcttaggccagggtgattcctgggggaaccttaactggggctaatgtgcactgacattttgccttttgtgtcgaacacacatcccatttgcagagatttagaattttttgactttaaatgttcgctatttctatgtatgtgtaagagagagttgttttcttttgttttgttaagagacaggatctcactctgttgcccaggctggagtgcagtggtgcaatcacagcttactacagcctcaaactcctgggctcaagcgatcctcctgcctcagtctccccagtagctgggactacaagtgtgcaccaccacacccagctaatttttctgtgttttgtagagacagcgtctcgctgtgttgcccaggctgatctcaaattcctggcctcaggtgatccccctgcctcgaaattctgaagtgctgtgattataggcatgcgccaccatgccagagagagagattttatcttttctacacaacgtgtgtttcccccagaagaaatgccttcctacttctgtgatgaatgtaagtagaatgcagacagaaattacagaaactccctgtgccccagcacccttaccagggcatgcctggcctggtggagtgacagggtgttgtacacagtgaggggaaggaagggagtgggagaggaggtgaggctctgcagagcagagtggaccatttctggtcagaaaacagtgaggaggccgggcgtggtggctcacgtctgtaatcccagcactttgggaggctgaggcgggcggatcacttgaggtcaggagtttgagaccagcctggccaacatgttgaaaccccgtctctactaaaaatacaaaaaaatttagccaggtatggtggtcctcgtctgtaatcccagttactcaggaggagaatcgcttgaacctggaagacggaggttgcagtgagctgagatcacgccactgcactacagcctgggtgacagggcgagactctgtctcagaaaaaaaaaaaagagtaaggaaagcgaagtcctgggttggggggaaatgtagctgcaggcaagaaccaaggaaggtgtggagcccccaacccagtagggaaaaggcttgctgccttgaacccaaagagtgtgagcatcctgtacctttgcagacagaacttccacctactcacaaacagatacaccccactgcacagctaagaaagctaaggggaaaccaggaagaagggaaaagaaaagaggaaaaccccagaggaaacgaggagtcaggcctgggcagggggttccagatgacgcatgaggctgcaggaggaaaaggtttcttttgaaacacatcttttatcctgtccttttccgatgtacgtgagcgtgtgttttggaacgcacataaaacgcgagcgcagtagccggcctctgatttctgccaaggtggacggaaacggaggggcgtgcccaaatgcttcttcttcatggctgctggatcagggaagttttgcttctgtggccgtgaacatggagatttgctgagaggccaaggagagagatgatgggggagggctacttcgggagaggaagtggacaagaccagaggttggaaaacaggggacgggttgatcctaacaacttggagggactggtactgggaataggaggtggggcccagggggagggcagaggacccaggagccccagctgtggacccagggtggggctgtgggcaggtccccagccctgtctgtgacctagggcagtgcttctcaaccttgagggagggagggaggataccacagaggggagggagcacctagaccacttaaatccctttctctgcagggggcccaggcagccttgtttctaagctcagcagggccacttactatgcagccagggatgagaaccaatggcccaccctgctgagtgctggaatgtgtaatgaagtcctgcgtgggtctgtaatgaacccagattcggctcctaacaggtgctgagtgcatgtttgcaaacccaggcgcctgttgcaaggagaggacagagctaaagcaaggagcctgcggaggaatgggtggcagggactgatgaagttgggggaaggaggtgcagaggaaaatgttgaggctcgctctggactgcctcgcctggggatggagaatggggctgcaagggaggggcagccagcgctttgaacttgggtggggcctccctaaatagagtgggggaagtccaggtgctgggcagggctgtcttcacctgcccatcctcagcgccgtggggggatgaggcgcaaagaagccctcctgggaatgtggtggaaatacccaccttgaaaggtagagagtggaatcgttgccctgagcacctgggtgtggtcgcagcatcccccgtgaggcctcccaacctgcagctgcctcctgcgtgcgcatctgccactgctggctttagggccagggccaggcccagctggaggtccaagctggagccctgggcagtgtccagtgcactgtggcctcaaagtgcccagccatggtttagtactccagctggcaaggccctgggttcaaaccctgctctgaatttgtccagttgcttccccatggtgtcatttggtttgttcctctgtcccttgtgttccctgataacaagaggttacctctcaaagcttggttagatcagattaaacgtctttggccaaagaacatcatagggaaggttggggccttcctgctgcatcatctcataccattctactgtcacacttctggtggaggcttttaatgatccagtttcctggactcctctccagaggctctgatcctgccacgctggtgttggagcctgggtgtctgtatttttcaaaaccaccccaagtgatctgccgtagtgtatagcctgcatccctgaccccagtagccagctggtcagggactgtccttggttttctgaagagcatagaataagagagtggatgggacagtccaggtaggtgccagccctggtggccagtgctatcaggtgtgaggcagggagggtggcctctgggcccccataaagaggagaatgggcttcctcagggcagctccaggttcaggtaagagtccttgcaagaccaggagtgccccacgcactgtgctcccggcgtccagcataaggcctggcccagcgtgaatgtttattgaataaagacacacaccaggctggtggctctctgaggagccctggggagctgctctaagagtgagctcccagccaagcagcacagctttgtgtgttccccactgggctgcttctaagattcaaacaaaggactcccaaactgtggagctagcagctgtgttaaaaggcccagagagccagcagggccatggccatcacctgccctcagctcgccgtggagacagcctgtgggacctgggagagacgaaggaaaggactgggcactcagtggggctgctgagggcagtgaaaggaggcagggaggtcctcgcagggaggtcctcgcagggccactgcacctgctgaagcaggtgctagattctacatggaaacgagtgaaagaatccctcctctcaaaaaactcaccatcaatggagtcggtggacaattcacttgagtgcattgaaggttacctgtgacggatgtataagagctggggaaatggccagagggaacaatttgaattggagacattaaaaggggatttaaacatgggaccttgagggatgaatagaagtctggagtcagaagcgaacaagagggctgggcaggctatgtcttgtcttttaccagaactggcttgaagggtatagcaatgtggggacccagcaaaatcctggtgtgggaaccagcagacttggctgctcagaacggcagcctaactctgtaaggttctcatttcccaatctgtaaaatgggagactgacttagggtttggaggggtcaggaaggggagaaatgttacaaggttaaaatgaactaaagatgcaaacatggcttaggaaaaatttgaattagaattccacttagtggagtgggaggcaaagaaacagatggccaagctccaggaggaaaagctggccaagctgagctcaacttcaaggcccagctcgaatgtcacctctttgaaggggacttctttgccttctcccacttccttcccctcagcacacctattccttgaagtcccaagtgggacttctcacactctgcaactgactggtcacctgcactgaggtggggtcactgaggagggtggaggctacatcttttttttttttttttttctgaggcagagtctcactctgttgcccaggctggagtgcagtggcacaatctcggctcactgaaacctctgcctcccaggttcaagcgattctcctgtctcagcctccagggtagctgtgattacaggtgcccaccaccacgcctggttaattttttctgtttttagtagagacaggcgtttcgccatgttggccaggctggtctcgaactcctgacttcagttgatctgcctgccttggcctcccaaagtgccgggaatacaggcgtgagccaccgcgcccggccgaggctacatctcatacatcttgggcacatagtatgcaggtactgaatgaggcccagccttcagatgatcaggtctggggcacttcaagaacgatctgcgtgctatgagagagacaagctctggctgggagtcagcaggcctgggctgtgctctctgcactgcctccaaccagtggaggaacagcagggaaggcacatcgcttccctgggccttaatttccccaaggagctgaactaggtgatgtcaaaggtcccgcttagctttgacattttatgacctaacactgtaatagaatcactaacatgcgtggccatttacagaatgctcctaaagcccttccaggacactcctattgttcccccgcccccgccctactccaatagcaagaaaactttcacaggtggagacttttcttcaacaggtctttattggctgggcacgctggctcacacctgtaatcccagcacttggggaggctgaggtgggaggattgcttgggcccaggagttcgaaacccagcctgggcaatatagcaggacttcatctctacaaaaaattttaaaaacttagcagagcatagtggcatgtgcctgtagtctcagctactcaggaggctgaggtggaaggactggttgagccaagtagttcaaggctgcagtaagctgtgattgtgccactgcactgcagcctgtgtgacagagtgagaccctgtctcaaaaaaaaaaaaaagaaaaaagaaaagaaaaatggcctttactgaacatctatctttgtactgatgagcacccccagagacacctgggcccaccagggtttctagaatgttctagaatgttcagcatcccctgagttgccaagactagacatttagggggagctgtatgacaatcacccaaaactgatgggcagaaatgctgtgaccccaagtaggcctctgggccttgatgacatcctcagtaacagagagcacggcacccctttgtgtgtctgaaggcagagggctgggaccctacctgagcacgcacagggcatctgggctttacctgggagtcctgaactgcgcagcaaagtggagaaacggacccagctctcagcatgtgtccttgggagctgctcccctctgtggtcaccaggcagcacttgcccacctgtgggcttggtgcctctcagggagacgctctggggtctgaagagtgaggtccctgccttttacccgtctctggacacccctctgggcctaggcccttccctgtgaatcccctgcctgaaggaagagacccacagccctggggttcctctggggtgccaagtgggggactgtgtttggtcctggggaggatgggctggggctgctgagcaggccaggggtgcaggacccctccatcccccgcttctcctgtcctcctccttcttccacccttgactcctctcacctcttgtcccctcttccctcctgtttccactctctttcctcctccccaggtcccaccagactgctccatgccccggaccacaatttggctgaaggcaacaatccctctctcgcaccctcctccctttttccaggcttatcaacttcactttcctgtgaaatgaaggggtgggggggtgggtaagaaagaaggaaaaagcacttcatgctcacaacacaacaaaaaacaggtttaaacattttacaggtttcaacatttttcaggcggtcttgtcacatcttatcagatcagccagagccgcaggcaggcgctccaggagctgctttggagaacagaagctgcaacattccagcccaggcactgccccgccctccacaccccttccctcccttcccttttctccccaaagaaacatcccacagggctccctgggatggagcacagggcccgcagcctcttccctctgactgaggtatagtctgtggccaaacccttggctttgagcttctgcccgcaccctttccttctccccacggctgcccagaaccatggtcctcccgggctctcaggtggtccctggcagctgagctgtgccacctcctcggaaggcccctcgtggccctgaaagggaaccttcagaagctgcgggcagaagggagttgctaaagtcgtccacagcatgtagaagtggtcatttggccagcagggctagtgagtttccggggctcctggggcctgtcctcgggggctcctgtcggaggggaaggaatagctttttccttggttatcttttctccgtgtgcatgggtttttctcctatggcgtggatcactgcctgggatatccccttccactcagtcacccccagacctcacctttctgttcctgctgcactcacggtgacattagtgacacaatgcagggtgacaggtccaggaagggctggccaaagcccaaaggctcagagttaagccgaggcaacgtgagggacagacccagaacctggatcccaggacaacagggaagagctggctttgtagcttgtaacaggagcatggttagggctgggaggtcccactgtgtggtcagagaggggtccccaagggaaggcagctgtgcactgaaggcttaggatgcatcataagaaaagcaaaaaggggaggccgggcacggtggctcacgcctgtaatcccagcactttgggaggccaaggcgggcagatcacgaggtcaggagatcgagaccatcctggctaacacagtgaaaccccgtctctactaaaaaatacaaaaaaattagccgggcatggtggcgggtgcctgtagtcccagctactcgggaggctgaggcaggagaatggcgtgaacccgggaggtggagcttgcagtgacccgagatcgcgccactgcactccagcctgggcgacagagcgagactccatctcaaaaaaaaaaaaaagaaaagcaaaaaggggaaagcgcagaggaggtaggggcacagtggctccctctgtgtaggtatgttggctgtgcatctcgtggggacctcgtccggaatatggaaaacacaagccagacctgggcgcctgctgccagtgttggctgggcaggggctgaggtttcgggagagcccacctttccagcctcctagtgtgaggttcaggccctgaagctgggctggctgccccttggcccccagccccctccctggtgcctccaccccttggcatatggcatcaatgctcccaccgtgacgctcagtgtcctcccaccgtgtgcccacagccaagatggggcctaaagtataattcaacttttagctccttacaagcatccccagatggatttctagcttccgtccctctcttgggcccagctctgtctctacgtggtgcctggaagtccctctggccccacgcacttcctcgtcttgttcccaaagctgctttgcttcttaccttcccatcttggtggacaccatctccatcttcctggtcatcctggctcaaaactttggccatactttcctccttcctcctgtttctcatgggaccaaacggctaccagtccttattcacagcttcctgtctgttcctgaagccactgtcctgagatgaccagcgggcccatcccctgccacagaccccggtgacccagacacatgggtcttggcccagctgcacaatgagagctgagccctgggaggttgcaatggatccccaggccccagagtctccttagcatccacgtcaaccccgcctcccagccgctttcccagcacccacctcttgtctcattttgcacataactaacaggatgatattccaaagcccagctaaggaaggtgctagtttgtccgaataatgtctggcactcagggcccctttctagctgcttcccctcctctgcttctctgtgtggctcctagaccctggcttggggaggcatgccaccttgcctggggctgtccccctgccacctggctccacctgagggcccctagccatccttctccagctcggtagctgctccacatggagccctccagaggcagtgaggacacacttgcccccgttcctagagatcgctcgccctgaccatgcaccctctggcccagaggttactggggctgaaagttacaagtgccttgggaccatgtctcactcatttaaggcacccacagtgcccagacctagtaggtgctcaagaaatgcttgttggtctgttactgacagcagcctcctgggctgggtgctcctcaggtgtggcttcattaatctccacgttcccagaacctggaaccctgccaggctgagagtcatcactcaattcgtgcgtgttgagtgaataggcagtgaatgactttgtttaccaaggccagactttaacctgctctctgaaggacaggcacttccactgactccacaaatcaccaggccccagtcttgacagctggggctaaatcaagacaggagcccactgggcttagagcccgggcagctgctccttcatggttttatctcaagaccttgggtcccagctcagggcctgcacccactctaccctcacccttcccttcctgtcctagacataggcaagggtgctcccacccctgctggagatgcaggcgagccagagggccccgttgagagaatgaactagccccgttgagagaatgaactagcccctaatggcaaggcccagagacatgtcccacttctttgatgaaaggcaccccctgaggcaccttggcgctctcccacagccacaggacacagccccacctgagtccctttgggctcagaagaaaccccctacccttggccctgcactgaaatgtcaagaaggtccagacctgtgctcagtacccgcagggtgcacatgtgttccaggagggcgaggaacagtggcagctggaatcctgagctaggtttctctggttttgtcacaagctccctgccaagcagccaggtgagcggctccagtccaggcctgtggcctccctcatccacagcagtgattgcctcgtcactatgggtgtagttgggtgcatcagagcccaccaggcccagccccacggtgtgcacacatgcccctgaactggctaggcttcctgtcctgacatctgccaatcctgaacggcttcttgacctaagtggaaaggtagaggcctgagttccaaagccaacgcttggttcctcacttcctgctctttcctcaaacctttcctttcccttctagaagtttccgtggagggtggagcccttctgggcccaggaacaagttgggcctctgtccagtactgcccaggagccagcaggtggagcacctggccctggcctgttgtggggttgacaggagcaccgtggcccccaccacagggagaggaaaatgaccacaggagaggtgatttctgactccttctcctcaccttccctcctcctctccctctcagcagccatgtcagtcattttaagagacactagatcttcagatcagagtcttaagatgccttccctttgaggctggcacagatggttagatttccgcatggagaaaggtaagggcaaagggcctatttctgcaaagaaggcatgacttggggagacttggccctggagagcaccctgagaccggagggaggaggggagcctttccctgggccgcagcccctgggtccaccttctgcagccccacccatgtgaagccaggtgggtcctttttgtgcccagccccagagaagcttctgagaatgtgcattcatcacccccaggttaaaagcctggtgggtaaaagaactgtgagccctgggttctcctcccacctcctgggcagccagctgtgtgaccccggaaaatgacaaacctctctgggcctcaatcttcccgtatagaggaagagggaattagactagacccggggctctggaatttcgtcctgcacaggggctctaggtgcaaagttgaaggctggggatgcaagcaccatccctcctttgatttttttaattttgctatttaaccattttaaagtgtactattcagtggcattaagtacattccaatgctgtgcgaccatcaccaccgtctgttttcatcatcccaaactctgtacttattaagcagtaacttcccactccctcccttccagaacccctggcaacctctgttctactttctgtccctgtgaatttacctagacacctcatgtaagtggaatcatacagtgtttgtccttatgtgtctggctgctgtcgcttagcttcttttcaagtttcttctatgttgtagcttgcatcagaatttcattcctttttttttttttgagacagagtcttactctgttgcctaagctggcgtgtctttacctagaacttcatgtaagtgaaatcatacagtatttgttcttccgtgtctggcttctgtcgcttagcttgttttcaagtttcctctacgttgtagcttgcatcagaagcatcagaatttcattccttttttttttttggttggggggacagagtcttgctctgtcgcccaagctggagtgcagtggcgcaactggctcactgtaacctctgcctctcaggttcaagcaatactcctgtctcagcctcctgagtagctgggactacaggcacgcaccaccaggcccggctaatttttgtattttagtagagatggggtttcaccatgttggccaggctggtctcgaactcctgacctgaggtgatccacccgcctcagcctcccaaaatgctggcattaccgccaccacacccgcttccttcctttttctggctgaatagggtcccactgtatgtatgggccacctgttgtttatccattcatctgctgaggactcttgggttgtctctaccttttggctgctgtgagtagcactgccgtgaacactggtgtacaggtgtctgttggagtccccattttctttcctttttttttgaaacagagtcttgctctgtcacccaggctggagcgcagtggcgccatctcagctcactgcaagctctgcctcccaggttcatgccattctcctgcctcagcctctctgagtagctggggctacaggcgcctgccaccacgcccggctaattttttgtatttttagtagagacggggtttcaccgtggtctcgatctcctgacctcgtgatccgcccgcctcggcctcccaaagtgctgggattacaagcgtgagccaccgcacctgggcggagtccccattttcaattcttttgggcgtataccaggtgtggcattgctggattatagggtgattctatgtttaactttttgagggacagggccctcttttcatatgttctgtatgtaggggagaggagggagattgtgtgtgattccatttgggaggccacctggttgggtgcaggactgcctaccctaatggatcactcaggggagtgggtgctggcagcacagtgggtgtccctggcagcacagtcagacccccatcagcaggggattggccgtcactgggtggacggcagcatctgaggccaacaaccccagtgtcagatcaggcaggacgcactgtacagggtgcctttaggtgtctcaccatatgttaggtgcgtaagtcaatgcagcatccaggctgacctgaattcactgattaaaaatgttctctaaaaatgttctctatggccaggcatggtggcttacgcctgtaatcccagcactttgggaggcagaggtaggtggatcacttggtcgggagttccagaccagcctggccaatattgcgaaaccctgtctctactgaaaatacaaaaattagctgggcatggtgacgcatgcctcttatcccagctacttgagaggccgaggcaggagaatcacttgaactcgggaggcagaggttgcagtgagccaagatcacgctttgtactccagcccgggcaacagagcaagattctgtctcaaaaaaagaaaaaaaaggtcctctctgccttgtgctcaccatgcaggcctcctgcagccctctggccacagcaggcgttatcagggtagaggcacagaactggggtggggatgggagttagataaggccatgcacaaggtttaggtcttgcctatttgtggagggatatttcactccaaggggtcaacaccaaagtttccacaagcagcccgttgtgcagggcacccgcagcccatccgcctggctgcccgtgtgtgtccttggcccagctgggcagtgggtggtcggagtggaggatgagccggcttcaggaggagggtggcagggtcctagggaagggaagggccgggccaggagctgggtataaatagcccctggcccagctgcgaaggcctggcagggtcctccgccctccccctcaccagctgtcagtgccaggcaggtctctatcccccttgggagcctggccatcatctcagatcctaaacgtaggaacttcctgagcggaaccaaggagtcttgtcctgtgtgtaggcggaagctccggatgccgggaggtctggcgagtgaggggcatcaggctcgtcctttggaagagttcttcattcctttcctccagaatcatgaatacctagcatgtgcccggccctttggaagaccgagtgggctggggtgtgtgtgttgtgtgtgtgtgtgtgtgtgtgtgtgtgtgtgtgtgtgtgatggggtagggaccggggaataactggagaaaacactaccactacctctcttcttggagactgagactggcatagccagatggaattggaaacaaatcagttcagcactttgggataagaaggtttgaattaggtacaggaaagattcaggcggaggagaggtgacttctgtctggagctcacagaaggctttagaatggtggtgacctaggaatcaggtttcgaaggatggtgtagaatggttgccgggggccgggcagtggagaggtgcttcgagccgagggctcagcatgtgcaaatgtgcagaagtgtgaaacagccccgctggagtcattcagctggctaggcaaatccgtcaaagccacgcacactttggcacaaagaatcgaggagcatgagagtcactgtgccgcctcccgaagtggaacgtgtacttcaataatggggaataggagtggcgagttaaagtaatgtgtctgcgatggtggaatttcagcagtgtgcgggcaggaggctcagggtgggggtggccgggcatgtttggggaagggcagccatcctgcagaaatcaatcccatggccacagcctctttagtctccgacactggcccaggagctaagccccatcgccagaggccttgctaattactcgcaggatgaccccatctgaactgaagcctttgaatggagcatcctgaaaatgtccttttgcctgcactctttgagtgaccttgaaccctcatccagatcacaactgtctttgttctgccacccctgtgaggactgaggtctgatccaggcatcctttccagtgttggataggaaggggctgagatttctgatgtgttctaccaagtcagggatgcaaggatgggagaaatgaggttggtgacaaggcagggaacaaagtgctggggacagctccacacacaccgtaaccatagcaaccaccatctagcaagggctccccacgtgccatgcactggattgtgtcacttattcctcctgtcgtgtctattttaccgataaagaaactgaggtatagaggttaagaaaattgctgagatcagcagctaggaagtggtagagctggatgggaccctggcaccatggctcccaggtccacagttggtgggacctgggcaacaggaaggagacagggtttggtggaaagagggaaaacagctcatcatgactgaggctcaggaattgttctcagaggacatcacactgggagtcagacaaactcagggcttgaattctggctcagccacttccttgcataagtcgcccaactactccatgcctcagtttcctcatctgcaaaatggggataacaatgcccacctcccagagttgttgtgaggattcagtgagattatgtatttgaagtgactggcacagagcaagtgctacataaatagttgtcattagtattgccagtatccgggtaactgtggggacagaaggaaatccctgtggggcagaggagagactgcgtctgcacagcaggaagggctcagtggcaccttcttcctggagatgtctgggaagcactccgacctttgaggccaatcaagccatgcaggcagtgtgccagagctcaggtgctctgctgggctgcgaagacccacctgggaccctgagggaggtaactggtgaaaccaggaagcagggagccccttggagagctgggtgaggagccgccttgccagcatgggccccccgactcctcagtcccccaagccagccggcctggctttctctgtggatatggctgtgtgacctcgcacaagttggtcctctttcacggcctctgctttttctttttccttttttgttttgagacgaagtctcgctctgtcgcccaagctggagtgcagcggcatgatcttggctcacaacaacctccacctcccaggttcaagcgattctcctgcctcagccttctgggtagctgggattacaggcgtgagccacctggcatggtcggcctctgtttttcatctgtataatgggctttgtgctcccttagggctcctcctgtgggttctgctgctggaccagggctcagcctccagtttagcttgagggtgcccaggcctgcagaaggtgtcaagcaagggctgggagagggggaggaaggaggaggcaggaaggcaacgggaggggaaggaggagggcagaggaagggtctccgagtgcctctcactcccgcctcagctctccgctccagtggtcccatatagggctctgggtcccaaacaccagaggaaggagcggggacagcccaggcttcttccctgggtcttgttcctgagctgcccatctaggatggtgcaaggccgagttgtctgcactgaactctccctcagtttcccctccagtgattgcagggctgtgggggcagctggcacagcagggctgggctggagatgctgcttaagagcacgggaggggcagcctgagcccagagggaggctcaacggggacctttgcagcctggcagacagggcagggtacttagctccctggcctcagtttccttatcttggaaatgggacaatggcgatgataatgaagtttttattacagacctgccgtgaggattacataaggtaacagacacaagcactcagaactgtgtccagcacatgataggcccataataaaccacagggattatatgatcactctaacctgcttctaacagggcaggggcagtgctgtgtgcgccgtgtgcccatcagggctctgggctcactgactctacccactcaggcatgtgctcagtatggaggcccagggtgcagatgggccaggcctgaagccaccttcaccccatgaagacccaggcaggcactgcccagcaggcagggtcacatagtgatgacccccatgggctctggagtctgacaccctgggttccaaccagcaattccataggagctctgtggtctggggtgcttcatcaacctgcaaggctaagccatctgtaaaatggggctaataatgaccctactttgtgctggggctattttgaggattaaatgaggcaaacccaaggaaaagcctctgctcagggccaggcaccggggaaatcagtaattagccattaccaccgataaatcagaacttctgggccgggcgtggtggctcgcgcctgtaatcccagcactttgggaggccgaggtgtgtggatcacgaggtcaggagatcgagaccatcctggctaacatggtgaaaccccgtctctactaaaaatacaaaaaattagccgggcgtggtggtgggcacctgtagtcccagctactcgggaggctgaggcaggagaatggtgtgaacccaggaggcggagcttgcagtgagccgagatcacgtcactgcattccagcctgggtgacacagcgagactctgtctcaaaaaaaaaaaaaaaaaaaaaagaacttctggctgctgcttctttctctttagaaaaagctcagtgcttaagacctggaatgcctcacagatgttaccatccaaactcccagatctggctcctcagttcctccacccaaaataaacaaatggaaaaaggagaacctgcctctccccctgacaactgagcctggagacaaccaaggtggatgggtagcatgcccctgcacggtgcccagggagctctgtgccttggagtctccacgaattggccaaggccaacatcaagctcaagtatggaggagggacccgggggaaggcacatggcactctctgacccaccacagaccaaaaagccgtaggcaagctaattcactctctaaacctcagtttcctagtccaggagatagtgatgttcttcatgtttgggaattgatcagaaatgttgtatataaagtgcctggcaagcagtaacagttgccaaatggcagatgtttggctcggccctgtgtccagcccagaagcttttgtgtactaaaaagcacacaaaaaacctcaccctgccccatggggtcttctcccggcccctctttccgaggcttttgcccatcactttttgtgggaaacttgacttaggccaatgctggaccaaagccttggtcagtgctggacacagagggagaggagatgggccccttcttccagctcacactgcccctggtcatagagcagattgcaattgtccttgaaggccactgacactcacggatcattttctcaggttctcccagaaaatgtcatttctgctgttcctgtgctgagggcagggaacggaaaagtcgtaattcctaccttggttttctagtattttaaactcttctgccccacccccataaggtcattctttctgttgttgactataaaacctgagagagttgatgggatattgattacaaagcgaggggcagaggaatggagtgaattgaccagtcacctggtgttgggtgtgggcagtgagatctgagatctcccttctgactctgtgctaaacttgttttgacacaaagccaagctccagtctctcatgagaaaagaggtggagctctagaaacttctaggaaactggaaagatggtcatggaggccctggtagacaaaggacttggtgcaagccagcaattccttggggagatactgggaggctctgggctgggctggcaccatcgcagggaagaggctgagggcattgccaagggtagtgtgtgtgtgtgcgcgcgcgcgcgtgtcccatgagtcactggaagtgtccatgtggccccagtatcctggactgccttggaaattgcccagcctgatctcttcaatgcccatcagggaagctggacccagaacctggaaaggactggatctgggccccaaataccatctttctagtccaaacctcttttcatggctttgcattgcccccaagggcccccacaagcggcttctgcggtcccatccccctgcaagctggatgcagccagagggctgacttgcgtgggtcagagctctgcgctttgaggggcggcatgctcccgaggtcaaaggtagcacattcaggtgccagggcacaggccctctgcctctccacctaccccggagggttcacaaagcggccatggtgcccaggatgggctctgtgctttgtgcccacagtgttactaccctctgtctgcctgcaggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaaggtactgccttggggctgagggggggggaggggctgggtggggggagggatcaggactgtatgcccttccaccccagtcagggtgcctcttctctgaagccagggtccctctgggagggtgataaatttggttgcatgactgccacaccttcccaggcgctgctgggggctgggccgccttgagatgctccaggatcctgaggtttgagggccgacaccaagaaggccacagacttccttcctggcttttgcacagtgggcgcctcaggctcctgctgtggacatttgtgacatttccccaatgctgtgttaagtgctatgcaaataccgctttggggtgggggtgagagcattgccacccctaggtccctcccatctagaaagtcctcagtaggtgaggaagctgcctggtgctgtggtagcattgcgttgcccccaagagcccctctgggtttctgttcatcctcatgccctgtcagctggatatgcccaggaatcatggtggggctagagggtgcactggcctctgggtaactttccggccgtcttgcagcctgggagtctaactggctgtgcctcaagtggacagggaaccacatgatttgactttgaacctgcaggccctgggagggaggctaagtgggacaactcctcccaagaaggggacttgggggctcatggactgggtggaagatgggcagctctttgtggaacggcagtgtccaggaatttaacgatcctggccgggctggccacagccagagttgctctgccacccaaaccgctgagcctggccctccctcctattagaagctagggaatgaatgagagctgcctatacagccagaaagaaaagggatctgacgttcaggtgaaggggtggggtgctgggtggggttgggggggaagctgacaacccccattttagagtgcagttcccctttaccggtgcctcaggtgctcagggtctgtcccacctacaggcaaagtgctggctattgtcatgggacaggagggtaattagcaaatcaatggatgatgattctgtttacgcttctattgccaaaactaattattccttgttgacataaaagatttggcctcttaattggggccaagtggcggcggtttgcatttcaaactcgttcttgtcggtgtgttggtctcagcgctttccggtgcccctcctcgggccaggtagcgctgaatcaaacaaccctgcgtctagacgcgctccccaaaagcgagtcacctctgatcgctcttcccgtctccggccaagagccaggggaaagcggctctgggagcgctacccattcactccgcgttgaacgttttaagtcaccaccgtaggttctggcacacgccccggtccctagatggcccgaggacaggtttgggttgcggggggaggggcgatgtgtgcccgagagtttgggaatttgctggcggcggcgaggagagcatcccggaagacgccgcgagcgcatacgcgccccggtcggtgcccagagcccggaccttgaacccaggttcgcgcccagctccggccccacgtttgcaccccgcccccggcgagtccccacaccaccgccgcgtgggcggccaagggttaatctctgccccgcgctttgagacccggggcgcagcgggtcgggcagcccggggcgcgcgtcttccgcgagtctgggggcggcggggtcggcggccggaaggggcgaggcgcggcggcggcgcggcgggcccgaggcgcttccccaggcgggggcgggggcaggggcgggggcgggcgccggaggggcctgggcggcctgaaaagcgcccgagcaccgcccccccaccgcgcggccgccgcgccattcacacgccctctggccattcggcgcggcgcggcgcggcgcgggggcggggggcgccgcttcaatggggatttcgcggcccggcgccggggccgggggcgcggcccggccgcgggagccgcccgttgctacgcggtggcggccggcccggcggcccgggcccggcggccgcattatgcgggtaatgcggtgtgacaccgcgcgaacaaaggcggattgagcggcccagcgggccccgccggacggggaaggcacagcggggctgtcagcgccgctcccaggctaatccccgccccgcccccgccgcccccgcgttcccggggctgggaacccagcgcggcccggggcccgggcgccgctgccgccgcgagaggccgcaggccggccggaaacgaggggcgcccgccctgtgaacccgccctcggcccctcttccccgaggcgcccccagggctggggcgtctaggattggggcgagtgagcggcgcggctgggaccccgaggccgggagcacaactggacgcgggacgtcgggcccccttgccgccgtcctcggtcggccctggcagcgcaggcgcggggcgcgggcgggaccagctctgcactcttcgccctcccgtcgttggaagtgggacgggcccctctgtaggtggctcaggagggcgtgggggccgcggagagcggccgcgggagccaagaggggtcccgggcttccttcttgcagcactcggccaacagcccaggaggggaggcgggcgcctggcttctaaataaatttggtcacatttatgaccaattttgccgactaggccggcccggcgtttcacagcctgtgtcaggtggcgagtcacctccggctcccgggtcctgccatgaggagagagatggttgggctgcaggtcttgcaggccttggcctccctaatcgtcaatgtccacatctataaaatgagtaaaactttccatgtgaatgaagcacatgcagagacgatgaccgttgtgaggaggctggagcacacccttgagagtctctcctttccctgcgctggaccctgggacagaaccaggggaactgcccggtgtccctacccttctgggagggagttggccgtgcctgggcgtgagggcaggagaatggggatggggagactgaggcacgggccactgccctcctggtgaggggctctaggagcggagggaagccgtgtccattttacaaaaagggcgactgagaccgagaaaaggagaggggccgtccctatgcatccacgtgcggaaggggtgggcctgggcaggtttaggctgtagattcccaggcctccctccttacagacctggatctcactcaggcgtgggagggctcaggcctgtgcagggtggtctctggactttgggaaggtggagggcagggggtgtgggaccaggacagaagtggctgccttatctctgcagcaacctgccagagctttggtgtcggcgcctgtttctaacaggcactgctttgccctgtggcatttgaggtcctgagctaatcagcagcccagggcctcagtttgctcatcggtgaagtgggaatacccaactgggtctaaaccagccaaagagggtggggaagctgcctccctcttgcctcagggctggtgagctcttcaactcttcctggcctcgttcccctcacgtcctggcctgggaggtggaggcagggcaggcgctcccaggccgggtcctgagtgctgcctccccacgacctccccgcagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacggtgagcccggctaccctccccaaacccttcagggagcagccccccgcttcccctccggagctgccctggcccccacctcaccccttccggcagccctgtgggtcgcgggctccttttccccttggccaggcttggcctcctccccaccccacagccacttcgtctgtccaccctccttcctccttgggcagttcctggactccaccccacccgggatgagtcggcctgggagcatggccaccccgtgggatcaggtgccacccaccacccatcctgtgcaccttggcacgcggtgtagggctgtcaagtcctgggaacctggctttgaattcagcctccactcccttactatgcttgtatgatctagggtgagtcacgttaagttcccagcctcagtttccccatgtgttaaatggagataactcctatttcttttttctttttcttttctttttttttttttttttgagacggagtctcgctcagtcgcccaggctggagtgcagtggctggatcttgggtccctgcaacctccgcctcccgagttcaagcaattctccggcctcaacctcccaagtagctgggattacaggcgtccgccaccacaccagctaatttttgtatttttagtagagacggggtttcgccatgttggccaggctggtctcaaactcctgacttcaggtgatcctcccgcctcagcctcccaaggtgctgggattaccaccgcgcctgggcaacaactcgtatttcatgcgctgtgagaagtggacgtgctgtctacccatgcttggggtgtgaagggggagggaaacatggtcactattctttaggtcttgcctcagtccccatcagttctcttcctgtcacagaggagtagagaaggctggagggaagggggtgggcagtggcagagagggaaggcctggatgtgccccctcgtggggtcggtctgttggccagctgccacttctctcccccagactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccaggtagggctccgggaagcaggggggaggctgggagcctgggcgcagggaatggggttgtttgcccatctcgtcttcttgacgacccccttctgtttctaagctatccaagacacacaagttcccacagccaaaataggaagctaggatttttcaagcatccgtgggaatggtccttgggcagagacttggtggattgcacaaagcacagataaaaacccagtgttggccgggcgcggtggctcacgcctgtaatcccagcactttgggaggccgaggtggacggatcacctgaggtcaggagttcgagaccggcctggccaacatggtgaaacccgtctctactaaaactacaaaaattagccgggcgttgtggcaggtgcctgtaatcccagctgcttgggaggctgaggcaggaggattgcttgaacctgggcgacagaggttgcaatgaactgagattgcaccactggactccatccagcctgggcgacagagtgagactccatctcaaacaaacaaacaaacaaacaaaaaaaaacaaaattcagtgtgtgcacattaggtgccagcaattgattaacatttttacacaagttagttatgagccagatcaaatttttgcatagctgctagctgtcattcttgagcattatttggagatggggggctggaagctgggagacctgacgtctggtcctaactttgtcagtaacttcctgttctttcacttttctgggcctcagctttcttactataaagtggtgatggtggtgaagggcagggggcagtttaaatacctcaagcagcgagccaaaatgtctcctctacccctgaggcagagtcagtgtgcatccaccttgaacttagagggcaagttcctgcacaagcataaatcgtaccaacctcagggaggtgggtggggggaagcggcatataagcccatatcctgacagatctgaagcttgggtggagtggggagcactctcaccgagtttatggatgatgacggggagcaggagggattcaagttcagagtggctgggatgagtaatcgagggatcaaaggcgggtggattttgttcccaagcttcccagaggtggcctgcatgggaggcgctatgcactggccctgggttccacagcaccccgggataggtcagcatggatgaggagtggtcctggacccccggggtggaaggttttaaggctggggtgccctttcttccttttctgtcccctgagaaggagcctagtgtgtcgaggcatgagcatgggtgttggaattaggccctgccctgctccagctcctaccacttgccaaccgtgtgacccaagcaagaaattcttcatagacctggttcctcatctgtcatcctccccagagatgctgtgagggacaaatgaaaggacaccgaggacagggcttggttaattgggaagcacttccctgctgggtcattgttgtctggggtgctgctgggcgagagcagcctgtgaaagggtagagtgccccctcttcctgcagttccacagggcacctctgagctactggcacatgtctgtgccatagggagtaggggagggaagtggacgggcctctctgagatatgggaggtacttgacgtcatggagaagagctctggctgaggggcgactcactcagcccatctaggaagcccctcggtgtagctcaagttctgtcctggtggggacagtccagaaaggcagcaggtggcactacctttgtcggtatctgaacaaaagcagtgtggggagtgggagaggacgaaggtgaatccagcgcctccactcgtccactcagctgtctggcctgggagcgccagtttcctcctctgttcagtggtggtgacaatgggagcccagcagaactttttttttttttttgagactgagtctctctttgtcgcccaggctggagtgaagtgcgcaatctcggctcactgtaacctccgccacctgggttcaagcgattctcctgcctcagcctcctgagtagctgggattataggtgcccgccaccacgatcggctaatttttttatttttagtagagacgggtttcgccatgctggccaggctggtcttgaactcctgacctcaagtgatccacccgtcttggcccctcaaagtgctgggattacaggcgtgagccaccgcgcccggccagaatcagtactcttcatcagccctctttctccccatttctgaaatggacaatgagtgttttttttcctcaatcttatgtaaagtgctacatagatatggtttcaagatgctgtgtccaagtggttcctacccggaaccccttctctgtggaagctctggaggcctcactctgtgaccagtggaggacactctcccaacatggtgcccttctgataaacactcccaggccagctcttctgcctcgctgagccctggcttcttcatttgtgaactggggatgagaactgtgttctgtgtagggttgtcctgtggactggagaccctgcacatgaagggcctggcccaggacccagctgctcacagggcagccacagaggctcctgggccaagcagagctgacctcccagagccacctccccaggcgagagccgcctgctctggagcaatgggcccaggctcggccgagactccgctaggcaagacgggagcctgcgggatgcactggcagggatggcaggggacagagtcgttagctgttctcttgtcttccctgacagtcttggcagtgcaggcaggagagagaagggagtcgcagagcaggccccgggccctccacacggtgaggagagagcgcctgtcaaatggcttgtgtccttcctttgtggggaaaacaccttttctgtagctttttgtagcttttacccagtgtctctggctaaccattgatttggtgccttacaagtgccagatttattcctcgtcactctgctgttgtgaacatggtgagctggagctggaaaggttctggcaagagtcgagtggcctggctgcgcccaagtcctggatctgttactgccttgctgagagaccttggatgtgtcccttcaatctggctgagcctgtttctgcctctgtaaagtagtcttatcttggccttgtcagccccctagaagagctgggggttgactgggaatgcctcaaaccctttgtgagatatgactatgcaaatgagtaaaatgaacacactgctgctccaatgggaaggaattgttcgtaattaagtaggctctctcccatttggacagctcattatcaagctatttggtgcggtacaaaaacacagtgcatgcctggcgtgagcccagcacagcagttgacttggagttggggactgggccctcggccaggcaccgtttctcccatcctgagtgacctgctcctgggcttcctgttgcccaaggccctcagctagaggtgggggaggtagaatttcgatcccattctgtggactcgaaagccttactgctcctgtgactcatacgacctccctcaacagcaggcccaaagcacagaggagagcgtggagaaaccacccaagtcctcatcacctctgagcaccagggacacgttcagatccatcagcagcctctgatctttgaaccccaatgggtggtctctgggaatggaattatgtttctaattcttcctcttgattttccccaagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgttaaagaaaataaaaatgaaaaaaaatttgactccaacagaacaggctgggctaatgtgagctctcagcctggcagtcaagacatcagcatgggcaaggttctgtttccaaactgctgcttctggtgacattccaagacgcctggagggtgggagtcaggaagtaggacacacccctgcagtctccttttcttggtccactcccattcaaatttgagctaatttctcattctgataaaagccataggtttagctaggatgaagtggtaggaaggtccgtggcagttgttagagtaggatttggagtttggaagaactggcagctcagggtggcctggtcagccgtttgaagagcagccatgtgttcttctcagtctcattttctctataaccctgttctgcacgaggggcagtcagatctcaaaatctttttctaccattctgcagtttccaccgtcaatgcagttttttttttgtttttttgttttttttttttttttggtggtagtggaccttgtaaataggctatgtaagggggcaagtcttctctagctcaaatggcttcctaaataaataagcggtatcttcagaaggggccattcagtccttcccagccctgctcacctgcagattctctgtacaaataactccaggtagagcagttggactccaggtcaccttagtataagttagacaaagggtccgtgagggagtagccatcaattcctgaaattccaactttgtgactagcagatggggaggatgaaaaccatccctttgcttcctctccaatacggacccatcttactgtgtcctttcctctctggggccaatgtgagtaaacacagacacagagttctttcccccagctcttcctccctcacctgcatgctgagatagcttccatccatgcagttcccaaggatctggattagaagttcaaaggggaaccagcagtcacctactcccttaggtgaagcatctcacggctgagttctccctgaggcatactggtccagctgagcgtcctagagaaagctagcaaaagggaggcacatggatttcacagtatgaattggttcaacaactgtcttagggagaatcagaaagaagagatgcagcaggggaatgagcagaacaaagatttttctttctcccccttctctctggggtctacctaaccctgacctaaaataccagggcagcgatctcccagctggtgcaggtgggcttgccaagatggtcgtccaggagcccgccttcacttctaaatctgctggccacaagccctgctaaagatacacatctcaccccctccgccaagtctgaaatgcccctccccatctcaccttagactgaaaagttttaaatcatgtcaactggataatacttgctttatgtgagaatacttcagcagaatggatacgaattttcaaaacaatcttttcatatctatgtattctatattaaaagtgataaagtcatgtttctggggcgtattcaagtagctgacaagtaattatttaataatagtacatgagtgcattgtaatgattctcgccgtagtcaggtaatagtatccaaccgaaatttcctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatttggagaaaatatatttcatcatgcagtttttttctgttaagtcattaaagagaaggtaaacaaacctaaaatggatacattgtacactgtgtggagtttccagattaatgctcaggaggtcaaggatacgagattctgaacatggtggcctcagctaattaaatgaccaagtgaaggttatttcctctgttttctaagcaagatcatcagagatgtcacggacagtgggtctgatacaccacagtacatttttaaaggcttcttttgttctaagttaacttctaacaatgaatttccagttttagaaaacaacaacttgtgtactaattcatttcacagactcaagtattttcaatgtataaattaatgtcacaggcactcctaaaagatgtggcccaaggccagcagaccgcaggggtggccactgccttaatcccctcctcaccacgttttcaactccatttaatgggaaaataggattttctctattgaaaatgaaacttgactgaaaattgtctgtcccctgctagctccactgtgagagctaagccgtagagggaggtaggctggtctacaagaagaaagcgtgtgccctgggctgtgggctgtctggaacaattgtcatttgaagttgggtttgggtttgggtagaaagggcctgccagtgggcatgctctggggatgggcaccctctcagatcgccacttcacaggacccactggaagctcacaggttatgccttctcaacaatgagatgccacaagttggttttatgacaacagacaatcctttagttttcagacctacccataaaatgtcacctttggtttattcagcacattatttcagagaataacaaaaatgttttttctttttatttctcctgacctacctcatttaggaacaaatcttacctcactacgaagagaaataatgagaacaggctgggtggggtggctcagacctgtaatcccagcactttgggaggccgaggtgggtggatcacttgaggtcaggagttcgagaccagcttggccaacatggtgaaagcccgtttttactaaaaatacaaaaattagcagctgggcatggtggtgcatgcctgtagtcccagctacttgagaggctgaggcaggagaatcacttgaacctgggaggcggaggttgcaatgagctgagatcgcaccactgtactccagcctgggtgacaaggcgagactccatctcaaaaaaaaaaaaaaacaaacaaaaaaaaaccaggaaaataaagccatgagccgcctatggtggaggcgggctgctctgcgctgtattcagacctgtgacctgaggttaggaatagccaccagaagttgatgcactctgttttgtccatgatgtgtctttagcccctgaaaagctgaaaccacaaaaactgttacacttcagccatacaacgaatcggacacgtacaggatacagatctcctctacatcttacagtctggtcatttttatttcatttcgactttttatttttcttttgcataaagctaatgcaggttgactacaccttttctgaaatgcttgggaccagaaatatttcagactttggaagatttgcatatatacaatgaggtatcttggggatgggacccaagtctaaacacgaaattcattgatttcatatgcaccttacacacatagcctgaaggtaattttatgaaatttttaaataattttgtgcatgaaacagtttagactgcattttgaattttgattgccacctgtcacacaaggtcaggtgtggaattttccacttgtggcatcctgtcggtgctgaaaagttttagattttagagcatttcagattttggatttttagattagggatgctcgactgaacttatctatcccagaattctaggtactttttcctttttttttctttttttttttttttttgagatagggtcttcctctgttgcccaggctggagtacagtggtgtgatcatggctcactgcagccttgacctcctgggctcaagtgacctcctacctcaggctcccgtgtagctgggaccataggcatgtgtcaccatgcccagctaattttttaattttttttttttagagatgaggtcttgctatgttgctcaggctggtcttgaactcctagcctcaaatgatctcccacctcagcctctcagcattgggactacaggcatgagccaccctgcctggccagtactttttcaatcaataagattgccaaatatttaaatggtccctattcatactaatgaagaccatttgtaatcgtatgattagtttttaatttttaagagacaagtgtctatgtcactcaggagtacagtggcatgatcatggctcaacacagccttgaccccctgggctcaaatgatcctcctcagcctcccaagtaactaggactcaggcgcactctactatggtaattaaaaataaaatcttttgtagagatggggtcttgctgtgttgcccactggtctcaaactcctgggttcagggggtcctcccacttcagcctcccaaagtgttgggattactgggtgagccatcacaccctgcccagtcttatttgatggttaaggagaatacagttgatagctgtgcttgaacatgtagtttctccttatgtataagtacttacaaacgtctaaacacaagaggacgttgtttaaaaatctgaaagagacgacataattagaagatatctttcaaagcaatattattttatgaagaaagaagggaaggaaagcatgtgagacagttcaaggatgaggggatgaggtacaaagaaaggtggaaggaaagaaggtagggaaaaagaaaagcaaggaaacatgatggcgacatgattcttggtgttacctaatgccgtctcccctggtggccctgggcatagggacatgttcttgtgtgtgtggctggtctgcacactcgagtgaagtcagtgcagctacgcattgctgctacactgccactgtttctcctagtttaatagagaaccttctaggaggcaaaaatttcttaccattaatcttatactcccaaaatagtgagacagaagttgcatggcgtctacgctgggaaaatttcaaacatgatccctccttggatattttgtcttcacccacttgggatgcttgccaatcacaggcgctatctcccgcatctttatgccatggtgcccgtccagcacacacccttgtgggctcgtctccaggacccagtctcagtacggcttgccagctgatgagaaactctacatcattttgcaataaattctgcaacttacctgctttcttgaactctcatacacacccttccccagtcacttattttatttttcgagacaagagttttgctcgttgcccaggctggagtgcagtggtgtgatcttggctcactgcaacctctgcctcccaggttcaagcaattctcctgcctcatcctcccaagtagctgagattacaggcatgtgccaccatgcccggctaattgtgtatttttagtagagacggtgtttcaccacgttggtcaggctggcgtcgaactcctgacctcaggtgattgcccgcctcagcctcccaaagctctgggattacaagtgtgagctactgcgcccggctgcccccagtcacttctttaaagaggctatggaccaagttgtcaggcaaggaaaatgaaatcctgctttcaccttctgtgtttgggctggggtgtttgtttatagctgactcactgtttcaacaagtctgttgatcaggatttgattattgtacacacttcaatctactccatgattttgtgacttgttgctgaaacttttaaaggggaggctgcaatttttaggatatgaaaagacagccttaaagtaaaaacatatttctgactttaaccacaattatgcaatttttctgtgtgacattgaaaaaaagtgtcccagtgaagatgtacaaatttagaaaggataaaataacctcctcttttgaggttttgatctcaaaaacatcttatgacaaaaaaatagccggttaacaattcgcctatagatgaagaaacctaaggcagcagctagctggagcctcctttgcttcttcacaggccgttctgtaatctcatacgctctgctgtacagcactggctttgaagaatatttgggcagcttcaagaacccaccttctcaaggctatgcagggaccaggtcggcctcagggtcctcctcccaggaactcccgtt

SEQ ID NO: 993 - DNA, 1195 bp, Homo sapiens
gcgcttctgacaagcccgaaagtcatttccaatctcaagtggactttgttccaactattgggggcgtcgctccccctcytcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccag

SEQ ID NO: 994 - DNA, 1068 bp, Homo sapiens
atggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtag

SEQ ID NO: 995 - DNA, 42533 bp, Mus musculus
  misc_feature (1302)..(1503): "n" at positions 1302 thru 1503 can be any base
  misc_feature (3260)..(3314): "n" at positions 3260 thru 3314 can be any base
  misc_feature (5939)..(6734): "n" at positions 5939 thru 6734 can be any base
  misc_feature (27928)..(28447): "n" at positions 27928 thru 28447 can be any base
  misc_feature (31054)..(31130): "n" at positions 31054 through 31130 can be any base
  misc_feature (39123)..(40764): "n" at positions 39123 thru 40764 can be any base
gctaacaggtaccacatgctttctagggactaagcatggtgttaggcaatttaaatatgtccatttctatgatatatattgctattagataggaaaacccaggcatggttttaagcgattggctggcatcacatggttacagagtggcaaagccagacacgagcttgcaaggtcaaactcacagctaaaagaccatttgcctgttctcttgcttcctaggccttttctccccaccccaacccccatccctatcatcatcttaggatcctgtgaaggccagaggctgcaaaccaatttgctttacattacactcccaaagcacctcactcctgggaggtcagacaccttttgcaaggcccggtgtagacgggattcaccctccctgccaagaataaagggctgggtgtgtcccatgattgcctggttctagcacaaacatagctttagacatgctgcttcactgttaatccattttctttttattattgtagcctctttcacttttctctgtggtctgcacatggatgtgagctcactcacctaggcatgggggccagaagtcaacacagctgtcttcttttattcctctcaacgttatttttaaaatatataatagttgttctttgagaatttcatgcatacataccatgagttttggtcatattggctcctcactcttcctcgcaattccttctagatccacccctcaccttcctacacccttacaccttggtgcctcctccttcttttaataactcataaagttcaatttgtgctgcccaaatacacacaatcactagaacaaggtcaacctaccagatgctccaagaaagctgagtttccttttcctctgacactttttgtcccctttcctgcaacagtcctgagtcttggagggtgtatgtgatgtaggtgccatttgtactgaacactccacagcacttgttctctgtacactgaccagttcacaagtgtttgcattaaccaccatccgctgtacaaagaaacatctctgatgagggccaagagcctcattaatctatggatacaaggatgcaaactgaaagaactgtccatttatcaaataatagtagtaggctcacttctggagcctgtgagtgcctccaccatgggctttgcccagacttacagtaccaggcaagagttttattctttggaggaagtcttaaatctattctgaaagtagttgggttaactccataatggttgtgccactaatacttaggtatattgtgccatgttgggcattactgtggctaccagaatacacagctgggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtgctcttaactgctgagccatctctctgggcccactcccacgttttggttttggttttttgagacaggtatctctttgtgttgtgctggttgtcttggaactctatagatcaggctggcctcgaactcacagcgatccaccttcctctgcatcctgagtgctggcattaaaggcatttgccaccactgcctgcaagtccttcacttttttttttatctgatggaagactaaaatttagtacctctctcttgccttttgaggggcctgggtccatgccttctggtctgaaaggtaaaagcagattggaagcttccagaagcaactgagtgcctcaggagctctgctgtcaggttgaagactctaaagcggctcggagcaaggacgtcattggcctggctttatctcaaggaggaggagacagaggaggccacaggctgagactgacggatggagcagaagtttaggatctaggagcttcctccctcagagcatctggtgatgaccagagatgtgtcagatcttctcacctggggttctactgaagtctggtgagtggaggaccagggcctggcctgctaggccagagacagcccccacaacaaagactcctgtggccagaagatcacaaaaactgcccttttccttttctgctagcctcacgaagagccagctaatgatggtttcctgcagtcttcatctaggctgaaaaggcaggggaccaggctaccggccactgcaagggactttcctcaccatcacctggccatcccctctggccccttccctggagagctctgccctcaggtaaatgttttctcaacttgtttggggaacttcgtaaaaactccccgctagccatctcataagctgtgaaggtgtgccttaatgtgcttttttccactaaaaaggtttgtttaaaaaaaaaaaaactagagcagccaggggatttttattattttttttgttcaaataactaaatagcagcccatatgaagacttcaaagttaacacatctcaagagtatccctcaaaagggagctcagaaaaaaaaagcggcagagtggggggtttaaatgtcgtgaatcaactcatggcttagacaggaaaagttggtaacctgggcggtctggtctgcctcaggaaacagccagacaaggttgggcatcagtgcatgggagcatggaaggagccttaaacttctcccctagccgggaaccagcagcctagcctctggggagccggggtcatttgcatgcgctcttaagagactcttgcttataattccctagtgtcatctttagtaactaaaggggtttctagggaatgggaggccagtgccccgggtatatgaactagcctagccacctggttcagaagcaccagtgagagccaagtgggagtgtaggaggccttggtgcctggaagttgctagataacttgaggcagatggtgagaatggatcactgtctacttgagaccttttaggcagaagagtttgaggctgtgggtgctgatgggacccagtgagtcaactcttgcatatccccagagagtcaaaagataacagaggccagttggatctcctcctcttgctgagacactaagctggcccctgaggtcacacactgtcccctactggacaatgtgtccagaacttcgcatccaacaaagggcctcatgagtgaccagcattaggggtcaagccagcatttccttccttctccctggctttgggaaatgtcccaccgccttnnnnnnnnnnnnnnnnnnnnnnnnnnnnnnnnnnnnnnnnnnnnnnnnnnnnnnngcaccttctccacagtcagcccaggcccacacccacactatgttgtcctgggtttcttatgtgactggagcctccctgaccttgtcaatcaccagctagagggagcccaaagcctgtgaactgagttgatagttggatgttgcagtggagcctgtctttatggaaacagggaagagcaaagatagggcacctgggctgacatgaatatacactgttacacttaaaaagcaaaaccaaagagaccctgtttcggatgaccttaagaaacccctgtgcagggcttggaaagagggctcagcagtaaagagcactccttgttcctggtgagctcccggcatccatatgatagcttacaactgtctgtaaatccagtttcgggggatccaatgcccttttgtgacttctgcaggcatcaggcatgcgtgtagtgcacgtacacacgtgtaggcaaaatagccgtacacatgaaaaaataaatctaaaaatatttttaaaagacagaaaccatttgcgtatggtatattctgctgatctgaaacaaggttgatcactaggcattccaatgcctgctatggaaagactgaaatacgggttgtcagtttgaccttagcccttagagtttcttccattttcttcctaccttatccattctcctgaaaatcagcaaccaaatcactactgccatggctcagaggagctggagtctgctccgaccactgagggctcaccatgggacaaatggacagacaagtagtggtccctgattgtacatcatctctgttgctcatgacaacagctgcctggggctctctgcttatcatattcagctggatccctgcacatcggcttttaatttcacaagtcttcatcatgtcctccacgtagcagaaaatgctctagaggattgtacactataactcgtttgagtcttggaatagcctagaggaatttgggactttcccttttgataattagccagatgtggtggagaggtgggcctccagtgtgggctagctccatcatagaaagtatcaccaggagggtctggcgttatggctcagctggaataaaggtgcttgccacaaaggctgaggacttcaggtgatccacgtggtagaacgagagaattaactcctcccaagctgtctcctgtgacctccacacccacagggcacacatcacctacacatacacacactcatatatacattaagacaccatgaccaaatgtaactctggggggaaagggtttgtttgtttccttttacaggttgtagttctttaaccagggaggtcagggcaggaacttaagacaggagcctggaggcaggagctgaaggagatgccatggagggggtgttgcttactggcttgctctccatggcttactcagcttgctttcttatagaaccccagggtggcaccacccacagtaatctggaccctcccacgtcaattatcagaggagaagatgtaccccaggctcgcccacaggctaatctggtgggaacttttttttttcagttgaggttccctcttcccaaattactctatctgatgtcaagctgacataaaagcagccagcacagtcagggttataaagtcagcagaggggacagccaggagaaaacacgctactgcctttgactcccctttagctgcatctgatggaaattcccccagacattaatttggggagtatggtgggcttaagaaatgtcctcaagtattgtgtgtgtgtggggggggggggaggtgtttctcactatgtagtcttgactggcctgaagctagctatgtagaccagtctggccttgaactcatgaagatctggctgcttctctacccccacctccacccccaagtactgagatgacaagcacgtgccaccacaaccagccagtcttcaaattctttaatattcctaccttaaataggtgggggtcttagcctgtggtggtatacacctttaagatcagcacttgcagctgggcggtggtggcgcacgcctttaatcccagcacttggcagaggcaggcggatttctaagttcaaggccagcctggactacaaagtgagttccaggaaagccagggctgtacagagaaaccctgtcttgggaaaaaaaaaaaaaagaccagcacttgggaggcagaggcaggtaaatctctgtgggttcaaggccaaactggtcttcatagtgagagtctgtctcaaaacaataacagagtttggagagatggctcagaagtttggttcccaacattgatgtggtggctcacagtcatctgtaacgccagtcccagagaatctggcgccctcttctggccttgtgggtattgcacacacatggaacacagacacacatgcaaacagaaacactcctacacatgaaaattaattaattaattaattaattaatttttaaaaagattgaaagcaataacaaaagaggtgaagtctctttagtctccccttaagagtgaggtgttagtgctttgcctgagagtagcaaagcagaagagaaaggggactgagacataaatggctccctctattaacagccatgtggggactcccacttagaagtgaatctcctagttcatcaggacttcagatgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgatatttattatttttaaacataattattttaaagtaatttgttaatattccattgaatgagacccctccttccatacagaagacatcatttgtatttctcttctcactggttcctagtacttaaacactgtactgactcgacatcattgagtcaaagccaccactgactgctgagtgatagacttttcagagctaagaactttgtgcacattataactcataactactttggttgttggactatgcttttctttctatgaaagcagtgtctctgtcttgcttatacttatgattcttgattcttgttacaacacataataggtgggaaatctgtcgggtgaaactaaatgcaatataaataagatcattataatccttaaggggtttttaatatacttaggtttagagaagatgcaagtcgtaacttctagttgtatgggagcttagtcggaccttattcaaacagccctttattgggtgcctactaggtaccggacatggaactgtaaacatgagacagtcttcagcttgaacaggggccacatctcaccaccttcatcgccacctctgtgattcatgctaccagtatcttttcttttgtttaggacaatgagattacaatgttaaacccaacattgtaatcctaactggtcttccctcattcacttttctccccacaggaaaatctcaactgtgtctaaagggatcccaggatactccagtcagagcatgtagttcccctgctctcacactaccaacgtctgcccacctgggggaggcagcaggcttgaccttacaagtcttcaactgggtctgagtcaagaggtggactgtatcttcagcccactgaacattgagcgactttgtgactttctttggtcaataggatgtggtagatgggactctgagctagacctgatcatggatgttggcaggttctgagttctgcctttagaatccggcacctgccaagggaacaacaggcaggatggctgggagggtggggtggggtgggccagggagaacagaccagtcagttaccaaccaactcagcagctgagaggtctggatgagatcagagctactgtggccttctggaatcttctgaatgacctacaaactcagccaaaagcatgcctgtttaaagctctcgtgaagtccttggtatgttacacagtggaaacttactgataaactgtctcgttcaggggaaaaagtcaagtgttttgcctggcacatggtgggtgctcaggggacgcttgattaaataagaaattcccaaatgcagtttgccttccagtgaagaaaataagttctaaaacaatcagcggctacgataagtgctctgaaacaaacaggcagtcgcagtggctagatctgaggatctagggaacggggcacgggcctgtggttggttctctggttactttagaatgaggcaaaactcctcccaattgactccaagagccttgagagacgtcccggctgatccacgtaccgaacttatcccctaccagtcccctgccactctcaggacctctgatccggagacactgggctctctggtgttccacctcaggtgtgtgcctggacctttcttcacttagcctctctgctccccctcaggttcctgctcacgtgtgaccccttcaccaagcccttcctggccagcttacaaaagtggccactcttcgaattctcctaccctgctctatttttatctgtgacacttgacactccctgatgtattatgtcagctcagttgttttacctgtctgctctcaccactaaatacaaattctacaaggattgacttttattattattattattattattgttattgttattattgttattattattattttgataggtttgtccttagaacaatattgtcgtcaggcagaattgtaatcagtggatacaaaaatgctttaggagccataacatattgtcagccctcagattaatcgaggtgagcatttgagccacactgggaatagagtaagagcttttattttaatatgtgtgcgtgtcttgcctgcacatatgtatgtgccccgtgtccatttcctggtacccgaggagtcaggaagaggacccctggaactggagtaacagatgattgggccactgtctggatgttaggactagatcccaagtcctctggacgagcagccagtgttcctaactgctgagcatctttccagtccccaaactttaaaaaaaaatagccaaaacactgggatgagaatgggactgttcactaaagcgacaagcgtgttcgtgtcatgggacacatgccaaacaccgccactccacagcatgctttacagagtgggggacattcctattcaaattgtcatccctcattgcagtagccctgaaaggtagtaggtggggcaggttttaggtgtgtgtgtgtggtgggaggctggggggggggggagtaagggaagggaagtcactggattctcatcatatcgatctgactccaagtccagagcctctgtccctcattttgacgttctctccttgttgggttatgacgtcactgacttctgaagactcaaggtcaaccttgaactcctgaaggagcccctccacagaaggtaggtatcctttctctagggagaatgaaagtgtcttgctaagaggacaggggatagataataaacttctttagcatcgattccagagactccccgagactctcagctagccccaacgtcttgcttggtcatctgtaaaaggcagtgccctcctttctttttgtccccagcccaccgaactgtcctataggtgaaggaggaaggccggtcataaaacaggatgggcagttgctttcgggtgaaacccagaaagggtcctcaggcttgtcgctgactgtatttagatttaaaaatcaaggcctgtgacctggaggctctttcctgctgctctctgccatgttgacagcagagaacttgctaattctggccggggattttccctgtgtggctgtttttcttctttatcttcatcaattgaagagcgctcgctctgcctttcaaactgcctgccggaagatactgggggtttgtgtatttttttttctttcacctaattctgtggtcttttcccagatgtgtattttctctctaccttctttctaacttgttgacgtttccgcccatgtgacttccagcttgaattaccagaaaccacaagagagggcctgtgcgcaagccccaaagcagcgagatgtccctgtggggagcagtccctctgcacccgagagagaggaggacgcaggggtctgtcagaggttgctgttgggcaagcaggggaggtacctgtggaaggtggtgtgctggtggccccctagcagtcaagaaggggagccagctagtgagaagatcgcccagaggcatctgggacggtgtgggagagcccggaagattagaaccatgcctcacagctccgacagcagtgactccagcttcagccgctctcctccccctggcaaacaggtacccccttcgtccccctcccccacgccccgcatgccttgccttctgattttcctggggtggtagaagaggggtaggctcccttgtcctgcccagggagctctgtctggggaaggaagtagctcgtggcaggaactctctagcagactctggaccgtgtggtgtttgctatacagaggtccaagggctgaagcttcgcatcccgccacaaaagcctctctttccaagaggtacccctcgtctctgccacttaggttcccaccgtgaaactttctaggaagctgggggcagggtgaatatcacagagcttagaagtatggtcaaccataagcagaggaatgttccagtagatcgctgcttcgggctccacccaaatcctagagttgtagctttccaggaaaaaaccaagcaagtggcaagacagaaccgaggtcagggaagagaaatatagcaaatcaaagcaaggtagacaggaggagaagagtggcaagatctgcctgcggattgcctcggtaactccagcagtccgtgggaagggaggctaaagctacaacctgtatctttcccccccaccccccatgtggcttccagatagaagaaagaaggccatggtccaggaggcgtgtcagagactttcactagtagctaatatcatccctgaaaaaccagggatggagggaaagattctgagactcttagactcttgactgataccaagccgaaatgtctcagactgaaagatgcctccgatgggatgcctttctcaccttgtggtttctgggtctctctaccacgttcctgatgccccttgttctagacatttctcctcctcatccaacatagacccacggattaaacttttttacatctcatcttaaaaactatattctttccttagcacacatattgggaggggctcagaggtagagtgtttggctcacacacatccagggggctgcaaaacgctacaaacaaaataaacgtaaactacctgaccaccggctcccacatctgtcacaagccctcaccaaaagccatactggtgaagacctcaagagggagatagtccctcgctcacgatggtatcagagcaactcagactgcctggaagatggtaccccagtctcttcttaagaaggaaattactcacagcttccatggcaacctagtcccttagcacattaaaggaagaatatatccttgccctctctaacccaatgtccgtttgctagaatgacctggaaagtttgagtaaagagggaagggaatcagaacctgacccaagggtctttgcccctcaggccagtggaggtaggtgacagggtgggggttgcagaagggcttctcttccctgatcttctataggagatacttagaaagcactcaaagagcactgtgtcctccaaagcacccgtcagtggctcactaaagcaggcgacctgcacttcataaaatgatttggtggtggtggtggtggggttacctcatctgtagcaggcatcatgttcaggactaggaaggtctcaagatgtctgcacaatgatggaccgaataaaacagatctgggcggcgccctctgcctaggggtgcagcacaatgaaattaatagtcaagggggaattctcagaaaggattgagcatcagtgccagaaagatgtcatacccctggatgtccatgagctcagggatcagggtggagagcctcagcttcgtactgtgtaaaatagaaaagacggtgcctgctcagaaagctggggagttgaagcatagcgtctccgaacgcgcttgtacagaagttggcacatggtaaatgctcagcggagttttcaaagacaacagcaaaaggagcatcaagaaggtttagcatgtgcgcacacatgcacatatatacatgcacacacactcacacgcacacatacctcacatgcatacatatgtatacacacatgtacacacacacacacacacacagagtgaagctagaacagctctggagagagcagaagtgatggcatcttaactggaatttcccaaagtagccctcctgaggcttcaatttctcttcacttttgagtagcttttgatcataagaagaccataggagacccaagggtgggtagcagggaatgctgaagaaaatgtctttgggtacaggccttttgtaaataaggggaatggacaatacagaaagaactgaggaccgggaaggaaggaaggaaaggagggaggaaaccaatgtcctattttgactaagaggaacgatcagacctaccgttgatatctctgcttcctaggactcatctgatgatgtgaggaaagttcagaggagagagaagaatcgcatcgctgcccagaagagccgacagagacagacacagaaagccgacacccttcacctggtgagtacccacacttcctaccatgctcctgcccttaggctctgcgccccacaccagtgaggctgtggggcccagctctgatgattctgctgtggtagagctaagtactgggggagagtagtagagggcaagagctgcaggggtcaggttgtggaaagggcttcgctctcccatgcatgtatgaaaacatttagtagcagagaacagcactggacactgaacctttctggcccaggagagtgcaagggtagatgtgtgggatgttgacagcctcaaggcttcatgggaggcagagccacctgtgtggaaagggacagcagagagggtgtcgtccttcctgagccactgtgagcagaacactgatgctgagaggaagttaggtgttaagtgcttcagggaagccattctttcagagctgcacatctcatccctctggaaggcaatggtctgccacccaagcacacttgcctttgggagaaggaggtcgatgatgctgcccttattttttttccctgagcatggagaaagttctgtgttgagatttacattgttaatggtctctctagggtctgctaaagacaaaattttaaagcacttacttgggacaatcaccatcctggtctagcagggaggggatgaactgcagcctcacttgggagacccagggcctggaccagcgaccccgagtcctgactgggcgcagtgttcccacccttcatacctttcctctttacagtctgctcctttcactgtgttcttgctcaactgttccatcttcatcgcatccttcttcctgctcttcctccttcctcctgaaacatttccaaactgctaatattctagaaatttcctaaaagtgcaagaggtgccaaacccagataagctgataatgatctgatgtttagcatggctaagggctgctttaattttatcagggataaattatcgggggctggggaaatggctcagggggtaaaatgcttgccattctagcatcagggtcagaatccccagaacccgcatgacagtcaaatgggcaagaggcagaagcagcaggtggacatctatgaaattgaagccagcatagtctacacagtgagctccaggatagccaggtctacatagagagcccctgtgtcaaaagagaaaaaagaaaaaaaagaaagaaaaaaaagctgaaaagcttaatggatgtggcagcctgacagtgtaatcccagctcatgggaggtggagatggggaatcttagagtacgttggctagccagactagtcaaaacagtaagctttaggttcagcaaaagactctgcctcgattctcaatacggaagttggaaagtgatgggagaagatactgacctcaaccctgggcctcacacacgcatgtgcatctatgtacacgcgtgcccacatacaagaaaaatacatggaaacaccacacgcacatacacatgcaacaaaagaataagtaacatacagttttagaagacaaaggggaggatatcgccacttctttcagcctaaggacagagaacggtctgccctagtcgctctgcctgtgcttctgctctgtttgataggttcttaatatagtctccagtacgtgctaacatcattttcaattggcaaatatgtgtcagactaacaagagaaagaataaacagcactcagcacaaacagaccaacagtctgagtgttcagtgtctgtcccggtactcaaacccttcaagatttcctgggggcttaaaaatctcacactatctgaaactgactttttctatctgagtctggttcttagttaatattccatagagcaagaaagccacacttacgataaactccgttttgtttgtgcaagtagacaatgtcctagatgggcaaactcctgtaagctttgtaagtttgtaatattaaaagaaggaagctgagttcagcctctctctggcagggaggccagacttgaaccaccgctctgccgactgctgtctgtgtgtctggacccacaagcattcttcatggtccttagccttggggcccttatctatagaatgggaaatgacaggaactgcttatagagacagtgcaggagaaaagctcagtatggtgcctggcatacagtaaatactcagaagattctgtgcaattaaagttatagtaatagtgtaagaggcgtgaaaactgagactgagcaggcatacatatgtacattgcataattttatataaaaatgtacgtgtatttcccagtatgtatatatgcacatattacatgcatgtattgtgtgccgtgtgtattgtgtgtgtatctaccatgtgtgtgtgtgtgtgtgtgtatcgtatgtatgtgagtatgggtgtgagtgtgtgtgagagatgcatgcatatgtgtgtgtgtgtatactttttctccacatcatctcagtgctgagagacttcttaacagctgtaaagctcatgagactcccttgccacactcactcccggcagaaggtccccagggcacgcccagtcacctctaatagcagagtgctgcctccctcttgacacaggagaagggcctcctgtctctagctgcaggccaccttcctgtaaactcagccccctggtctctgttgcctaacttcttctgtgagagcatgagaaacttacaatgaagcattttgaatacctgtcttgtattcatgcatggcgcgctgattgttttttaagtgacagaggtggggaggagcctcctgcgacaactgtgttacaatgtccccagcattgattaactgcacataattcatttgtgattctgttccgattatgagatatacgtgatggtttcccagacacagatgtaaacataagataattaggatggcatatcaacctagtcagagaggtcgaattatctaataaatagagttgggacacctggcaagtcacttgaagagacaaaaggccaggtctctcattccttatgcaatgcacagacagtttaaatatttttaaaggaaactaaagaagtcttgggggaaaatatgtaatttggaaatgtaccttggcatgaaaatttttcaaataagatagatagaaaataataaaagaaaattgatatacaaatgtgatttatacatgcatcaaaaaataaaaaaatttggctgggcatcctaattgggctaggccttcaatcctagcacttgggagacagaggcaggtggatctctgagctcaagaccagcttcatctacatagtgagacgcccatcttgaaaaaaggatgaagtttaccccccctctttcttccttttctctctctctctctctctctctctctctctctctctctctctctctctctctccttccttccttccttccttccttccttccttcctttctttctttctttctttctttcttttttttccttctttctttcttttttccaagacagggtttctctgtgtagccctgcctgtcctggaactcactctgtagaccaggctggcctcaaactcagaaatctgcctgcctctgcctcccaagtgctgagatcaaaggcatatgccaccactgcccggctgaagtttttctttcattcttcaaaatattatatacaaaatcaaaggcaaatggaaagccaggagggaatcatctagaaaattcatgagccagaaaggcaggtttactacatatgtgggaactctatggcgagggaaatgattgatctttattaaaaaaaaaaaaaaaaaaaaaaaagactataaagtgagggaaagggagaaacagaatgtacctacacatgtaaggatgcgccaggcctccttgggaaaatgccaatgagggtgaatgtaagacttccttgccaggctgacagaggtgaaagatggagctgacccaggaaatggccaagggagacggagagtgagcatcgcattcccttagcagggcaagttgctataaccccctaagacggcagcttgagcaggctcactcaggtggcaggggcacctcccctgtctcccagcagggtgctgtccagaatccgtccacaccacaagcacagcacagaggttgtagctctctgagctgagtgtgagtcattgttgcgatgtgctgctcttggtgtctcttggtttttgtttagtggcactggggattgaacccagggacttgtacaccactgaatgactggaaactagttacatattcattaggagaatgggggttgaatgaacactattggtccattctgagtgtgctgttatgggactgttaagtgagttgcttctgagtgtggtaaaactatcgttttcttttctaaaacagtttttctaagttatggaaggtggggtatgtgtacatgagtgcaggtgcccataaaagacagaagggggtattggtcccatggccacaggtactagaaactgaactcgggtcctctgcaagagcagtagatgcccttaatcactgagccatctgtccaattcctctttaaagctttctatgttgcagttatttattgtttgtttgtttattgtgggggagtgcatgcatgtgtggatgagtcggttctctccctccgctgtgttgggtccgggcatcgaactgaagtcataagacttggcagcaagcagccgggcgtggtggagcacgcctttaatcccagcactcaggaggcagaggcaggcagatttctgagttcaaggccagcctggtctacagagttccaggacagccagggctatacagagaaaccctgtcttgaaaaaccaaaaaaaaaaaaaaaaaaaaaaaaaaaaaaagacttggcagcaagcactctcaccccctgagccctcttaccggtccctggttcccagactcttaaggaagaaaagtgcaaatgtagcatctagcttgcgccaagccacactttttaatctgtctgagcataagtatacaggcaagtttcaaatggatcacccgaacttattaatatcattttcaaaaggtcacactgaagttaaaagacaggaaaagtgtcctttgcattttcaatccttttttatgtcagttaggagtagctaagatttgagtgactctaagctccgtggtactagatggaacactttaaagaatggcaagtcgttttcctgtggccagccagccagttgagagtgggagccttctggaatcttctatcatagggggattttgagtcaatgtcctgggtcagggttggggtgggggtgggggtgggggagaactgagatcagtttaaaagcattgctctggagaggggctccaagcagaggaggtgggggttggacagcagagtctcccagagtgtgctgttggcaagtggcgcctggtctccaggttgcttggccatccgtgctggatctggaaactggagtacgaacagggtggctcctttctgtgaagatgaggcaggatatgactgctgtgggctcctgaagtaatctcaccacagttcaggacaggcaatgtctgtgatttgtaaaatcacataaaacagaaaaatcatgtagactgagctgatgctgtgaaaaatgaggaccattggaggaaattaaataattgagaaattcccaaagatgttagctcccagggacactgggagcaagttttcagcaaggccattgctcttggcttgctgaggtggcggggaaacgaggctgtgaggttcctccaacatttctcattctctgtctctaggagaccacatcctgaggtttattaacataacaaattcatagatctgtaaaacaataaaacatgaagggacattctggctagtttcaccttttaaatgcttaatctagagccagtgaatcagccgcctccctggcatctctgcctctctgaatttctatttaaaatatggtcattagctgggcatggtggcgcatgcctttaattccagcactcgggaggcagaggcaggcggatttctgagttcgaggccagcctggtctacaaagtgagttccaggacagccagggctatacagagaaaccctgtctccaaacacacacacacacacacacacacacacacacacacacacacaaaggtcattgaacacctggccatggtcacgctaagtgcgttaagtgtcctaccagtggggttgcacttgatctgaaaaaacaaattctttgcattaatcaatctgctgaaggttggacagcttgaacttcagagccctcctttgtaaacataaacatctatctgtatccttgcatctcctgctaaggtcttgtttgtcttgtttctatttaaacaatacactctgaaattcttatttttccctgatcatcttaggcttggtcaagaaagtaaagaaaggtctatctgttgctgtctgtctatctgtctgtctaccctcccccctttctccccctctctctctatctctctatctggctgtatgtgtgtgggtatatatagatctttatataaatatgtgatacatatgtatgtataatatttatacactagtttttagaagattgttccattttaacagtgtacacaagaataacctttggacacagtccttctcactataacattgtaaggcaaagtccatagatgaggatgctggaaacatggatatctgaacagcaaacactttatgggtgtcataaaattaggcagatggttaacaggatatttaacagactgtgatccacttacgcaatagaaattgaggctgacactagaagtggccatggagatctttgtgtatagacttagaaagatgtctgcgaggctgaattgagctaatcaagccaggggagtgtgcagagcaccatctgctaatgtgaagcttgcaaggtttggggatggaaacatagtctccaaattaccaatggtggttacttctgagtgcctgggttggggtagcttgccttcctcctggtgctctttgcagtgttattgtgacttaaatgtgctgtttaaacaatcagaaatagtcccagagtctttacaaatcagctattttagttggggaagaacacaccaaggcaatttaccacctcaactgcttatccaaggacgatgggctgctccgttagggtgggagggccccagacttgaggaatgtgtggctgaactggattgttagtaccagctcacaacccaacagctaccccactcaacaggtgtcaggaggctctcctcagcggcaccaagtgtggcttctgcttcccacagcagtggactggtccacaggataaaggttcctttcggcttgtttttccatagcctcaccatggggccccatagtagctttcagaggaaatgccactaagtgtggccacactgtcttgttcataggatcaaagtgttaaaaacgaaaacttggggtttttaggccaacctgtcatgttaccaatgaggaaatcagtgtctttctcggggacacaaaaggaccccaggttcttgcttccttaccagcctgtatctgttttgtgatattcttagttttgtttttgtttgttttgtttgttgttcctatctatcattttgcaaagggttagccaagaagtagactgatggtcaggatgcttacacaagactctcattacttccaaaacatttcaccaacagggagagaccataaaaggagttacagtggataaagcctagagtttaaagaattatttatttatatgtgcattgattggtgttctgcctgcgtgcttgttacaagggtggcagatcttctggacttggagttacagaccattgtgagctaccacgtgggtgctgagaattgacctcaggtcctctataagagcagccattgctcttaactgtctcaccagcctaggcctagaatttaaaggccccgttaattagaagatgtaaaggcaggaccccaaaaggatgatggtatttttgaagaatatattgtcattaaattaaatacatgatgatttaatatgtatactaagaaggaaaaacatcctttgagagaaaaacatcaagacattcatcactaagtgggcagaaactacacagaaagcttacacacatttttcctacccaaatgaaaataacctaattttcaattctgatgacaaaaacagtacacattgagacagggtttctcaacctcagggtgattgacagtctgagtcttatacatttttctttttccttagtattaaggtattaaggaccttatgcagctgggcagtggtggcgcacgcctttaatcccagcactcaggaagcagaggcaggtggatttctgagttcgaggccagcctggtctacagagtgagttccaggacaaccagggctacatagagaaaccctgtcttgagaaactaaaaaaaaaaaaaaaagaccttatacatgccaggctaacactctaccgctgaactataactcatcttttccccactctacatttaaaattttgagacaaggtatcacaaagctacccaggctggccttgaactcactgtttagcccaggcagacattgaactttcaatactgctgcctcggcttccaaagcagcttgggattgtgggcctacacccccaggactcctaataattctgataattactatatatggctgtcttgtgcaccgcaaaatgtaaactctacccagtagatgccactagattcgtctccctccagttatgacatctggaacttgccagctaccccctgaatagaatagttacccccatttggttttgatgtattaggttctgttttaaaaaggtgttttgttttgttttgttttttgcttcattagaagttgacagcttgcaccagtaagcaggcagccggaaaggatggcggacggcctggaaccctttggagttccgagacttgccgccgggccgggccgaggcgggagggacccttccaagttgactttgcgggtggagggaagtcctggagttagcaggactgtgtgcttgcgactgtgggcgtggagagagcgagtagcggctggagcagccgtgctcctcccgaaccgaccgcggccacgctgccgggacttcccggacagcgtttgcgccgcccaccccgtggccacgggcccaggatcacatggctagacccggagcggccggggtgggcgtcctccactctctccggcctgcgttttgcgagtgtagcggtggaggctgaatcggatcccaccagaaaccccaacaagtgggcagttgggactagggcgttcactagggcgttaagaaatcttcacaaaactagttggcacaatttcttccattagaaagcatggcatccagtgcctctctgtgactgctctgggtggcttcaggtgcagcaacgttacatctcaggagctgtagtcatcttgggcaggcactcactgttggttataccgtctcacaacacagtatggatgcatcaaggtggcatttctagtgctatttgcaacagggatattttgacagccatcagaatgtcccatacccggcaaccatctcaagtaaattcctgatcatgcacttgatgaggtggccatgaaacacagtacttgtgacactgtagccattacaaagttataaaaaaggcaaaagacaaattatcttttcactagggttgagcttctacagaaagaagtatacactttgtttgaaaaaaaccaggatgctagtaagtagcgatgcgagcaggtgttaggagctaggattatgggtgccttacatcttaaaagctctcgaaggctaggcaaggtggtacaagctttaatcccagcactcaggaggcggaggcagatggttctgatttcgaggccagcctggtctatatagcaagttccaggccatcaggggttcatagtgagaccctatctcaaattaattaatctttaatatagttatactgtgtgtatgtatatatatgtatatacacatatatacacatgagtgtaagtgtgtgtgtgtgtgtgtgtgtgtgtgtgtgtgtgtgtgtgtgtgtgtaaagaagatggccaaagttgagaactctgaaggaaactgaaatatcgctgttaggttttggcaggaggttataatttatcttctcagctggagctctttagggaatgaaaaaggagtcctagcaaatatcataccaggacagcagagatgaacttgagccatccccagaaagcttgggagaaccaaggacagtgacctggatcactcactagtgcaaaggaaaagatagagttcaaaaccaagcagattaggaccaaaaggccattctgtgtgcccagcatggaagcctaagccattggtctcatgggctttacattcaactgtaggtctggaaaccaattcagaatctcactagctacacatcatgaaaaccgctttgacactgaggatcaactgcaaaccacagaggaggctgggaagacctggggaaacggggcctgtggagagacttggggccaaacacaacatgaagcatcagaaacggaatgtgaagccagagtcggggtgacaaggataaaccagatatgtaatacaaggatggaagataggaaattggagcacacaaagaccattgtgatccaggctggggattgctctcaactggagacttttttaggtagaccagcttttattaattcttagacagtttcatacatataagcagtacatattgatcactctctgtccccactctcaccgatacattcccttctccctgatctacatcctctgatactgatacctgtgtgtgtgtgtatgtatgtatgtgtatatgtgtatgtatatgtgtatatgtatatgtgtgtatatgtgtatgtgtgtgaatgtgtctatgtgtattatgtgtgtgtggtgtgtgtctgtgtgtgttttaatccactgagttcaattaacactgcccattgtattgttcactgatcatgtcaagtaacgtcagctgcagtgagtttattggccacattacactcaaacgagagctttctctacattaactgttgaccatagcagacagctgcttctttctggccaaggctgatgaaagcactaagtctgtggtataaatatgaacaagacagtttgacagcttgccattaatcagaacaacaggatcaggttacgtcctctaccctaccaccctaccatcccatgctgctctcaccccttcccacccgggcctagaccccctaagcagcatgaggcctaagtctcttaagccttgaattagagagaaagtaagaatgttcatctctcctggggagaaaagcagagctccagctggggtgttgatttgtctgctcagctcatgcaaaagttggtcttggcacacaaaccaacctgctgtcttgtcacttgtgagtcttggcacacaaaccaacctgctgtcttgtcacttgtgagaaagaactatgcccttctgtctgtgggttcatgagaactctatggtcaacgcttcagcctccttgggttggtctgatccgggaaagtcaaatacaaaggagggaaattacattcaaagtcaagtggtgctactctctatatggctgggccttttgaaaaaggaacctcttagattcttttgtaactgttataaagcagctggaatgttgggttaaacactccccgctagcctcgaagatgtcataggtctactgagtagacaccgtcaggagcatttgtcacattccaagctagcaagcaagtaacacgatttggctgagcattcacattgtgctgtctctgtcgcaacgctgaggaccaacgcatggagaccatagcagcttccttctctgccctggaggagctcaccaatccaaagggacctagtgtgagtgaggtttaactggtgagttcacacagatccccacctctagccttgccatcccaagaagcaggggtgctgggaccggggcaatgctgatggagtaaatgcagttgtagcagagcctgctgacataagtttgaccccttgaactcacagaactgactctgggaaggtaacctttgacctccaaaggcctgccactcattcgagtctgccctcacacacatacatcatacacacatgtaataacaattaataagtttagcaccttaagagctgttctgggccaggcattggtggcgcccgcctttaatcccagcactcgggaagcagaggcagtcagatttctgagtttgaggccagcctggtctacagagtgagttccaggatagccaggactacacagagaaaccctgtctcggaaaaaaaaaaaaaacaaaaaaacaaaaaaaagagctgttctgaactcttgttttcaccaataatctattgtctttaaatgtcaaagtattctagaaaatttttaacttagaaatgttcattcaactcctaagactctgttttatgctacctatgaaaatatattcttaacttagctcggtggtggtgcacacctttaatcccagcattcagagtgagttccgggacagccaagactatagagagaaaaacaaaacaaagaaagattaaaaaaagagagaaatatgtctaatgagataaaacatgaaatacatttaatagtgattagttctgctattatactctttttaagtatctgcaatgaatatgattctcaatctggctaagcactgggctcaccagggaagtatttttaaaatcttgatgcctacaccccatttgtagcaatgaaattggggcctctaagagacagagggtggagtctagacaatgtggagtctgcatgtgtgcttggtaatcacacagcttgaaaagtgctttgtcaaaaaaaaaaaaagtgaaataatgcaaggctgaaagtgacctcgggacagggatggggcagggatgcagggagaccttcctaagcccctaacctcggaaatgatatgtgaatcaaagcagaggctgagacggcctggggaaagtgaccaatggcagagactctgggccacaggcagaagtcctcagggacatgcagcccaatgtggaaggagtccataagctatgcatgtcctcggtcccagcacctcgtggctgacacacactccaagcctctgctctctgtttttccacattgggcttcctgtggtaccctgggagcaagccatccatcgggatttctgtcagctacaagtcataaataggccatggaggggcggcagcagcaagcctcgctttctttctctcacataccaagctcaggaatggaaagagcaggtctctgtcagcgtcatctgcttggctctcctctcaaggctgcaagatggctgccggccctccaggcctcagtctgtgttggcggggggattgatttgtccttgcccagcaactctaccatgaagagaaaagagaacctctgtccctgtgcctctacctacatattacagtcataattatgtcacacgcacacacacacacacacagccccaggtgcaaggaagctgggtatttgtgtctctctagctgaaaacagtggggtatttggggaggacgctaagtgagccaacctctagtaggcccatggaaaaaatgaggcccaggtaacatccttccaaccctgtgactatgacaggaccacgagagcatgattggtgtctgaccagctattggtggccaggagctgaatgaagccaactccagaacccaatgtgtggtgactcctccccaccatgaaagtcaatggtggcagatggaggaccggtcctctctctcctggggagcaagcccacctctccattggaaaccttcatcaagaactgtgggctccacttgccatgtgtacttgatgtctggcacatggtggcaccaactccaaatgccatgtgaattggaaggttaccatgctaacgatagtgtgcattttcctttgggcagaaaaaaactacagagggtatttcatcctctggaaatggctgttagaaaatgcaggaaggtggggctggaactatagcttggcacaggctgctctttcagatggactgcagcacccacacaatggtgtgcaaccatctgtaactccagttccaggggatccgacgccttcttctggcctctacgagcaccaggcacatctgtggtgtactggcatgcagatacgcacataaaattttttcaaagaaaatgcaggaaagtcaaagcactggagagctggccatgaacagagcagaacagagctgtaaggcatatgcctggggagtccctgctgagccccccgcatgagctcaggctggaccccagccaggcagtgccagctgctcccagtctctctccagctcagctgcctggggctgagggactagcctggggattcccctgtcactcaggagctctgagtgacctcctctgcagcccctccaattggggatttcccagaatgttcccacacctcaacgcctcctccttagccacccccagctcttgatagatagaagtggcatcaggtgaccctacaggtgagggaggatcagctcgagggagggagggaaactgggaggttggccagtgaactgagcctgagacaatctaagctcacaggctcccaaggcaggaggcaaaggacgggtgtttgtgctgcagcctacaagctgtgtggtctcctgacaggttgcttaacttttctgtgcctcagtttctcctcttttgtaaaagggtgtgttatgcagtggtgttaccaagattaaatatgatgatagctataaaatatacaaaagggtgggtgtcatgaggcatattcctttaaccccagcactcaggaagcagaggcaggctgatttctgtgagcttatgaccagccaggtcttcacagtcagttccagtccagctaggctccaataagactctcaaaaaaataaaatatgtgtgtaccatatatgcacatctatttaaattgtggtgccagacacacccataggcacatgcacaaaaatatcaaaaggcttggggaggagattacaggcgctagtctactaatacatctaggtagccaatttggaatctgaaatattggaaaattcaaggggaaactggagacacccccattcctgtagctgtcgacattagctgcccaacgggcaccccgtgtagcctataaccaccaaatggcaaggttaacccagatctagttagttagaacctgtcaccaacaatactagtcctccctggaggacccaatgtcaggaatagcaggctccagctgaggatctttttggactagtcatcttgccttcaggcgaagcagctggcatccaataggaaaagagagtcctcctggggccacgcagccaagaccaccaatgattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtatggttttgctccaggtctcaattggtttccttggtaggatggctatactgactgcagcagccgttgtgagaaccctgatgggcctaaccacattctgaaaggtgaagagagcaggctaaggtggagcagggagggaggcaggctcgcttgatctccacactgcctagtagaaggacatttccttcacacacacaccctcacccctctccctcactgagttccgtcccttctcacacccggaagttgggtaggggtatagtcattgtctttgtggataaacagctgaccccaactgtccctttagctagatgagtcctctccagaggccctgctgccctctacagcttagagggatggggcccaaagcagccacttcctcctacaagtcattctttctctagggagtggccagtgtctgcaaggctccgagcttacagacattcctcttgcaagcagccgtctggctttaagaggtaaagacacactttgcctcatggtgagaggcagcaggcagtggttagtcaggtctaccccagcgtgggctttggcatctgtaggcccaggaggtgacaggagaaggccagcgggagctccgcagagcgcctgctagtgacttgccctgcagtcacttcccgaaaactaggccggcctctaggcggggagacgatcggagcccgcccacccagtccgtccctccttgctgccttggggtttgcccaggctcttcggagcacggaacttacagtaaatggtgtaaccagtggaaactctcagagggggcgaggaaagggccaggactcagggccccagttcccgtcttagcataccgctccaccaggttcatttcgcccacctttcagtaacggggcgctgccttcctggtaaaaggctgacctccctctgggatgtgccagaaaacaaaaaccagcgaaatgcccagctggcctcagcctgcaggaacagcagcagccagggattgagcatccagttgtcggcttccctcagcccgcttgagatgggggtttcctttgcaccagactaggggccctggttagctcagagagcattcaaagtgtcgctgaggctcagcgccttcccatatgaccttcaaaagaaatggaagctgtcttgatgagcaatgtcagggtcctctgctcctccacaacttaaaagagaaaccccgactgtactgagtttccgtgattggcagtatagctgataaatcccatctctccttagcctgcagctcactcctgctggatcatttagggttaattttaaatgtcaagttatcgtacatctgctaaccactatacttttgagtcaacattctcatgccaacaattgatgttatcagccagtcagtccacaaacacttaagttcacttggagcttaaacgggcatttaatacatgcttaaataattaaagcaggctttaattatttgtatcatatttaatagggtttttaaacttgcccgggcgttaaaacgacctaagacacctgttaaaagctcagatttccagaactgaggtgttggctccgttggtaaagtgctaacggaggacctgaattgtgttctcaagcacccatataaaaagtggggcggggggagcacgtggctggaatgtgggcgatggcgagattggaggcagatccctgaaagcccgagggccactggcagttccaggtaatgagacatcctctctcaaacaaaatgtggacggtgcccgtgggagttcttctgacctccatgtgcgtgtcacacatgcgtgcacctgcacccatacatgtgtgcacacacatggaaaagaaaagcccagattccagagtccaaatttcttcccaaatcccagatctgcagaagagctgcctgcaagcttctggcctgaaatgaggttcctttgcctctcaggggacttgggggaggcccccaggacttggcaaggttctgtttattcaggtccgggaaccccattatctggagaagttgttgtttctcagcaacttctatgccccagtgctgtggtggctggtaaatgacgcagtccccacaacactggaagacatttctggaccaagcgcttgttgcctctgcacagagtacagggctcctccttgtttgaagtttcaccctctatggttttagttagccaatgtcaactgtggtctgaggatactgaatggaaagttccagagataaacaattcatacgttttaaaataactccagctatagtatactgtcataaatgttccattctgtgtttatttattgataatcgcttcctatgtttaataaacttcatcagagatttacaggtgtagggaagctcatagtgtcttctgggtattgtccaaggcttatggatggtttggaacaggatcgcaaaacccaggagggagcagaatagaatgccaagtccatcgtagatcctcaatattcagaaaggctataagcaccctagcacctgagcaaagcaggcagagcgcgtgaggcaaccacagacacaaggcacttggcgtgtgttggggagtaagaggcacaaactgctttcctctacctggggctggcccgactgccaacctagaggtgcatacgnnnnnnnnnnnnnnnnnnnnnnnnnnnnnnnnnnnnnnnnnnnnnnnnnnnnnnnnnnnnnnnnnnnnnnnnnnnnngttttctgaggtttgtccctaccaaacttgtatgtgtatttcatccctagtgaaacaacagagttgaggggtggtggtggccacaaggggggattgtgtcactaaaaagtactaatgtctttctcagtttctcttctattgtttttcttccttctctcttccctcctttccttccttttcagtgttgcagattgaacctagggctccattgcttcttcacactaggcatatctcccagcccttgagaatactcatccatttagagacagggtgacaagggactgtctctctgtatttcctttctagcctgggctggcttcaaacccccaatcctcctgcctccccgtgcttcatgacaggactgtgccaccactcccagcttgtctctcactagtgaggggatgggactggttattgtaagtggattgttaaagagaccccctctctcttatacacaagctccttttctaagctccccacttgcccatccattttcccatcatgcacccctcagccaccatgtccttaaaccttcagaactctgatctaaataaactacccagcctcctggagttttcttatagtgacagggaagagacatcttaggtgaaattgctattcctattagtcaaaatagacagcaatcagcagttgcccacgggtcaaccttatacttacgcacacccacatacaaatctatgtgtatgtgtatgtgtgcacaggaattctcagttgccctcttcatggctgtgctaatagaaaactttagctccctgtgtaccacctttctgccatcatgtaccaccaaccttcccccgacccccgacgcgagtcatcatgccgattgtctctttacaggagagtgaggacctggagaaacagaacgcagctctccgcaaagagatcaaacagctcaccgaggagctcaagtacttcacatcagtgctgagcagccacgagcccctgtgctccgtgctggccagtggcaccccctcgccccccgaggtggtatacagtgcccatgccttccaccagcctcacatcagctcgccacgcttccagccctgaccttctggacaagaagggcgatgctactcccgtgatcccttggaggggcatgtaaactgaggccgggctgccctcatacctctacccagaggcccagtggcagaggcctggacaagtattgaacacaagaactgtagtggtcagagggacttaaggcctcccagggaagtatagtcaatgtactggactctcccagggaagtcgagccaatgtactggacccaaaaaatgacaagtcaaccctggactgtcatgaatgatgcccaaaatacacagcacagagggaggagggcagggggtggatagttttctaaataaatattttctaaaaaaccagccctggaaagcggcttccctcacttctcccatcagcatcgtgcgaactactttctcttgatttggcacctggttttccttcttggcttcagggagctcttccagactctatgaattccacttagctgtctgctccatgttttgttccctgtttgggaagctggtctcttcaaatcatcttcaacctctagctatctccctcacactcctccacagtgtgacacccccccccccagccgtgcctcttgcacggtgctttctctaaatggtggagccagtcactctacagttagagaaagggctgtataagacaggtcagggaaatctcagtttctcccacttgtacaccttcctggttggctgctgcagccctacagtcaagtctcaaggatgctgtggcaggttccatgccaggaatatgggtaacacaaacgcagcacctcccattcaaggccgtaggtaaccttttgccacaccctgccaaagacgcccttagaaataggacactcaacctgtacactgagtgtcccaaggttgagtagctcagggctgtgttcaatttggacatctggtagaaaccagtgttcttcatttccctttgatgtccacctgtttctcagaagtccccaggccacacatctgttggtcttcatgttatgcctttacccataacagtgcccagaagcaagaacagccgtctcctccaaggttgctttggagcctgtccttctccatagtctctgctgactggctgggcaccaatgaggtagataacccagggccagggctctgttgtaggcccagcccgtaatccctcagaatagcagaatcagtagaagccaccttcaactgccatgctctcatgaaggggaaggaggagtcggccctgtgcttgttagccaagtcctgacctgttggttagtgactctgatttccctaaagcctcattttgatggtccctgcccaggtgtctcttaccccctggaataagggcagtgttgagctgatgtgagcattaaacttcatagaggcctgactaacctgcctcctgcctatgacttccttgtgacctgtctatgagaggatctcagagcaaatcatggtggtagggacagagtgggctctcatcttggaagccattgcctctgcatgccccagagtagggctaggctgagcctgattcagagtctgcttaggatataggctgagcctgattcagagtttgctcaggttaccgccactgagtacccccttgtccttcagtgccatctctggaatcctaatctttggtctcccatcaaaacggcaaactggtgcttcccccccttccagagcagaggctccatatgtctgggatttgtgacggagagcggccttctcttcagttccctacaggaccaggatttgggggtcctggcccctctatcccacccagcggccccagcatgaaaccactcacttcaggtgccccgtgtgtcatctgtcatcatcttgagacacagaactctaggtccagttttctttgcagctgaccactacttggcctttcataggcaggcttccttccagtcagagatgtctcccctcacccctgctgtagcatggtgatttccccctagaaatcccgcacaagacacatgactggcccgggcatcttctgaatgagacttggggccagaactagaaatgcgatctcacgtgcgctgttcccatctctcagcagtgactcctcttcccctttcattccccactttctaatgaccctgggtggttccacttctcctttctgatcagcttggtgaaagcagacagcagaggtgcagtctctctgcacggggactgggaggggcagccactgagttcagacatcacaacccagcttagctgctcagtacaggaatgacacatcacaccaatggctggaccagttcttaggtacacacaggcaccgtgaatgcagtggatcagagtataacaaatgaatagtatgtcatgtctctgtagctccatccaatggggtcatgctataatgtaagtatagtgattgctatatctcccagtttgtaagacaagctaaaatcataattcctctatgagttccttttctctctctcctctctctctctctctctgtctctctctctctctgtgtctctgtctctctctctgtgtttacccctttccagtattgagggttgaagccagggcctccaatatggtaggcacattctgtgccactgaaccacacttcagcattgaaatccaagttttaggattatgagtctgtctgtctatttcgaggcactcaggatctgtaaccttggctggcctggcacttaaatagctcaggctggccttgaacttgaagcaattcttctgcctcagccttatgggtgctggaattacagacatcttctaccacactcttctccaatttctaaaataatctatggaccgacaaactacattgataggccagatttgccccttacatctgcttgacctgggacaaagtataaatgtcccatgttctaggtctcaatacctagacaccgttctcttctctggcaaagatgacttcacatctgccctgatgtgccagcttcaaatttaggatttttagacaccttggaatttgatcagttcaggtaatggggagacagacctctagtggcagtcagtctgttcttgctccatccctggctcctcctgtccacagcatcaaactctgttcacactccagccccaggaaggacaattctggaaagaactgcagccatgggaggagcattagcttagggagtctgggcatcctggagacacagagcactgcgggctctgaggaggtgtgcctcctttgtcctagggattcctttcctcgagccaggcgtggtggcacacgcctttaatcccagcagttgggaggcagaggcaagtggatttctgagttcgaggccagcctggtctacaagtgagttccaggacagccagggctacacagagaaaccctgtctcagaaaaaacaaaacaaacaaacaaacaaacaacaacaaccaaagatcccttgccccactagaaggaataaaaaaccaggagacagaccaggttaccagctgctggaccacaactggctggcaatgtatatttgaatgtatacttccagcccctgtcacagttgctcctgtggttttgtgacacaggaggtgaggcatctgggtatcccacttacttggaggacaggtaggctgtctccatcctccttctgcccaggttcccttctctccaactgatttcagcattccaaagttgttccagggagtcctagcaatgaaaggggttaaggaaccaagaccaacactaacttccagttctgctttgttttgtttatttatttttagacatggagtctttctgtgtctatgtatctagtctggcttctaacttcaaatccttctgcctcatcctcctgagagtagggattgtaagcatagagagaattaataccttaagacccgccaaagggcagtgcgtgactcaaaggaatgtgtttctcttgattttaggtcaccaacactgatgcagggatgtttgttagaattgttgctatagagatgagcagtgtctgccctagtcttcagtaccacacaaagagtgggaggtaggactagaaaggggacagagatgtgccaatcctaaaactcttgtggggtatgtggcttagttaagttcaccatgtgatgtaatgaaataccatgaacaagaacttggggaggaaagggtttatttggcttctatttccacagcattgtttgtcactgagggaagtcaggacaggaacttgcaaacagggcaggaacctggaggcaggtgctgatgcagaggcttggagggatgctgcttcctggcttgctcctcatggctcgattatcctgctttctttcttttcttctttcttctttctttcttcttcctttcttcctttcttccttccttctttctttttctctcctttcttctctttctttctttctttctttcttccttctttctttttccctcctttcttttctttctttctttctttctttctttctttctttctctctctctttctttcttccttccttccttctttctttctctctccctcctttcttttctttctttcttctttcttctttctttctttcttctttctttcttttctttctttctttctttctttctttctttctttcttccttccttccttcctcccttcctcccttctttctttttctctcctttcttttctttctttctttctttctttctttcttccttccttctttctttttctctcctttcttttctttcttccttccttccttctttctttttctctcctttcttttctttcttccttccttccttctttctttttccctcctttcttttctttctttctttctttctttctttctttctttctttctctctttctttcttctttccttctttctttctctctccctcctttcttttctttctttcttccttctttctttctttctttctttctttctttcttccttccttccttccttccttctttctctctccctccctcctttctttctttctttctttctttctttctttctttctttcttaactttttattgactcctcatgagtttcacatcatacaccccagtcccgctcccatatcccctttcaactttgcaacctcccccccaacataaaaaacaaacaaacaaaacccaaagcatagaaaacatctcattgtgaaagctgtagtatgtcacagtgtgtcccacagtatatccttctgtccacacatcttcacttgcaaatattcgttgcattgagtcagagtcattggtctggttagagatctctggcttctgtgacaccatcaatattggattcttaccaggactcctcatggttatcctgttgttgccccgtgtcatggagatcctgcagctttggaacaactggactgaccctttcacgtgacccaacttttagcagatgatatagatttagggtgtaccaactcagatcttggcctaccaggcagccaagctagtcagcccactcccgcccaggtccacctagaccaatagggtctcccttatctacatcaccaggggagcttgcagtactactctggctaggccacccaatgcaccatcagcaggacgcaggttcaactctgttctcatgacttctcaccggctcacccacacctccaccatcaaggccaactccatggtgttgcctagatgaggtgtacggcctgctctcctgagtggtgcagctggtgaggggtagggccagctctcccacactcatgaccctgtgggcagctttcccgactgtcagaggtgataggggcagggcatgatctctgtgcccatgccaccccacgacagtagagtgctgtccctggtggccaccctggcccccgactctcatcttgtttttatgctgatatgtgatgtgagttaactcccttaagataaacaaaaaccgaatactgcttgagtaatctactggtaagcagagctaagaaaccctctcttagagaatttcataggaaaaggcacagatggatcctgtgctcaggggtctgcctggtagactcctgtaaaaacgctgccaagcctgtcaatgacaaccatggttgaaaggggtggcagagactggtcattgtcttatattttcttggcaataagataataagttccatcttcctgcctacattgcagctagacctggccatgtgacacagttctaaccatgaactttaaacaagtaggtcttacaaaaaaagctctttaaaaattgaagctgtcaggggactgaagagatgggtcagtggttagagcacttgttcttgcagaggactagggttcagttctcagaacccatagggtgactcaaagccatccataatttcaattccaggggatcttatgtcctctgaactatgagagaaccaggcacacatggtgcaaatacacgcaggcaaaacattcatacacataagaataaagaaatctaaacaagacaaaacagtgaggctatcccagtgagcacacacattccccacctcttttttttttttttttttttttttttttttttgcctgaaagtagatgtaatactagagagggagccactatcttaggaccatgagcaaaccatgcatgcatggaaagaaaggaaagagattctaggtcactgataattttaaaaaaaatggggggggggggctggagagatggctcagcggttaagaacactgcctgttcctccagaggtcctgagttcaactcctagcaaccacatagtgactcacaaccatctgtaatgggctccaatgccctcttctggtgtgtctgaagacagctacactgtactcatatatattaaataaataaataaataaataaataaataaataaatattttttttaaaaaaatggctaaaaccataatggtttaaaaaaaataccattcttaaccgtgcatggaagtgcatgcctttaatcccagcaatcaggaggaagagacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccctctccctaattggactccccctcataaagtaaaaggaacaccaatttctggagcccctaaattctaaagttatgtaaataaatcaggaaaggcaggctaaaagtcaaaagaatataagtaaaataattcaaagtccatatgacttaattcaaaaatcacagttatatgtaattcttatggtatatcatgattttcgtgaatctcttaatatagttactgactcaatattcagaaagagttgttttgcatatagaaaactgctgatttagaattaacatcactgtttattcaacaacagcaagtaatcagaaatagaaatcctccattatataacacatatccaatcccatacaggtctgccaggccctctagcacaagatcatgatgaaatcggtcaaccattaataggatacttgctagaagcttcagaatttcattttaaaacacactatttaaaaggggatttttctatcacttgacaacacactgagggaattataaggaaatgtcctgcttgttctttgtataatcaaactccgttaactggaaggagtaaccctaaaggtcccccaaagaaattaaattttgcaaatggatatgtttcatttgcagagtttagaaagattaaaatatgtgcaccataccgtagacacgtattcaagatttcagtgggcacagctttaagttctggaaaggatggttttgtaatgacacatttaacagaagttatggcaaccatgggaataccctacaaattaaaactgacaaggctccagcatatgtctctagtaaaatgaagcaatatttttgcctactacaatagaaagcatattgcaggtatcccacacaatcctacaggacaagcagttgtagagagatctaattgtatttttgttttgttttgttttgttttgtttttcgagacaggatttctctgtatagccctggctgtcctggaattcattttgtagaccaggctggcctcgaactcagaaatccgcctgcctctgcctcccaagtactgggattaaaggcgtgcaccaccacgcccggcaaagggagtccaaaaagcctacagcacctggcattcccaggaggtatcccatccaagtactaaccaggcccgaccctgcttagcttccgagatcagacgagattggtcacgttcagggtggtatggccatagacctaattgagtttttaaagggatgcataacaaatgaaaagggataacaaagacccccagagaaaaattacataagattttactaacttcattttttttttggtttttctttttttttctttaagatttatttatttattatgagtacactatagctgtcttcagacacaccagaagagggcatcgaatcccattacagatggttgtgagccaccatgttgtggctgggaattgaactcaggacctctgaaagatcagtcagtgctcttaaccactgagccatcttaccagcccaactttaaattttttaaatgctaatgaacaacaaaataaacaagcaaacaaaacagctgttgagagacattggattacaggaaaaaaaaaaaaaaacgctgagctaacccagcctgtttatattaaagatatcctaacttcagaatggaaggaaggaaatatgttatgttggggaagaggttttatctttgttttaacaagagaagaaaagctatggactccttcaaacctaataaagattagatttgaccagagaagacttccagaagaccctgacttcaga

SEQ ID NO: 996 - DNA, 912 bp, Mus musculus
gcagtccctctgcacccgagagagaggaggacgcaggggtctgtcagaggttgctgttgggcaagcaggggaggtacctgtggaaggtggtgtgctggtggccccctagcagtcaagaaggggagccagctagtgagaagatcgcccagaggcatctgggacggtgtgggagagcccggaagattagaaccatgcctcacagctccgacagcagtgactccagcttcagccgctctcctccccctggcaaacaggactcatctgatgatgtgaggaaagttcagaggagagagaagaatcgcatcgctgcccagaagagccgacagagacagacacagaaagccgacacccttcacctggagagtgaggacctggagaaacagaacgcagctctccgcaaagagatcaaacagctcaccgaggagctcaagtacttcacatcagtgctgagcagccacgagcccctgtgctccgtgctggccagtggcaccccctcgccccccgaggtggtatacagtgcccatgccttccaccagcctcacatcagctcgccacgcttccagccctgaccttctggacaagaagggcgatgctactcccgtgatcccttggaggggcatgtaaactgaggccgggctgccctcatacctctacccagaggcccagtggcagaggcctggacaagtattgaacacaagaactgtagtggtcagagggacttaaggcctcccagggaagtatagtcaatgtactggactctcccagggaagttcgagccaatgtactggacccaaaaattgacaagtcaaccctggactgtcatagaatgatgcccaaaatacacacaccagagggaggagggcagggggtggatagttttctaaataaatattttccaaaaaaccaaaaaaa

SEQ ID NO: 997 - DNA, 378 bp, Mus musculus
atgcctcacagctccgacagcagtgactccagcttcagccgctctcctccccctggcaaacaggactcatctgatgatgtgaggaaagttcagaggagagagaagaatcgcatcgctgcccagaagagccgacagagacagacacagaaagccgacacccttcacctggagagtgaggacctggagaaacagaacgcagctctccgcaaagagatcaaacagctcaccgaggagctcaagtacttcacatcagtgctgagcagccacgagcccctgtgctccgtgctggccagtggcaccccctcgccccccgaggtggtatacagtgcccatgccttccaccagcctcacatcagctcgccacgcttccagccctga

SEQ ID NO: 998 - DNA, 44567 bp, Homo sapiens
accctggcctggagatgtccagctgaagaacagagaatgcttggttgggaggtagagacttgagttgctcagcaaagtaggaataaaggtaacagggctgtgagatttgggagcagtaacagagaaagcctcagaagggaaggggtagacaggcacagaaggcatgagaagggtgactttcgagggaaactgtagaaagaggattttttgatttttttttttttttttgagacagagttttgctcttgttgtccaggctggagtacaatggtgcagtctcagctcactgaaacttccgcctcccgggttcaagtgattcccctgcctcagccttcctagtagctggaattacaggcacccgccaccatgcccggctaatttttgtatttttagtagagacggggtttcaccatgttggccaggctgggcttgaactcctgacctcaggtgatccacccacctcagcctccccaagtgctgggattacaggcatgagccacggtgcctgtctagaaaaaggatttttatagaaagttggtatgtgatgttattccctttttcccttttcttttttttttttttttgagacagggtctctcttgttgcccagacaagagagagtgcagcagcatgataacagctcactgcagccttgatgtcccaggttcaagcaatccccccacctcagcctccagagtaactgggactacaggtgtgcaccaccacatccagctattttttaaattgtttttagaggtggtcttgaactcctaagctcaagtgatcctcctgactcagcctcacaaagtgctgggatcataggtgtgcaccaccccatccggtcttactctctttttttcaatatttctattggatgagactctacttggataatcccagttttatatgggttacataaaacaaatattacggcagtaatagctaataggcactgtatgcttactaggcactaatcattgcactaagcaatttaaatacattcagtggtatgaggtggcaccattatatagatgaggaaactgaggcacagagttttaagtgattgtccaagatcacagagttatgaagcgacagagccagaatattggatttcatattgaaacccaaagctaagaggccgttttcgtgttcctgctttcctccttgaccatgtctctctctgtatgctgtcagggttgagtgagtgagggaaggatgctgaaaagtcatttggttcaggcctcacattttcaaagcacttaactccagtgaggccgtatatccagcctgagatatttagccgggcctgagagatgaggagatttacccagcttttgagttactttccatttattgatgctaccacctccagagacccaggaattaaatactcatataaattccatcattttctggttgtagtataagtacattacttttaaaacataccatattttttgttaaccttattttgatatatcttcatttttaatctgatgggaaactgaaaaatggagtggcctctctctcaacctttgagaggcctcactccctttcctactgtctgaaaggtgcaggaagaggaggccctgcaggaagcagctctgatgcccactccggctgctgccagtggctggctggatgtgctatcagcatggccatacccacaggttgaagtaggtcaacaacctggggacccagaagctgcgtggtgcaaagtgcatctatccggaaatttcctgagcttcaagggggtttataaggcagccaccaggcccagactgaccaagagaacaggagctttggatgcatgttctttaacccagtggctctcacctggggcgatttagcatctcctccccgtagaacatctggcaattctagagacatttttttattttcacaacttggggttctaccagcaactagtgggtggagaccagagaagctgctaaacatcttacaatgcacaggatggcccaccgccacaaagaattatccgccccaaatgtcaagagtgccacagttgaggaaatgtgttctaaccctctggggctggccttatgaagcgcagccacacccctcctaagaggcttcctccaaggctgcaaagcctgagagggctggactgtaggccactccgccgcgggatttccccttcatcacctggccacccactctggcccccttactggagggctccgccctcaggtaaatgttttccctacttgtttgggaaactttgagaaaaatcccctttagccatcttctgagcagtgaagatgtaccatgtgtgctttttccaccaaaaaaacattaaagcggctaggggatttttattattttagctcaaataactaaatagtggcagccaactcctttaaaggcgactgtcagccctcaaaggggcgctcagatggaactcagaaaaaattaaaaaaagagtgagtttagtatcagtggatcaggggagtggggataacctgggaattctggtctggtggggcaggcgacacagaccgaaggcctccgcccacccccagcctcaagccccctctgcgtggggcccctgggggcctggggacatttgcatgtactctcaggagattctcctttcttctccctgggtttcatctttaataactagatgatgggctgttggggaatgcagggccagcgctctaggaaagtgaaactgccttgcagagggaaagcaacccactgtggccccgaaagacccagaccgccagcggccccgggcagccgccgagggcaccggctcacacttcctgcatttcacaagctcttgcttggcatgcattgatgacttgaactggggggttaacccaaaaagatcaagtgcgagctcaaggcggatgatgagaacagattcggggctggttaacctcagagagcgggagtccgttggtgctaatgaggccaagggagcccggctcctttctgcccccaggcaggtgagaaagaaagaacggagacgaaagagggcccgctgtgtctactcctcttggcccagaagcccagctggaccctgaggccacaaactgccccccactggagaaatcgctgcaggatttctcctccatcaaatcgctgtgtcagagccagttgggggcttttaaaagacgcccacgctcaggcccgcaccaggccacctacactggaatatctgaggctaagtcccaagctagaatttcccatcttctttctggccttgggagattttgcatctccttccagggaaggaagcctgacttctgaaatgattctcacgaaggagaagtgctccgttctgcagtgagcctggccaggggggccacaccacagactcccaggaggcttctgctctgcgtggttcttctgctctcgtttccttaacgattgggccagagcatctctgctcttgtaaaatagcaggcaattagatctcgaagtctttgaagtgggcagattcaccaggcgttggactgaagtttctatttgtcctggcactgagaatagcaaaggaacagggggactgaactggtaaggatatagcaggtttgttgcacttttaaaaaatatgttttcaattaccttaagaacccatttatgtgcagtatatcctgctgctgattttgaacaaggatgatccaataggcactggtattaaaacgctgaaatagaggttgacaagtagctgcttccctaaatccttggagtttccttcctccctccttcccctcctttggcaccaacccccttcccacctccccaagatccagcaactaaaaggttatttgcttggcacggcagggagtaggggctgtgctgaatggtgggaacccacgctacatgggttgtcagctgtgtcacccctaattagacatcatttcaatctactcatgaaagcagcttgctgcaggactctgtgctggccatatttaattagagcagtataaggttttttttttttaagttaaaaactcatattgtattgcccatgtaccagagactattctaagaactttacaaacattaactcatttgatccttataacgaccctatgatattggtggtgtgatatcctcccgttttctaggtatggaaagaggcatagagaggtgaagtctcttgctgatatcttctagaccgggctggctgcagggtctgttgctctcaaccagaggaaatagaaccatgaaagaacaaggtagggttttcctccttctgccaaactgagattcacaaagtggactctagcattcttcctctctgccattccctcccaccaaatttacacctggggaaacagtggcccagagagggaaggagaccttcctacaatctcagagtcaattgggggcaaagctaggaccagaatgctgcctctcaactccccctcgacctcatatcatattgcttacatccagctaaatgtctcctcagaaatcagttggggaatatggtgattttaagtccataaattctttatttaatactcctccctctaagaggtagagactcatttgcctcccctcaagtgtgggctggactcagtgctccattctacttttttcttttaggtcagcctgttgcccaggctggagtgcagtggctcagtctcaaatcactgcaacctccgcctcctgggcttaagtgattcttccacctcagctctgcccagctaattttttgtagagacaaggtctcaccatgttgcccaggctggtctcaaactcctggactcaagcaatcctcctgcctcggcctcccacagtgctagaattacaggcatgagccatgccacccggccccaagagtagaacaaagatggaggactaggtcataaaagacactgcaactcctctctctctctctctctctctctctctctctctgtctctctctctttctttatttctctctcttgttgttcactctccagggagccagttgccatgtcatggggaggacactcaggcagccccgtggggagactcatgtgaggaggaactgagatgtcttgccaacatccatatgagggagccatcttgtaaatgaatcttccagtcccaatcaagtcttcagatgaccagagcctcagctgataacttggctgcagcctcatgagagatcctgagccagaaccactcagccaaggtgttcctagattcctgcctctcaaaaactgtgtgagataatagatgcttattgtttaaagttgtttagggtaactcattgtgtagcaatagatagctgaaacaggaggctctacatttactcttttttttttttttttcttggagacagagtcttgctgtgtcacccaggctggagtgcagtggggcaatctccgctcattgcaatctgcgcctccctggttcaagcaattctcatgcctcagcttcccgggtagctgggactacaggagtgcgccaccatgtccagctaattattttgtatatttagtagagacagggtttcaccatgttggccaggctggtctcaaactcctgacctcaagtgatctgcctgccttggcctcccaaagtgctaggattacaggcatgagccactgcacccagcctacctttattcttaaaatgccataaatgcacagagtgttttgaggagtcttttatcccaaagtattccaactatatttcttttaaaaatttagggcaattaaggcattttaatgcatgtgaccctccccgccccacattcccccacccttcattatttcaaactggagtggtcttttgaattttttcctgaacgtgtttccagaaagtttataccaagtaaaacagctatatccaagttcctagtaattattacagcaattacaagggttccaagcctaataaagtaatctaagggcaggaggtttggaggtatggttatttcttggcattcttctaatgacagcctggagctgagtagcatcttggcagttgtctactgtttgaatacgttagactgctcccaactctgtcacttgctaactgtgtgaccttgggcaaatgatcgaactctctgtgccttaattgcatataaattttagaatctaattatgatacctgctctgtggaatcctggggaagattaaaatgagatgtggtagagcatggtgcttataagcattgaaccaaattgcctgagtttgagtcctagctccagtgacttttctagctgtatgatcttgggaatgttacctaatctccttgtgcctcaatattccacatacataaaatggggtgaggtggggaaacggtgcttacctcctgtgactgtcatgagaattaaatggagccaattcatatactattcccggtacacagtaagtagcatatggcaaggatgctaggtatagttgtgcaggttgttcactgttcaagggctccaacctgagaggtcaagtgagggcttgccaggccatacgctttggtatgaggttgcctacctagaggtggcgctgttttctagtttgtaccaggccctatatcagccagctgtcagcataagggtttgtagtatccagcaaccactaccttaatactatctttaggctttaggctgatgttcactgagcacatgccagttttattataactgttacttggtagcttcctggagttctccaggataacatcagtgggatgtgtatatcccaaaccttgccattaccattcagatacaatgctgaaaatcaaataaaaaatattagcaaggtaaaaagtttaaaatcctgcaggacaatattatatattgcttaggcatacatacaggtttggttcaagtatagaaaaatgcttaagaatgataaaccccacatctggataatgggttacctggggtggggaggaagcggaattagaaagggatgaaggaagcttcggctctattcataatttatttcttcagcttaatggtggctacataagtgtttattattttttaatcttaaatatttaaaaataatgtataattaatactattaaataagacccgtctttttatgtaaaaactaattttgcatttctctcattagtctctgttaaatattaaatcagtacattgattgggaatgacagaatcaagcaatcattcattcaacaagtgtttacttgttgaatgataggatgttcaaagagctaagaacttcatccatacgctgtaatacttagaacgcttgtaacatttataataacctgtttggttatttgactatgttttcttttttctgtgagagcagagtctctgtcttattcatatttaagaattctgctctgtaataggtgataaataaatgttaatttaaaccgaatgaaacataaatatgactattattgtcctgaaagggctttcaatacactaggataatgcaggtcataagtgccataaatgaagagcaaagtgaattcacttatgcattcattcgtttgaaaaccatttactcggcatctgttaggtactgagcatatgactataaacaagagaaacacagactttggtttttacagggcccacttctcaccactttcatcactgtctaactggcctatgctgccagcatcttttgtttggatggttgcagtaatccaatactgaaatcctgactcatctccctgcttccactttgctcccctatcgtaaaatctcaactgtgtccagagagatcctctaaaaacctaagtcagatcatgtcactcctctgctctgacacctccaatggcttctcatctgtaggagattgtagaaattgccacaattagttaaatttttcctatcgagaagtgaagtctgtttctcaactcattgagtctgaactggccttgtgactttcctcggccaatagaatgtggcaggttctgagttctgtgctagctctgagcctgggttccatggggcttcgaatgcttctgctcctactcttggaatcctgccactatcaaataaacatgctccgaccagcctgttggtggatgagagaccatgtggaggagaaatgcccaaggcaaagccaggccagaccagtcaattatcagccaacctaccagctgtctgaggacacatgaccgagcctagccgagatcagcctagcccagcctatccccaaagaacctttcagatgacccacagactcatgagccaaataaatggcttgagtcatcgaagtttctggtagttttttgggcagcgaacactgatagactatctcatttagacaaaaagtcaagcttctttttactaactgtatcctcagtacttagtgcctggcacatggtagatgcaccatgaacgtttgttgaatatattaataaaggtgtaaatggttttaacattctattgagggaaacaggaaaaagataaatcagtaaacgaataaaataagtataaaattgggtaactgctatgggagaaatgaatagtagctgaggtagaggataagaatgaaggtggaaggggaaaccctccatgggctcactgtgtctttcagaatgaaagctaaaatcctgatgttggcctctaaggccctccctgaccgggccattacctcactgacctcatcgcctgccacttttgctgcctctggtatccaactacctggcccccctgctctttttccaatactcaagcacacttccacctcaggtcctggaatgtccttccctgagacactcaccattcactccctctctttcttcgaatctctgctcaggtatcccctctttgggcaaggcccttctgaccacccagaattccctaacctccaaccctgctttattttcctccataggaaaggaattttgtcttacttaatttaaccttagggcaatattgtcttagtctagaaattcagctcatggatacaaaaatcctctaggagccgtaacttcctgtcaatcctaaaatttaataaggcaaatgtttggcttcgagccatactgggaataaggtaaggccttttgaaaaagccacgatgcccaggtgagggttgaattgatcactgagaaccctacaaatgcgctcatggcaaggctgggaataccctacacttaccctctcggtcatttacttcagagtctgcggggcattctaatccgcgttgtcatttgctttgtgccacattcctaagaggtaggcagggcaggttttatcatcctctgtttacagatgaagataatgaaggtcacatagctcaagtgagctacccagggccacagacatacaaagtggtagaaccagaatttaaatcttggttggtctgactccaagtgtagtatttgtttcactttttctttctttctttctttctttctttttttttttaactgtttctccattctgggttctgaccaggtgaccttgaatcataaagattcagggcctgtcttgagctgctcaatatggaaggcatcttttctctaaagagtgtgagctccctgccaagcagcacaggcgcttaataggctttcagagcagcaattctagaacctcccttgtggctttctgatctcccacagcccttgtgtttgatggtcaggaaaggagaatacccttggatcgtcttatctccagaccaccccgaggctggctggacttaaggggtgaggaaagacaagatgggtgagcagctgctttcggctgaaaaccagaaagaaatcccagtgtttttgctttattttggtttaaaaatcaagtcgtatgacaatggaaacattttcctggttgtcctctcctctctgcccatgttgacagaagacggacttgctaattctggctggggtttttccctgcctgggctgtttttctcttttatcttcatcaattgaagagggctgctgtgtctttcaaactgtcggaaggtatctgtatttttttttctttcacataattctgtaggtcttttcccagatatgtatttttctctctaacttctaactcgctgaagtttccgcccatgtgacttccagcgtgagttaccagaaaccacaagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggtagagtcctcctttttctctctcctaccttctgattctcctgggggatggaaagagagccaggcttccttgtcctgcccagggagctgaggatggaggaagtggctcgttgcacgggcactctgttagacttaggacatggaatttgctactaagctgtgcatattggcagagatcctcatccttccacccattcttccaaagcccctttttctctccattttccaaggctgcctatcacctctgcctcactggggttgccaccctaaaaagctttctaggaagcaaagaggaggatgaacatcaaagaatgcagagaaaagagtctactgttctccaaggctgtagaaaagtgagaggagttttcaagtgggccgctggcatgcacagctcaaatcctagatatgcagtttcccaggagacagccaatagggaaggggagaaaaggggttagggaaaagttaaaaaaaaaaaaaagaagaagaagaaggagaggaagaaggaggaggaggaggagaaacccagggctagcatagaaggatctctctactggggcactgcctctgttgctagcacagccagcaaggggagatgctagaggtccagccaatatctctttgcttgtggcttctggataggagcaaggaaatgaatgaggaggtggctctggaaatttgttggaagacatttgctggtagttcatcttagctctggggaaaccagagagactgagatagggattgtgggagcatttggagtctagattgtgacttccaagtccaaaggttttagcttgaggattaccaaaaaaggagtgccctgcccatctcacagcttctagggttttgttctgcaccacactcttgacatcccttgctgtaggaagccctcctctttctcatccgacatgtatccgtgggttaaaattttctcaaccttcatagtttaaaaacttcattctttccttagcacagatatccacaagggttttcaaaatgctgcagccaaaataaaagtatataaatattgaacagggcgtatatcctaagcctctaataacggagcagcaggctgggatgagtctgggtggagacctctagaaggcacagaatccagtctgctgctcaagatggtgtcagagtggctctgactgcctggaagtttgtacttttcttaggaaggaaattactcatggcttccatggtaacctggtgccccatcccccttagaggaagagcacttccttcctatctatgccaatgacctcctaccacaaaggcctgaaagtattggacatgttggtgagcccagtacttagtgatcccagagctttgcccttggatctgtgcccctctagcctgtgggagacgtggaagggaacagggcatgagttgccaggactcctacacctacactgcagcatctgggagagaactggagctaacctctctgcccaggcacaggacatgcctctctctgggtgtaattagagaacacccaaagatccccttatcctaccaagcacccatctactgcccaccacagccaggtcacctccaccattaacgttctttttggcattgatgtgccaggcattgtgctggggccatggggaatgtcacagtggctgagcacaacggaaggaaagaggaggcagatctgggatgcaccctcagctcaggaatgcagcagaagaccacatggggtgcagagtagctagcggggaagggtcttggaaagccattgggctcagcaccagaagatgtagcactctcagatgaccaggagtccttgggcacactcttagagcctcagtttcctcacatataaaatggaaatgatgatatcaacttcacagcattggggaattaaacaagagcacctctgaaagaacacttgcccagaggttggcatatagtaggcactcaacaaagtctgaaaaaaagaaaacagctaaaagaacagcaagaagagcctaaaggccaaaaagtgagagggcgagggtggagcagccctacagaggagaggtgataaaacacacttcatcgccttaaccattttttttttttttggccaaatacagctctattgagtcctcaagttctcttttctttttcctgtagctattggtcaaaaaagtcagagacctgggaatgtgtaagcaggcatggagaagagctctccttcgggtgcaggcttttggtaaatagagggatggagggttcatgcagagacgaaggcatggaaggatggctggacggataccacacaccaccagagcctgctttcactcagaagggagatgcagacccatgtaatcctccccgtctctgcttcccaggactcatctgatgatgtgagaagagttcagaggagggagaaaaatcgtattgccgcccagaagagccgacagaggcagacacagaaggccgacaccctgcacctggtaagtgttcagatcaatcttcatcctcgtgagctttaggctttgccctccgccatctgggaacccttggaccatagctttgattctgcttgtgtggggatgtgtatgtggggtgggttagtggagggtgagggccgtggggtgaggtagggaagggaagctgtcgtgagagtgctttaagaaggctctgtagtccgggcgtggtggctcacacctgtaatcccagcattttgggaggccaaggcgggtgggtcacctgaggtcaggagttcgagaccagcctggccaacatggtgaaacctcgtctctactaaaaatacaaaaaattagccaggcatggtggtgcatgcctgtagtcccagctacttgggaggctgaggcaggagaatcacttgaacaggcagaggttgcagtgagccgagatcgcgccattgcattcaaacctgggtgataggagtgaaacttcatctcaaaaaaaaaaaaaaaaaaatagaaggctctgtagcagggaatgggccaggaggctgaacagagaaatgggcctttctaccccaggagggctcaaggggtgggagaaggcagagctgtattgggaaagaatttagaaggtatcaagtgctttggggacggcccattgtctcgcagtgcaaggaccacacatagtcgcatcccttggcagagacccaaatgcccctgcatttgacacaaggaaattcacagggcgctgtaccagattcctcttttcagagcattattaaagtcttattttgaaatttctgtctttaatggtatcccaaggggtctatgaaagatgcaatttcaagtgcccttatctgggatgatcaccatcctagttgagttgcctctagtcccaaatttttctagagaaagcttttacctctgtcttgagtggtccaggggccttgagcagtgctgaactgcagttccgccagtggccaaggccctagatggtgtttctaggttctggctgtgccccttataaagtactgcttcctccccattgctcataccttaccaccttacctctcttcactctgcccccagtatggttcttgttcaaccaactcttcactagttcctttctctccatcccctcatccccttccctagcaactctaccttcctgcccttgctccagaaacattcccttacctctaatagcctagcaattcctttccatggaaaaagtgcaattggcaccaaaaatcaataagcttgtatttatctggaagattagcatgataatcagccagttagaatggctgtgttaaccgtatcaagaataagtaagtaagatgtagttttaggggaaataatgcatctttcagctttacaaggaaacagagcagactgcaccaacagctctgattgggtgcttgggttttatttgaaatgtattcagcttacactccattgcacactaacattaaattcacagctatttgttaactttttggaaagaatgaatgaacagaaagtctgtactaactgtgctcaacagtctgaatgtcaagtttttggtggccctgctgcttgtatgttctccatgatttcactgtgtccccacattctggtttaccaccttaagcttgaacatctatgatccttacctctttctctatcagagtctgattctgattcagtattctttagggcaagcaaacagaccaatcaaaatttaaaaggataaaatcttccttgtgtacaagtagacaatgtcctcagactggcaaactgctgtaagctttttaagtgtgtacctgttttcttaagtggaatgtaagtatagttcggcagctcagcagtcagaacagggattgaatcccagccctgctgcctactatctgtgtgacagagacgttcttggcctcccttgggcttggtttccttatctagaaaatggaaaatgacaataactaccctatacagatcgtacatttaaagagcccaacacaatgcctgtcattcataaatactcaaaaatttaagtataataagagtaataataattatcataagaagcaagataatcacaaattatacacacattttatatatatatgaaaacatatatacattttgtgtatatttaatcacagaagctcagggttgaaaggtttcttaaaggctagaaagtttagacataagtttgatgcttcagacttctctgcaacacctccagccaatggtcccattgtatgcctggtcacttctagggctggagatcttcctctctcccaatttatgaacagaagagtctttcctatgttaagctgcacccctgtctccctgtaaattcaactcactggtcttcatccaaacccttggggaacgtattaatgagggtgacacagatgtctctttgctgcggcaaggctttcagcactgaatcagctctctccctctccaagacaaatgtcagagcccaaagagtcagctcatctaattatacaagtcatgtgacattagggtaatctctagagcttgagggtccacagagccccaagtcatatagtcaacatatccatagccacaccccagcctcagtttctagaatgttccaatcttccccacatctgaacacagattcctcctccactgctttcttttgagcaccacagcatcgtctttaccttttgcccaatgagtaggtcgcagcggagttgatgcagcaagcctgcggactgctgccaatgcaacttatgtttcttggcttcaggtagaagcttttggcagcaacgtgttcaatctgccctacatcaaattagctgtggtttgacatcttcctttcctccgagatgacaatcacctatcttctccatccattatcctcttaattatgtctgagattcaggtgaaaagtcttctggtttaccaccagtgtcagggctcagtgtgtggtttgcccttgactcctttccatgcttggctccacatgctggggttgttctctggccctcagacatggccataggcctcgcctaccagtgctttacagatgagggtttgggagctactgagagtaccatatcaaaaaaggaccacattcctattagggttctagcctcatatatactggtatgttttcttagtttcaactgctgtcactattatcaaccttaaaatactgaaacaattatcttgttcctctagtgagagtgtgggatgcttactattcgacattttcagcatctatcctataaatggctggcaccaagacactgtacatcgattgctttaaaaattgacagagtagggagagagcctctttttatgattgtgttataaatccctggccttgactatctctgacataaaatggatcggtgattcctttcgtaattgtgacatcaacaaacaatctaattctgttttaattctccttttgttgagcatctcacacaagcaccctgcacacttagttccttttctcctgcagacaactgtagggttcattgtatatagtacagatgttgattaaaaaagagaaaggcataacttgaccagttagtttctaaaagatatcaatagctaataagtggacctaagataatcagctgaaaaattatttgaaataataagagaatgcagtcagcttctaaaattaaaacaaaatgtaataacgttcctatatgcaaaacataaccaattaggaaattaatggaaggaaagatcctgtttataataccaatgacaacagcaaatggaaggaaggaataatttaacaaaaattatgaagagtgtatcctaaatgatttttaaaagattcaaataattggaaagatataccttatgtaaagttagcaattttccttaagttaattgataaatttaatgagatcccaataaaaaacccaatagggttttctgggatttgggcaagaactagattagctattctaagtttccagtgaaaaaaaatcatatgacaattgccaggaaaattctaaagaagaagtataatgaaaaaagattaactgaccaacatattaaagtgaaacacaaatacagaaatcaaaacaatgtggaaaagacagaacattgaacaggatagaatatggaaacagacccaaaaacaaattcagattttaagacccaaatacatatttcaactcctaggacacaagtataaatacaaaatgggctgggcacggtggctcacgcctgtaatcctagcactttgggaggccaaggtgggcagatcacttgaagtcaggagttcgagaccagcctggccaacatggtaaatgttaaattttttaaaaaaaggaagctaaagaaacttgaaaagacaaataaccattaaaaatttatcttggaatgaggaattattttctaaataaaacataaaaccctgaagccataaaggaaaagattgatatacattacttttattcataaaaagtaaaagtttctttatagatcaaaatactgtatgcaaaatcaaaggcaaatgacaagctgaggaaaaatatctgtaatacatatgaccaaaaaaggtatgtttacttactatatgagagagctcttatgaataggagatgattaacaacccaaaagaaaaatgaacaatgggccgggcgcggcggctcacgccttaatcccagcaatttgggaggccgaggcgggcggatcacgaggtcagcagatcgagaccatcctgtctaacacggtgaaaccccgtctctactaaaaatacaaaaaattagccaggcgtggtggcgggtgcctgtagtcccagctacttgagaggctgaggcaggagaatggcgtgaacccgggaggcggagcttgcagtgaaccaagatagcgccactgcactccagcctgggagacagagcgagactccgtcaaaaaaaaaaaaaaaaaaagtaaagaaaaatgaacaatgactatgaataggcaatttacagaaaagagaaataagtggccaataaatgtgtgaaaagatggtagaccttatttagttaggaaaatgccaattaaagcagcagtgaggctggcaaagatgaaacatgttgttgatacacgatgttgccaaggtaatggagaagcaggcaccatcacacacagctagtagtagagtctgcataaccctggtagaaggcaatttgcccacgtccattcaaattataggtgcacataccctgcgactcagcaatttgacatccaggagtgtgttcacaaacaaatccacacatcatacaattctgtacatgtaaagataatcattgctgcattgtttcttataggaaagactgaacataagctaaaaaaatccaccaataagggattcaataaattattgtccattctgtggaatattgcagatatgttaaaataatgagttacatctgaatgtgctaatctggaaggattatcacttctgtactttaagttaaaaaggcataaatatagtccatagtttgctaccattagttttttaatttaatgttttatctatttatttattttttatttttagagacagggtctcactatgttgcccaggctggtctcgaactcctgagctcaagtgatctgccctgcccaccttggcctcccaaagtgctgggattacaggtgtgagcaacagcacccagccccttctgtgtttttaataaaaagaaaaagttacatatatgcataagtataaatgcaaactttttcaaatagattataaaaaattgttaatgatatttatttctgaaaagtaggactaaagatctaaagcaagagggagatacttggcattctttaccttttatacagtttgggattttttatcacatgcttttatctttataatatagatatcaaaattctcagcattgatcattaccacacatgcattaggaggatttcttttctaattttgacatcaaacattgaataatcttccatcacgacatggaagagtattcaatcttgacgttatcttttgaacatcatacataaatatctcagcccttgggagaaccaactgtaagttgggatttgagtgactctaaggtccacagtactatatgataaaagatggcaaatccgtttcctttgtgtagccatcttggttggttggtcatggctatctggtgccgtacagctggaaggatttcaagtcaaagaccaggatcagtggaaaagagagctgaggtcaattaagaagctttattcatgaaaaggctaaaatcagtggagttgccgggagcagtggcaaatagcagtgttagccctgagccgagctgttgacaagtcatatctggcctggtggatggagctgaaagcaagtgagagtaacagccaagtttgaaagcttgagatttaggtactgtcttagatggaagtgggccaggtgcttgcctggggctgcctcctgaaggagtctcacaccagtataagaaaaaagagaggtttacaggctccagggatgtgctttgtcatatatgacagaaaagtcatgagtataaattatgcattaaatgaagctttgagctaacactgtgagaaatacggtatttacaattggagaaaaattgagtaatggaggaaaagatgtttgggtagcactattgttcttggccttctgaggaggcagagaaggatgcttacggtcctatttcactcctggaattcttttgctctctctgggagaccatgccataatgtttgttggcacagataagtcacaggtcaggaatgttcaggctagttccacccttaaaaagttcaatgtagaatcagtgaaccatctatggaaagagatgcgacccttctgtctccattgctatgaatttcttttaagaaaaaaccatgttaattgaacaaacgactatgtattaaccactgtgcctcaagtgctctccctgcagcatctcatttaatctgcataaaagctgtattttataattccttgcattaagtaacttgatggagatgacacagcttgtgactaggtctgtctgacgtcagaacccattttcctaaccattaagttttactgcctctttcttcaaactctgatgaagatgtattcatcttccctaacctatattttccttgaatctctacatgaattaatttttttgtcttttaagcaatatcctccaaaatctacactgtcccccagccatcatcaggcgtgatcaagaaagtaaagacatgtttactttcaatacagtatatccattgtacaattgatatcatatatgtcatatatatcatgatatcaacatatatagataggtactatatatagatagatacaattggtatatcaaatgatacaatatgtcaattgaaatcttttttgagaagtctgtgtagcaataaatgttaacatctttcacaggaattacctttgacacaacagagtttgaagaaaaaataatttacaaagatgcttagttcatcattatctgtgaatagtaaataccttaacaatgctataaaacttgacagggggcttacaacagaagatgaagcatattatgatacattcatacaataaaaaaatgtatgctggtactaaaaatgattatgtagatctgtatttatcagcatagaaagatgtcagtgatacagcattaagtgaaaaaggcaaattacaaagagcatgcagagtataaccctttcacgtaaaatttgtgggttttgggcatggtcgcatgcataaagagatatccggaaggatattctccaaaatgctaatagcagttatgagtggttgagtttgggtagttcatcttattcttggtacttttctctcttttttattataatgaatgtgtgccattttaaaaatcagaattttaaaaattaggctattttcatttggggagggaaaacacatcaaggaaatccaccacccctaactgcttgtcttaccgatgacgggtcggcatggctaagtttgggaggcatattggaaattgggagtccagctccatgctggtgttgatgctgtaaagaacgactgtttgggaggccaaggtgggcagatcatgaggtcaggagactgagaccatcctggccaacacagtgaaaccctgtctctactaaaaatgcaaaaaattagccaggcgtggtggcgggcgcctgtagtcccagctactcgggaggatgaggcaggagaacggcatgaacctgggaggcggagcttgcagtgagctgagatcacaccactgcactccagccaaggcaacagagtgagactccgtctcaaaaaaaaaaaaaaaaaaagaatgactgtctgtctacataggatgatggtcctaggtcacaaactgacagctgcctgttcagcagatgtcttgatggagctattctcagcagcacccagacttccttctcttgagcagaatgggagtctccccagagtgcccttgtgcaagcttctcagaggttttcttactcccctcttttgaacttagtctagtcccctgcttcctaggaggggtgggttgggtccacagtataaaggccccttcagattgtgggatatctgtagagggttccactacgggttcacatgatggcttgtggagggaataacaatcataatagtcatactaccttgttgataaaatttcagaattaagtgggaactcagagatcttctagggtgacttgccacatttccaatgaggaaactgaggacgcccaagaacccaaacctcttgccttcccaccagtctgcttttgtttcatgccactttgctgaacagagctttactaggcaggtgtttacataaggcctattgcaaaggtgggccaagaagcaggccattaaccagaacacttgaactgcctagacactcatcagctccagaacatacggctatacatgagaccagaaagagagtgagtccaaacttgacaggggctgaagtgtaaatgtttctttgtttaaagagattttaaagttgtaatccaaaattagaaagggcagtgacatattggggaaaatatttgcatcaaattaaagaaatgaaggtttaatatttatgctacagaaagaaactcttataaagcaaaacatcaggactccaatagacaagtgggcagaggcaatgaacagaaagcttacataatatttttcctaccaaaatgaaaataccctaatttcctattctgattatgaaaacgatacacactaaggcagggtttctcaaccccagtggaactgatacttcgagtccgataattctttgttgttggggattgtcctgtgccttgtaaaatgtaaaatttacccacaagatgccagtagaacaccccctcaccctgcttagtttgataaccaaaaatatttccagaacttgctaaatgtccctggaaaggcaaaatcagtcctagttgagaacgctacactaaggagaaagacacatggaaagttgttctttctccttaatacttgacaacctgtaacattaacatgaaattaagaagccttcatcaagctaattggcaacaagtaaattatttaaaattataacacctaaatgccagtgaggttgtagtgaaatggatagaagcattcgctagtggtgacattatatacttgatatgaccccttttcagtaatacttctcaggactgggaagattgaatgcctcctttgcctcattcatttcattcctaggaatttctccaaggaaatcactgaacagagacaaaacccagtgtgcatcacgatgttcatctcagcattatttttaatagtgacaatttgatagcaaccaagatgtccagcattagaagaccactttaagtaaattgtggataatcaatttgatgatgcagtcattaaaaattatgttgactatgtagatgtgacaaagttatgacagaaagcaaaatacaaattgtatgtgtactatgattgaaattttgtaaaaataagtatgcatgtttgttcaaaaggatgagatggccaagtgggatggttcatgcctgtaatcccaatacatacggaggccaaggcaggaggatgacttgagaccaagctgggcaacagagtgagatcctgtctctacaaaatataaaaataaaaataaaaataattagccaggcgtggtagcttgcacccagctactttagaggctgaggtgggaagatcacttgagcccaggaggttgaggctgcagtgagccctgattacatcactgcactctggactgggtaatagagtgagaccctgtgtcaacaaaaaggatgagatctcaatatgtgtaaatgaaaacagctgtattaagggactaggatcatgggcgtttttaacttttaaaaaatatctttaatgtagttatactgtatttttttatttttaaagaaacagaagaaaatggccaaatagagagctgaaggaactctggaggacatcaagtacaaagagacaatattactgagctcgaatttggggatcaggttttggtaggagaccttataatttataccccaaataggaatacttcgagagtggaagatggaacttgtaaatattacaccaggaaaacaggtgtcccagtaaatgtctggtcaccctagacagggaaaccaagaaagatgacatgaagctcttatgaaaactcagaagtgataaagttcagagtcaagtagaggggactggattcctatgaccaaaatgtgatttcctgcaactgaggaccctgtaactaaaaaagggtactcagctggcataagaatatgtcttatcattaagagagtaggatgacacagaaaattataaagcaaaggccatattatcagtactagagctgagatcagcggaagtgattcatctactcaacaaatatttatcagccaggaacagttcgttctaggcactgagaatattgcagggacaggacagacagagtctctgatttcacgaaccttacagtcagttggaagtcaggctggaaaacaaataaacacactaatcacatgacatgtaaagtgcttcaaagaagatgaaatcatgcaatgtggaaagtgtctaagggacgggattggggcagcgatcaggggaggccttcctgaggccctggaatttgagatcaaaggtgaatcaaagaggagactggaaagatctggggagagggtgatctcagcctagagagccttgaggccaagctgcgaggccaggcaaaggtcagaaaggtgcttggtaaggtggagaccaagttcaagaccataagggagtgaggaggaactcagtaataatggcaattgtagggctgagcacagtggctcacacctgtaatcccagcactttgggaggccgagttggttggatcatttgaggccaggagttcgagaccagcctgagcaacacagtgaaaccccatctctacaaaaaaaaattttttttaaatatccaggcatgcacctatggtcccacctacttgggaggctgaggcgggagatttgcttaagtccaagaggtcgaggttgcagtgagttgtgatagcaccactgcactccagcctgggcaacagggcaagatcctgtctttaaaataaaataaaataaaataaaataaaataaaataaaataaaataaaataaaataaaataaaggcaattgtgctgctaggagcaggaactggatggggcatgtggtggggacccaactaattcaaaccctgcctgggggatttctctgaacctaaactctgatcataagttgagaagcaatagcacctcactaggctgtttgaccgtttaattgagagggcaaatgtaagaacaaagcaatattgtcattttttttttacactgttcctttgtttaatgcagacagcctgcccttttcctagaaatcaatcagatatattatcctacatgaacacacacgttcttctttctggttgcttataaactctttaaggatatcagtagtttcaggggcttggcctttcacaactaggcaagtctcctttgttgggtatgaatggagagagggtcaaatttgaactagggaaatggcacgacgaagttcttaaagtggttgtaattctgccactcccacgctgttggttcagtttggggaataaacagaggtttgacctaggccttttgaaaaaatgaatctcttggattcatttggaagtatcccagatttacaaagtagaagctattaaagtgtttgagtggtggttaatcactctctaggaattctcatggacatcacagatttactcagctgacccttcttcataggcacatctcagattttggaaaattattccagattataagttggcagtcaagcaacgtgatttgatcgaacacttactctatggcaggcactgtccttgtcactgagaacaaaacagtgaagacaataatagctcctgccctcacagagctcaacaatgtaaatggtaaggaaacgaaacggttaaagttataattaatgaaacacgaatagatccctgagctcttgcctttccattatatgaatgaactgtgctggactatttagaattgtttccaccaatttaagaatataatagtagtgtgcttaaatggacattttgttttagaaatttttttaactagaaatagtctcccaactctttaaattttttaatattatactataaatgataaaataaaatacatatttaataaaatgaaaatatgtaaaaatataaactctttaaggatatcagtagtttcaggggcttggcctttcacaactgggcaagtctcacaaatttaatttgtttgttaacaaacaaatttaataaaatcaaacactatatagttatgttatatttttattattttgagataaggtttcactcttttcccaggctggagtgcagtggtgcgatcatggctgactgcagcctccacctcccaggcacaaatgatcctcccaccttggcctcccaaatagctgggactacaggtgtgtgccactatgcctggttaacttttaaattttttgtaaagattgggtatcactatgttgcccaggctggtctcaaacttccgggctcaaatgaccctcctgccaaagaagcctcccaaagtgctaggattacagcaactgcacctggccttatgttattattaaaaggaatccactatgaacatgattttttgcccatttggctcacttaggaagcatttttaaagtcttgatgcctgcaaccactccagaacaattaaattggaacctctgggggtctggcatccaggaatccagactgtttaaggctctccgggtgctggcagtgtgcacagccagggttgagaatcagaagcagtacatttgcagcctatcaggtctgtacctgaatatgtggagtgagtagaatgtgtggagtgagcagaatgtgtggagtgagtgtggggcaattgtgtgggtaagtacacagatactctgtcacatacagtggcctgatggcttaaaacaaaacaaacggccaggtgcggtggctcacgcctgtaatcccaacactttgggagcccgaggcgggtggatcacgaggtcaggagatcgagaccatcctggctaacacggtgaaaccctgtctctactaaaaatacaaaaaattagccgggcatggtggcgggtgcccgtagtcccagctactagggaggctgaggcaggagaatggcatgaacccgggaggcggagcttgcaatgagccgagatcgtgccactgcactccagcctgggcgacagagcgagacacggtctcaaaaaacaaacaaacaaacaaacaaactattcaaacccttgctttgatggcagttattatttgttttgttgtttggttttgaacattgataatcttgctagtggtaacctttgtaactcgaagcatcagtatcagccaagattgcatgcattcagagacaagtgagagaccagccatcaaatgaggaatcaacaaatcatggcctacttttctcatgtaacaagaagttcaaaagtggagagaccaggctacagcaaggaagaaccaagctccttctctctaagcagccatcctcagtatgaggctttcattctctaggctgtgagatgggtgccgagcctctcggcatcagtctatgttgaaggaaggaagcctttgtccttatgagcaggctgtgcctttttggtaggaagggaagctctgccttcacctccctcccgcccatcaggtacttctgcttacgtatctttggtcagaattctgtcacatggctacccctagctacaaggtaaggtaagctggaatttttttttttttttttttttttttttagcaattcttttcccagtctttctagaggaaggcaaggcagaaggggtttgggatggacgctgaatgaaccaaactatagtttttttcacatttgagggcaatgaaatcatagtcttgaaaaccaaggaccaggcgatagccttttcaccctgtgactagacaggtccctgagggcacggctgatgtggccaatcttctgtaaatgcaaaggtgcttatggccctagagcttcagctctaagacatgaaagtgaaggttcctccagaatcacacacgtgcattattcagcgcaaagatctgtggtttggtgattcttcttctcctttcataaggtgagaggcagcagttggggtgaatttccccaggaatggtgggagatgtgggcctagatcctcccgctgcttgggaagagtcgtacttttcagttggaagcctgctccaggaatggcgggctccaccctctgcatgtgacgtacaggggctggtaactgatggagcctgaacatatatctgggtgtgagggataagcttcgaacgccacttaagtgtaggtgggagccaaaaggtcaccctgccaatacatgattacatgtcctgttgaggagaaaatacacagggactattttcacccttctggaaattgtgattagaaaatgcaaggagaaggccaagacactaaactggagctggtagggaggaagcctcagccctgctcagggtgcctggacagtccccaccagggcccagctaggaaatgccagccttgtccttggtctttgtccctaatggctcccggcgggtgagggaactgcctggggattccccatcgttgaagcgctctgtgagtgaccccctcctaagcccctccagtaggggatttcccagaatgttcccacgcccccaggaagcctcttccttagccacccccaagctgcttgcggttcatggtagaggtaggtggcatcaaatgaccccacaggtgagggatttgcctgaggtgggaaaagagggaagataaaattggaaagccaccggggctgaggaattatctcataggagagaactgtcaaacagtataacgtttaaacagactttaaaggcaagaaaggatggagggcacagactctgaagccagagtgcctcaattcaagtaccggtgctgcaacttccaagctgcgtgatcttgagccagtgacttaacttctctgttcctctgtttttcctcttctgtaaaacggagataatattttctaccacacaagtttgttgaaaatatcaaatgtaatgataaccataaaatacttaaaagagtgattggcacacggaagtattcaataaatgttagttattggccaggcatggatgattcacgcctgaaatcccagaactttgggaggctgaggcaggcggatcacttgcggtcagaagttcaaaaccagcctggccaacatggtgaaaccccgtctctactagaaatacaaaaagttagccaagtgtattggcgggcacctgtaaccccagctacccagaaggctgaggtggggagaattgcttgaaccagggaggcagaggttgcggtgagctgagattgcaccactgcactcccagtctgggcaacagagagagactctgtctcaaaaattaaataaacaaataaatgatagttaagttaacctaggctatttttttaaaaaaattttggtttctatccacctttttcgtataaattgagccaggttacaccttagacctattagatcagaatcaggcatcaggattgctaaagctccccaggggaccccagtgtgtggatgaggttgagaatcattgttttggtccagtctttccattttaaagtgaggcaactggagctgaatagggaaatcgagtcactgaggatcacccagccaggaccagggcccaagttcctattcccatttaccgctgatggagctcaccgtggtcatgagttcaggacctggctctgtgtctggaggaaggtctggcctcgagtcagcccttgtccagaatatctggccaggtgaccccctctccatgcagcccaggaggcagatggtcagctctatgattggaagaatgtgagtgactcagggatcttgtgttgtgttgtgttgtgtgtgggtcaccaaaaccgagacccagctttctcctgggagacaacagggtagccaaggacttatttttttgttttgttttgttttgttttttgagacagagtcttgctcggttgcccaggctgaactacaatggtaaaatcttggctcactgcaacttctgcctcccaggttcaagtgattctcctgcctcagcctccggagttgctgggactacaggcatgcgccaccacgcccggctaatttttgtattttttgtagagacagggcttcaccatgctggccaggctggtcttgaattcctgacctcaagtgatctgcccacctcagcctcccaaagtgctgggattacaggcgtgagccacagcacctggccaactttctagtgttctcgggagacctttgcccactcaagtctccagtctctcgggggaagcagtcagtgtgagagaaggaacacagggccccgagccaagccctgctctgcgcctccctcgcgggcaatgagtctttgcatcaaacactcaaagtttctgaacttctgagaaaacaagtgccttgaggtgaatcctatagcacagctgtcaccagcctgtggtcattttggagggtatgtggcataggtttgtcccagggtctcagttgtcctcatctgtagagtggggataataacagctgaccttccctatcccacacagagcgttattgtgaggagtctgatggacctggatgaattctgaataggagaaagatgggtacatggatgcccaaatgcaggctcacccccacccctctcagtagcagaagacatgcatatgggagaagctgcatttcctcccagcctcactgtgctctaggtgtccagccctcattgttaggggatgtcactgttgtacctctggataaacagctgctctcatgccacctttgccagttgtcccttcagctgggcgagccctttccagggcatgactgccccaaggagggccagaggggactgggcaatagcagggacatggagggacgaggccccagatcagccacttcctcctgcaagggaagtcaaaccctttctctcataagtgtcaggctggctgcacggtccctgggctggcagggcaggtttcttgggggccctagcaggaagcactcttgcttcccaaggtaaagacaagtttcttatcactggcggtggttttctggttagaggcagcaggcagcggttacaaactttgcctagagctctgggatctgcaagccagggagggggaggcagacgacagagctagagtgagctcagcagagcttgcttagggaggaaggacccgctgtcacttcccgaaagctgggccagcctctaggcggggagaaggtcagagtggccctcccttctgcctcggggtttgcccaggctcttcagagcacagaatttacagtaaatgttgtcaccagtggaaactctcagagggggcgaagaaaagggctagaggaaggagccaggactcccggcccccagttcccgtcttaccaacaccccctagtctcatcgtgttgcttgatcttacctttcggtaaagaggggatgccctccttctgggatgtgccaggaaatacccaaatggtaaaatgaatgagccggccacaccttgcagaaggcagggctgtgactccatcatcgtggctcttgataactcctctgccccgttttagaggggcttcctttgtactgaccttggcacactttctagctcagagccccattcaagaaatgccaggttgaggctgagcatgcttgtgtctgtccttcacagatgatggaacctggcttgatgagcaaggccatgttggtatatgcttctctgccatttagaaagaccccccccaggatgtggggtttaagatgattgacagtataaccgattaacctcattagcctacagctcatgcacctgatggattcgttagggcaaattttattttattattttattttattttttgagagaggacctcactccatcagtgaggctggagtgcagtggcatgatcatggctcactgcagcctccaacccctggtgctccatagctaattttcttttatttttattattgtagatactgggtctcaataatgttgcacaggctggtcttaaactcctgggctctcaggaggtagaggttgcagtgagctgagatcgcaccattgtactccagcctgggagacagagcaagactgtctcaaaaaaaaaaacccaaaaaaccaaaaaactgctgggctcaagcgatcctctcacctcggcctcccaaagtgctgggattataggtgtgagccactgcacccagcctatttagggcaaattttaaatgtcaagttatcttacatctgctcaccacccaccctatttttgagttaccttcttcattccagcagatgatgtcataagtctgtcagtcaacaaacatctgagttcatactatgtgccaggcattgagccaggcattaacaaataggcatttaataagtgcttgaataattaaaacaaatttaaaataatatttaactagtgctttccaacttgcctgatcattagaatgacctgtggcactagttaaaaatccaaatttcactccctagtagtctagtggctaggatttaaaaaaaaaattattattatttttttaattcagctctgcagccaggcatggtggctcacgcctgtaatcccagcactttgggagaccaaggtgggcagatcccctgaggtcaggagttcaagaccagcctggccaacatggtgaaaccccgtctctactaaaaatacaaaaactagccaggcgtggtggtgcctgcctgtaatcccagcaactcgggaggttgaggcaggagaactgcttgaacctgggaggcagaggttgcagtgagccaagatcacactactgcactccagcctggaggacagagtgagactgtctcaggaaaaaaaaaaaaaaaaaaaaaattcagatctgcagacttcactccgcaaatcccaaaaccactgattcacattcctagattttaggatgggcctgaaattctattcttaacaagccttcaaattaattctcatgatatggcaagtttgggaaatactgacctaatccaaatagatttagaaaggtaagacctggtctccaaatatcaggttgccttttgaactgaaattttttttttttttttttttttgcatctccaatgatatttgcctttcctctgtggttaccaatgcttagcagagaaagtctgtttggttgagtcgaataatgtaaaccttaaaattataccggaattgcgatctcctgggctttctgaggatgggattgcttttccataattgctaattaccagattgcaattgttgattaattaatgatgtgatcagaaatcagcacttcttagcaggcatttttctgattagcatgtatttgatggttcccccaagcaacagggaaaagagtttccagaaaaaagagaagctcacaggcttgggacacccccaaaataccgtcagaatgctttctggtaggccggacagggtggaacaaaacgttgtagcagactttgaccatttagtatttatttatttcatttttatttttatttttatttttgagatggagtcttgctttgtcacccaggctggagtgcagtggcatgatctcggctcactgcagcctctgcctcctgggtttcagcaattctcttccccgagcctcccgggtagctgggattacaggtgtgcaccaccacgcctggttaatttttttttttttttttttttgtatttttagagacagggtttcaccatgttggccaggctggtctcgaactcctgacttcaggtgatccacccacctccgcctcccaaaatgctaggattataggcatgagccaccgcacctggccccatttactatttataaagaccctgagcattctagaatctgggtgcagtagacaagtatccagtgactttatttgtaagacgaaatgcagacaccgggagcttttggaaaacacgtggcataacacagtggaaaagagtgaaactggtgtaagacgttctcacaaacgaccttccatttccttaggctctggcctgccagctgctttcccttgctgtattcccgccacctcccacccacacaccctcacagagacccctacatgcatacacgcagaggaacacactcacacacacccctctatcaggttgaaccatatgaaattgcttttttgccgggaggagagatgtagtcttgctgtgttgcccaggctggagtgcagtggctcaatctcggctcactgcaacctctgcctccctggttcaagtaatgcttctgtttcagcctcctgagtagctgggactacaggcgcactgccacacccagctaatttctgtttttgtattttagtagagacagggttttgccacgttgcccaggctggtctcaaactccccacctcaggcaatccgcccgcctcggcctcctaaagggctaggattacaggggtaagccaccgcgcccggcctgaaattgctattcttataggtcacaacagacaaatatcagcagcttcacgtggttcagcctcatatctatgtgtatacatgcacacccacccatgtgcttacgtaaacgcgcccatacacacctacaaacatatatacacttgtgcacacattcacacgtgcaggaaaattctctggtgcccttctccatggctgtgctagtgaacaactaatctggcccctcctgtgtccctccgcaccccacccaccttgcctccttcctagacactaacctccggtgctgatccccacccctacaggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaaccagtctgacaaggcagtttctctctttcaccctgtcccttgacactctaaattctgcgatgttgggaccttctttgttttttggactctagtaccctcaaagagctctagggactccactaacagctcctcttttccatggtttattgatgtacttgggaagctttcaattccttctctaggtgtctccttctccttctccttctcctcctcctcctcctcctttctcctcctcctcctcttctcccccttctcctcctcctcctccttcttcttgacagaatttctcagatcttggctcaggctggagtgcagtggtacgatctccgctcactgcaacctccgactcccaggttcaagagaccctcttgcttcagcctccctagcagctgagactacaggcacgcaccactatgcccagctaatttttttatttttagtagagacaaggtttcaccatgttggtcaggctggtctcgaactcctggcctgaagtgatccacccgcctgggcctccaaagtgctgggattacaggcatgagtcaccatgcccagcctaggtgtcttctggattgccctcccatgctcccctcacggtgacctcccaccttccattcttcactgctttctagaccatgagcaggttgtcccctagtccgggagaaggcccagtgcaggatggcctcacctggtgaggtggtaagtcaggttgaccttctcgtctcccactcatgactccactcacccagccaactggctccatcctgacagccaagtctccggatgctgcaaccaggccctgtgccaggctgcccttcacatggaaggcggtgtcttcctaatgctctcaaggggcaacatgcagcttgggtccacagggacttctctgccagtggtgtacgtgtcctgctgaagactccacctcccttagaaggcggtgatacagagcacaggacttgtcctgtccccgcagggctccgcaggctgccatttgagcactttgagggctcagggaacacagggtcatcttcagtttggcagagcctgaaaccagcatgctccacccccctgctcttcagagatccccaggccaagtgcctgctggcctgcctgacacagccttacccacaccactgcccacgagcaaagcctgcagcagggcctggccacacacaacccctgctgagccagctggagacaaaagcaacggagatcattgtgccaggcgcccacctgattgagctccttcagtagccaccctcagtctcatccatttgtcctttagagggacagcctctgcctgctgcctccccggtggcatccctcatggggtgacagaagggaggagaagtcctgcttccctgtgtcagtgccccctgaacccgctggccaaccactctggccggtttgaggccaagtttcaactctagacctcccctgtgtgtgtctctcctgcccctctcagatgatgccagtgttgggctattgtgattattaaatgccatagaagtttggatgagctgcatcccagcaggtggtggggtcacagccccttgggaggagtccaacccaacagcctctgatggcacattgcaatctttggggctctcaccagagaagctggtgcccatgggagcctaggatgtggacactgggctgagccccgtaattcagagcctgggaagacagcccagaagaccttccctgagtgctggcatttctcccagcacagaatcttgcattgtaacctttggtctcccaacgaaacgtggcaaaacaggctcccctttcagtgcagagcctccatgtggactgggcagatgtgtcatgaggaggagctttcttaatttccttcagaacctggattttggtagctaacgctctgtctagctctttcccacccctctgttaacgagaagagcaaagaagccgatcttcacttcagatgttgcagtcataaaatataattcatttttctttcataattattattttttctttttttgagacacggtctcactctgtcacccaggctggagtgcagtggtgcaatcatggctcactgcagccttgactacccacactcaagcgatcctcccacctcagcttcccaaggtgttgggattacaggcatgagccattgcacctggccttctttcacgatctaaagacgtagaactttgagtccagctttctttgctactatctctgccagggcctggcctcttgtgggcaggctttctttgaatcagagattttcatctccacccatgctctagcactgtgattttccccagaaacccccacagaaggcacatgacttctgccggcatcttctgaatgacattcagggccagaactagaaaagcagagttcacgtgcacggttcccatctctcagcaaggacttctcttcccctttcattctctactttctactgaccccaggcagttccacttctcctgtctagtcagcccggtagaggtagcaggtagctgagcctggagctggtgccaaggctgacttcatgtccatgcaggcaaattggagaggcagccatgaatagaaatttgaacatccgtagctttaaccttggatgtttcaccaaccaggttctgtcccagccttctacccatgacagggatggctccctcaggctggtgggccacttgacccacactcaaacgccttctacccaggcaggcactgtgaaagcatgggacccactggatgtagggcaattgggagtggtggagaatgtggcaaactaaggagagtgtgcagctgtctgtcgttcagttctctcccatggtgccatgtgggaatttaggcctgggcttgccatgtcttccagtttgtcaagaaaagccaaaatcagaatttctacatgaaatctctcaattctttttttcttcccttccctttcttcctccctccctccctccttccttcccttcctccctccctccttccctccctcccttccttctttctttttttctttctttcttccttccttcctttttttcctttcttattcctttcttcctttctttcctcctttcttttttctttctttctttctttctttctttctttctttctttctctctttctctcttcttttcttcttttctttctttcttttctgacaaggtctcactctgtggcccaggctggagtgcagagctgctgtcatagctcactgcagcctcgacctcctgggctcaagcaatccttccacctcagcctcccaagtagctgggactacaggggcatgccaccacacccagctatttttttatttttgtttttttcatttttctgtagcgaggggatctcattatattgcccagactgatcttgaactcttggcctcaagccatcctctcatttcagcctcccaaaatgttgggattacaggcatgagccaccacatccagcccatgtgtctaaataaaatacttaaaacattataaatcaagcttacaagttgttaacaaaacacattcttttcttcttccttgacaaggatactttcatcacaacctaaaaggccaagtttgaactcagaattcttagacacttcaaaattttatattagcacaaggtagtgagaaagaagcagtacccggactgcagcttgccgctttcttgccctcccctggttcttcctgtaccacagcagcctccagttcatgccggcggacatgccagcctggaagaccaaattccgtccacattcacccccacaggacccatcccttgggtccagagatgcacataccagtggtctggtccacactcgggaagaagtatccagggaagaggcttcagctcctggaagccagcccagggccagttactaaggggattctggtgtccttggaatgttgggcacagtctaaagggggacacagggttctaggtaggtgtctccttagttctaaggactttttgccccaacaagaggagcgtagcaggaggaatggcagtgctagtccctgcattgtcgggagttcagagcagagacgtcttttgtccaggtctgaaggtggcactgcagagacctgcccatttgcaactctgatctaggtcagcaatatctcctggaaaagcccaggctacaggaaggccctgtgtagcaagaaatggacacaagacagcgtcgtcaacatctgtcacattgaaatgcgggttcctggagaatgttagtttccccacctgccatcctctgcatttatctcttactagcagtgtcattccctgagtgagtgtcagagcaaattacgagaaagccagatcttcagtcctcaggatgagaagtgtgggtggggagagaaagggaggcaaagtcaactcaaaggtcacgaagttgccgtctgctggaccaaaacttaccagcagtttattaatacctccagccgatgttacagttgtggctttacggggaaggaggtgagactactggatgccccacttctcttggggacagataggctatctctatttctcttccttcttccccacgggttcagtgctccaaagctgcttgggaattccaagggggagaaagggctagtgaactaagatcaacaccaacgtagtaaagatttaatactcttgtttctgccagaggagactgtcattttaagagacacctaggagctcaaggctatagtgagctatgattgcatcactgcactccaacctgggcaacaaagcgagatgcaaaaccctgtctctaaaacaaaaaagagagatgcctagagaaagtaacacttgacccaaaggaaagagtttttatggtagcattttaggctttgtagcaagtgagcagaggagatatttaatggaattcttgccatgggaatgacatgtgactgcattggcctcatgtagataccagaggagtgggagatggggatgggagggaaagagagatgtagcccttctaaaactcttgtgggtttgtgtgtgtgtgtgtgtgtgtgttttttttttgactgagtcccactctgttgcccaagctggagtgcagtggtgcgatctcggctcactgcaacctccaccgcccggattcaagcaattctcctgtctcagcctcctgagttgctgggattacaagcatgcgccaccacgcccagataattttttttttttttttttttttttttttttgtggagatggtgtttcaccatattggttaggctggtcttgaaaaatcttgttttttaaccacctgatatgtgatttaatttaatcacttataggaagataaaataaaaacctgatcctggtttgaacaatctactggtaggtagagatgaagagcccccttttagaggacttcaataggaaaatttgcacaaatacctttgctacccaggaggtttctttggcttcctctggaagattcctgtagacagattgctgagtttgtcattacacctagaaaccaaggctaggaggggtagctgagactgataattgccctcccaaagctattcttccatttttccttactacggaactcttgttttgtctaagatggcaatatgcctagagaaaagattacatatcccagattcctttgatgtttgggatggccatatggcacagttctggccaaagagatatgcaagaatttgctaggtaagacttttatgggaaagctcttcaaaaggtggggctgtctcagttggcacatgcctttctcctcctttctgtctggaaggcagatatggtgttagaggtgaagcaaccgtgtacacaaaggaggaagagattctgcgtccctggtaatactgcagaagtgtgaagatgatagaagctccagctggcccacctctagacggcttctaagtgaaagtggaaaagagtttatttggttacatcaccttgagttgggttttctaagtgcagcttaactcaattctgtctaatgcaggagccaatggaacaaccaaataaggaatttaaacaattcccctagctcagtggttcctaactgggggtgatcctccccattccccaagatatttgacaatgtctggagatatttttagttgttacagcttgggagagaggtactagtaacatctagtgggaagaggccagaaatgttgttgctaagcatgctgcaatgcacagggcacaccccacaaacaataatccagcccaaaacatcagtagtacagaggtggagcacccctgcagctggccctagtgcttctagggcaccagcccatcaggccaccaacctaccctgacacgcttgtccatccctctctcagaaacaaaccctgtgtattgaccaggctgaaaaagccacgtccttcaccgtatctggcactttcctctctctaagcctttgctcatgcatcatttcctctgcctagaatctccctctcatcttttcaggtggggaccatgactcttcattttttttttttttttttttgagatggagtcttgctcttgtcacccaggctgcagtgccgtgacgcaatcttggctctcggctcactgcaacctacacttcacaggttcaagtaattctcctgcctcagtctcctgagtagttgggactacaggtgtctgccaccacacccagctttgctttgtgttgggaacattcaaaatcctctcttctagctatttgaaaacatacaataagttattgttaactgtagtcacccatcagtgctaagacactaggacttattcctctcatttagctgtaatttggtattctttaaccatcctctcattatttcgccctcatctctgccctgcctttccagcctctagtaaccactattccacactttacttctatgagttcaacttctttagcttctgcatgtgagtgagaacatgtggtgtttatctttctgtgtctggcttatttcacttaacataatgtcctccaggctcatctatgttgctgcaaatgacaggatttcattcttttttatggctaaataatatcgcattgtgtatatgtaccacattttatctgttcatctgttggtggatgcttgggttgattccatatagtactttgcattgttgctttttaatgtgcatagaagataaggaatacaggagtaaaagagtttggaggcaaaaactcaaactgtgtttttcctctgctctcacaccactctgcaatcaacacagatgacttctgtgaccaaatgtggggagttttccccatacaccgagcaagcaatcagttctgcagcagacaccagctgagtatcctccaattcagttctgaccctgtctgcctggagatagcatcagctcctacaggttgagagctcaatcccacaagactccaaccaacttcagatgccagtcgcaagtccaggcatccagaacttctggccactggcttcaagttaggttcccacgaccctctctttggattggacaaatgtgctagaatggctcaaagaactcagggaaacacttacatttactggcttattataaaggatattgcaagggatacggatgagatgcatagggtgaggtacgggggaggggtgcagagcttccattccctccttgggtgtgtcatcctccaggaatcttcttgtgttcagctattcagaaactccccaaaccatgtcctcttgagctttttatggagacttcattggagagccatgattgacaatcatgtagaaatgcaactggacaaaaagggtccaattacatgatctagtatgagtcacatgatctaatactaacaggctaagcagagaaacccagcaagacctgtctgtgcagattctttttggcctctctgtgtagcattccttccttcagggtatgcagcaggactgcttctgaagtgagggtcttatgaccacaatcagaaaaggggaggaagattagggtcctgctttgcactagggaaagaagggcagagaaaagtcagagataaattttgttttttaaggcctgcctctgaggactgaagtgcccaacattattaaaaaaaaaaaaaaagactgtaacaaggtgttatatcacagagataaataagacctctgtgttatccaaacccaagattggctgtactcttcttttgcttaaaaaacatatatatttaaattaataaagcttggcaaatatagagtatagacactgaagtttggaggcctacaagcattcatgaaatttcatcttttcattttctcaataaagcatctctctcaatccatttgtgttgctataagaaaatacctgagattgggcaatttatacataaaaaagatttatttggctctatggttctgctgtctggaaaaaatcgggcacccggtgagggcctcagggtgcttccacttgtggtggaggtgaaggggagcatgtgtgtgcagagatcacacagtgagagaggaagcaagaaagagcaagatggaaggggctgggctctttttaacaatcaactcttgtgggaactaatagagtgagaactcactcaacccccaccccagggagaacattaatctattcatgaggggtctaccccatgatcaaaactcctcccattagcatcccacctctgagtttgggatcaaatttcaacatgaggtttggtggggtaaacatccaagctatagcagcatccatgtgtggaaagttaagagcatctttttttttttttttttttgagacatggtcttgttctgtcacccaagctaaagtgcatggctcactgcagcctcaaactcctgggctcaagcaatcctaccacctcaacctcctgaatagctgggactaccagtgagtgccaccatgcctggctaattttgtgtgtgtgtgtgtgtgtgtgtgtgtgtgtgtgttttcaatagagatagggtttcaccatgttgctcagtcttgtcttgaactcctggactcaagtgatccacctgccttggcctcccaaagtgctgggattgcaggtgtgagtcactgcacccagccaaaagcatcttatcttctttctctatcttgtggcatgtgaagatactgatactaaactttgccaatcatctttcaacttgcagccatacacataggtacccattcctagggatcagctcttcatatctgggccatgggagctgtgaaattagattgcgagtcacattagcaccacgtcaatcctctccaccccaaccaccattagcacatcttctctaagtgaagtcagcattattcacataaaatgttatccattgactactggtgcacagtgtgattggggtttatgagttactcggggtgattatatgatgaagactcaattcttagtgggggcgctggagaccttgcaccctctgtcccccagctcacttcatatcaccctcttttcctctgcactggcatctgtcccttccccaaatctctgcgtgctccctccagcccaagagccttgctcattctgctcagccctaactgaaatgctcttacccttctagctcattcattcctaccttttgtcaaataccagcttggggaaattttgcttgattcccaggctagatcagaactgcaatttcaaatagtttcatagcacctcatgcccttcctttatacccattaacacagactgaaaatttacatttatctatgtggttatttggttaacatttgtctctgtgactggaccatccattctataatgtcagggattgccaatgttttgctcaccattgtattctcagctccttgcacagtagcaaagagcctaccacagagtagaaattcaataaatattcattggctgaatgaataaatggatggatggatggaacacagtgcctgccttctaggaatgtaaaatccaagccaattattattctgacgatggaatacaaatgacaaaataaatattcagttaacatataaaaagtaagaatcaatcagatattttaagagcaggaatcaagggaaggcatgtattcttgtgaagatg

SEQ ID NO: 999 - DNA, 925 bp, Homo sapiens
caagagagagagagaggtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcggcagggaacggttatttttctaaataaa

SEQ ID NO: 1000 - DNA, 378 bp, Homo sapiens
atgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctga

SEQ ID NO: 1001 - DNA, 37672 bp, Mus musculus
  misc_feature (28188)..(28207): "n" at positions 28188 thru 28207 can be any base
  misc_feature (35262)..(35689): "n" at positinos 35262 thru 35689 can be any base
atgctcatcatccttgagggcacacctcccttgcttttgccctctgaatcacagccttgtcctccttcagcatgtcctatctttccatattttacacctctatccaggctggtttttgcaaatttgcctgcctaaaattccagtcgagctgtatcacttgtaaggataaactactaatatatatgccttgcctgttctctttcactcatgaatgaacagtcctcacactcctatccccctaatatctaacagagatgcagctcccaaactctacagcctgaatcccagagcctgagctagcccacgaatgcatccaatccctgtggtgcagaagaacccatgctctgtccaaatcaatcacctaaacggtttagaatttctctgtggtcttctctttccagtgcctaggtctccacccctacctctgactgttttttcttctactagcatcccctgtcatactcttaagatttctcaaccattctagtcgtaacctagcctgttcttttccttcatgtcttatattgaaattctgtgactctgaggttcagaacagaagtcttcttgctggggttgcctatggttctctcaatcatttccactccttccctacttggtactttcccagagaatgataccttttgggcagtgagtgatatatacccagtactaagctgagtcactgtcagcatactcttttaggcaaccctgggtcttggccatgcctcattgccttttcctgtgcctcacaggagatagaataaatcacaggactttggagaacgtcacagtggtccatgcagttgacccttgtagcttgagctttgggtctcagagtgccagagcaagggaagatagagcacaaagatgtggagatgtggagtcacagcaacagtgtcaccaattctagaactatagttgcaagcactacctctgctgaaggcagttgaatacgagacaacatatcattggcctttggagcaatgctcaacaccacccacggcaggacactttgcagagcagggacatggagaagcagagaggtgttcgctggacttgggaaggatgcctcgtagcacaaaagagaaaggaagagtgtatgaagggcaggctggatcttccaacacaagagtaggggcaccagcttacttgtcttttaaaggcctgccagcacagtgagtccacatgccctggaaagtcatgtttcttcttaggttatattgtggcatgctgggatgctttctcctgctgggcagatggaaaagacagtagatggttctccttgtaatttttaagtttcatctgatgttgaattaccccccaccccccaggatgcctgagttctactcaataaaggaggggctaatttaaaacatattaaaagtcaacacattaagtttccaacgttctgtgtagctcattccctctaagcatgcctatctgcaacccagaagaatccattgttttgcatctgaacacactatcagggactacagtgcaccatgactgttctaggtctagcagagtgtatctggtgaagaagtctgctaagaatactcgctgctggccctcaggggcttttcttctgtgtggactggtttcttttatgctcagtggattatatcaaataagaacaatatattctgtaatcacaagtagtcaagcctgtgtacttatgcagaggaaactgcctttggatcatgagtttgtaaagagttgagggagaggcacagtgtttagatcagaaggtgatctccagatgacgttttacatagccctggttagtctgagctgaggaggggccaggtttccttcagtcgtgctgaagacttcaaaggctgggcaaagagacctttataagaagatgcttctcaaggcacatgagagaaatagtacaaggagacccggaaggtagagaaagaggaaaggagaacagactggctcacatgctcagaagtgaggacgactccatctcacaggggagtgcagggcatttctgaacaagtttgtgcaattcatactccttgtggtggctacctgatatgaaacaacaacacattttatataaaataatctaaatcacatgttcctttagagattgccaaaatgttttgtatactgtcgaaaactaaaaattgaatgtccacaacatgacctatgttcatgcctacaactccattagtactttcactcagtctttaacgttttgtatactgtaaaaactgttcctaaaatttgaatgcccccaacatgagctctgcccgtgcccatagcaccattaacactgccactctgtctttccagaattccaaagcttgagacagaatgcctgaggaacatcaaaatgcaaagcttgatgagtacctggccttcctctgtagtagctttaagggagacaaaacaagcaccctttgatggactccataattgttttacttactcttggaccatggaaacaaactacagatggggccatgggaacaaaccacagatggggcctgaaacctcctctgagaagggacaagtggaaaaggagacaccagatgctcgaatatcacattagtttctctgtgaaagaaggtggtcaatgtgggttgcaggtagggcaagggcattggtaattgtgaaccatgaggtataaaaccaaggggacataatacttctaagcctgacttcgtctacttggctgggcttctcaaggaccaagatgagtctgaggagaggaacaaatggaggtagacaaggggatcccatcctggggggtcaaccaagggaggttacatcagcaggccaaagcctagaaacacaggacagtctctaagtgtggggtcaggctgtcctcaatcccaactggtttcattgccatctgggcaagtccaggtgacctccctgatgccaccatatccttttctgaaataagaccatcgtcctgcctcacttccctacctgttcataataagaagtgattgagaaaactgtagtctggtacagtacaacttctctttggagtagcagacatgaagcccattgtctgcaggctgccactgagctgagggctgggctaacctgggattttcctctaccgtgcccagcctggaggagttcagtacttctaacagagttctactcataggtggtttctcatatggtagttcctttgccctctctgactagcctcatgcctgtgtctactgtggagagtatctgccaaaatctcagggaggtgcaatgatctcacccaagtcatatgtcatttgctgacactcactggcttattgcattatggataaaagcacacgagacacgcatgcatcaaaacattgtacagctccccagtagtacacacaattgttatgtgtggggcttttttaatcacctaaaagataagtttaaaatgaaaaacgttgatcccctaatgtgggaaagagcttgtgtctatttgaatgacatgagagctaagactgctttggatcagaaaccacatcctttgcctctctctctgcctcagcagaaccaaagaagctcaagagacccgtttctgtgtgctcacggtcatcagatacaagcaacgaaagttctaatgcaactgtgaaagtttctctttttgtcccttgttgtaggataatctgcattaacaaactgtcaagatgttgaaaaggagatgtgggggagaaggggagtgagacaggacagggaggggaagcaagcaggtgaactctacacagaaaataagaaaggtagaaattccctgcactgcactgccctgtgtggatgcactgtcctgcatggatgcaggagaaacagcccaggtggccctggggatgaagggctcttcctttgcctgcagagggaactgccattcccaggggccctcagctctttctatgatgaaaaggatagtaaggctttccttctgcaagtcaccagtgctcagattatctgcacctctcccatcccatcctctggctgtccagagagcaacaggcagggtcaagggactagatggcctggcttaggctgtgctgtgcatagtagaggcctctacaaaaaggactaacagtacagatgtctccaaattaccttagttagactttatatctttaaaaaaaactataatggcatgaaaatgatacacatccattaaaattatccttcaaattctgaagacaggcagttattgttcatacaatgcagagggccatggggacccacttggagacccttagttcttgtttggcagtgttgatgggcaactctaaaggtaagtatggaatcttttgaacaagggcttgatggacagcaattcaggttcatcatggcaaaaagcttgttttgtgatgtccttggttgagcaaagggagaggcaatctactagcccacttttcatggtctccttaaatgcctgaaacaagagagagagagagagagagagagagagagagagagagagagagagagagagagggagagagggagagaaagagggaggagagaggggggagagagagagaaaacacaaatatttatgttctatgaagctactttgtctaagatctatatgtatatctgggtgctgtgatttgaatatcatataaatgtatatatgatattcaaatcatatatacatatatatttatatatgtatatacgtatatgcatgtatgcatatatgtgtgtatatatgtgtatatgtatgtatgtgtatatgtgtacatgtgtacagtgtgcatgtgtgcatgtgtgcatgtgtgcatgtgtgcatgtgtacatgtgtatatatgtatatatgtatatgggctgggagcatgatgcttacaactactgaagaggttgttttgctgaatcatagcatgacacaggacactgtgtggtgatacaaaacaagcagctagctaaagcctttctttttgataatgcctcttctactaagaagcttgcttaggactccagccaattctaaagaccccacccctaccaaatgcattttcactgaggaattaaattgctaacccacaactctgagggaggaaacattcaaactacagtatctgataaacatttgatcctcagacaaaagagtttcacatattacttggagcatacttaaactgtacaattatacccattttatcagaaaaaaaaatccaaatataattctgaattacacgcttttatgtaccacaactggcaaacctgctccaggcatagaggtaggcaggatgcctaagggcgcggcccctggaaggtgtaacagaagtggatcaaagcagaacaaggcacagactttggaggacactatctcatgatagccagatttgtttcgagagagtgatagctcaagccttttggatataagacactcaacccatcatgtgagcctccaactctgagtcacacttcctctgtaagagtctgggaagtagattccccacggtaccatttcctaatttctgcacctggatcttcccacacccatcatttggcctcaaggcctcttccttaccgttctgtttccacctgcctgctctgtgtgagaacgtgtctctctctgtggactcctcccaggactcctggtcattcctctctgtctgacacggccaaccacagccagataattcctctttggctggggctttcatctcctaacagtggatgtgtgtcctggcgctgtgaataactgataattgcctgcacaataagccagtgtatgtttcttcctgaatcctttctctttgactgtgatcaagcatgtgccagactaaccgctcctgagtagcccataggaacaagaaggcactcacaccccgagcctcaggttgaccataagcaatgcaactttccctgagacataatctctaccgccccgtgtgccccagcatcactcctgtgttttacagtgttctgctgaaaagaaacatagcagatacagtttagaataatccagagccaagccacgttgccaatgggtgaaatgagacagtgccatttgcctttcacctcttgcttcagttttcgaaaaattgtccccagtgattacagagtatttgcatttttgttggcttgggaacgggaattggcagcatcaagtgtttccttgcttagagccacgtcactatttacgtagcaaacattacaagtcagagaacggagcattacagggaaacttcttagaatgctcacaatcaaaggagacaaaaagggaacagttggttgtttataaacatgacgaaggaagaaagggacaatgttgctctagagtcacagactttgtgactccttattacatgattgatgaaaatgacaagtctcatcttctataggattgaatgtggtttttttttctaccatatgcattgactcctggtattaaatgtgttcccaacaacttctcctcaatggctgatgatctggggatgtttgatactggaattgtctgaagtcacaaaacacttagaggatttttgcaatttcagttaaggtatattcgggaccttatataaaataaatagttgtattgttgcccacaaatacatcactttactaataatgttcagtttagctcttgggatccatgcccagctttttcacatggatgctgagaatttgaactcaggtctttatgcttgcagagtaagcactcttaccaactaagccatctccccatacccctgactttaacccaaagtggagcaaatagatgcatgcatgggtaagacaggttcacaaaagcttacttcttgggcaagtcacagtgatggctagtggcctctctggatctctcttcttatgtgcacaattggactaaaatgcgttgccctgaacaccatacaggtacatttgaagggtgcatatcattatgtctgtgacagttcccaagggctaatgtaggatatacgtaatcatagtctaagtgggtgagcacttgcgatgcacataattttgttgtcagagcactgcagaaagcagggtcaccgccactcttgaacgtgggaaagtgaactcaccacccacgccttcacccctgtgaactctagacacctcctctcgtccatgtatcatgaagtggttgtcagggctcacagtgggcgttagtccatgcacctggaatcaaagcatcagaggttttgtcttcgttttaaatcagaggcaatgcattaaaacaacaaagtttttttctttcctgttttattttttaatgttttataaaataatttttcccaaagatagaattttacttaaaaacaaaacaaaacaaaacaaaaacaaatgtagttctcattttaaaagagtgaggtcatcagaaaatacatttatccaaaacaaggtctccgtctcttggaagagagagtactgggaattgaacccagtgccttccacacacaagacaagcattctactgccacggtacaccctaggctgaataatgtctttctgagtatctaacactgactggctctataaaccacttgttcttacttgtgaatgtataattttaaaaggtcaattctcaaaatactgagctgcagtctagcttttcttaccgtctttttatgggaagtatgaatgaaaagtttgccccattcagacctcgatcactgctcagtggctccttagcccaataacattagtaatctcctcggggagtatggagctctgcctttgggacggatgctcaattcactaatttcctgtgacatttttcaaacaacagtccgccatctcactgtgacatgtatcgattttcttaagtgtcagtgcgaaagaggatgggaaattgcctactggcaaaattgtccccattctttcaagtctgactgtgatttaagaagttcttagtggtcagctagaagggcccacctggccattccttcctctccaccagcaacaatgggagcatgtgattcacaagggaatcacattcaactaaaaagagaaaccggggtatgctgtttgcaaggaacggttgaaactggaactcaatatgtcgtgtggtgtgaaataaatgtgtgtctcacatgttttcccatgctgggggcaggggtaagaaagtaaaaggcagactggttaaagacatggggtggggagggctggagggacgagtggtaagaaatggcgacagaggagatgaaggtaatgtcataatgaaacccatcactgctgtgtgcaactaatagatgctaataaaataggaagttttaatgatttaggtagcttattgcttgcattcacctcactgttaaactatcacttctgggggatccacacaacgagcgagcgagtaaaccagaagatggcgttgaagattagtaatcatatcttttaaacaagataaccatgtgaagtctcaaaaggtttcttgtaatgactgttgtttaaacttctgaaaacagaggatgtagattggctgaggaaaatgttgaaaccgcctaagtcaaggtagaagacacgtgtgtctaagtgaaaaaaagaaaaaagaaaaaaaaaaaaaaccaaaaacctcgggttggctgcttctgtccttagtctgtgcacgctttgaagaaatgtaattcctcagcagcaaggctgtgctatctgaagctacaatctctgctttgctccgaggtgtgtctctggtgaccgggatagttcccgacagacagaaggtgttcaaagaatatttttgaatgaatgaaaccccaaaggaagaagaggggaaaatgggtgtgaccaaaattttctttgaacgaaactctgttgtttactaccagggctctgacaatggaaaactaattggggtgaaagaacgacatggcatcctgttaatttctgagaaagcctgttgatgttaggaaaaaaaaacatgccggtgggcatctctgcaccagttttcctgtggccaaaatcagatgtttctcctaaagtccagaacccaggatggaagattaaaagaaaaactgagaaacatgtgaaatgaaaaagttgtcaaatctttacaaacgctccaagttgacctgtggtggtggtaatctaaaatgatacagaaactggtagtctgcttgcttacctgaaaacaccaagataacatataagctccaggcatccaagctgagctggagaaagtcagcggcaaaagctcatggagtttacatatgaaggtcaaagaaaacacgaaaataaagtaaaaccttcagtcagcctagctgttctatttggggcattggtacctcaccggcaactgcctcccacgaggctgaggttaaaattatcattttaaggtgaattgacatccggaagcgcgctaactacctgagtactcagggatcccccatctcttttatgttgccatgattgaaactttggggactgtgcttgtctgagtcatctcaattcgtcggtttcattcacccaacatgtataagcgtttcaaacacagtatttgggccacggcttataaacttgcctttctatttttctttttagtgagcgtgatattctctaaacgctcagagagacaagactccgctttgcccaaggatgctcccgacctctctcagtctatctcttctgtcacatgctgtgagaaccaagttccctgtgctccagactctccatcacttcccaacctggccatgagcagttagtagttatcagctatgctcagtgcagattccagtatcccctttgcatgcctccaccttcacaggaacgggccataccgacttgtcccatccggttgaggatttctgagtacatcagagtccccagccccctccacaggaggagctgaagaaagccagggtttgtctgaagtgggacagcccttgacccggtgggctctagtccgaagctcctgttcctgcgggacacccaggcacaaggcagaggtggggggcggtcctgggtatgggcaagccacgccctctcaaggcggggccgaagcgcccgccctgcactccgcctccggctctataaagttcctctttctcacctcactttcctagtttcaccacttgaacttgggaccctttgctgccctcagctaagagtgcgggtgaggtaaggcctgtagtcgggcagaaggaggagtgtgaggctggtggcagaggaagcctggcttccatctctgagcctgagggagaatgctgagatagcggacccaggctccgctcatctacgctgccctaggacctgtgcacttcgggttttgtatgaagctgtttgggtgggagttccagaacatcccccacgggctgggcgggacgagctaatgggactgtggtgtcatcaaaggatcgcactggccacagcttgtcctcagagggacagcctctgactctctctgctccagtggaaagctcctttccagccctggttcctaaaggacccaaactcatctagggctccagagcgtgattcctaggccgggcagccaagaagagctgagagctccaaacttagggtgctcagagcccctttccccgcatgccccttcttcacttctctggcaagagtgctagtgttgctgtccgcagcaccccttattcccagcctcggcttcattcctgccagggttcacgctgacattctgcaggttggaatctcctgtttcttggctgcgctgcttgccccataaccagacttccacttgttgcttccaggacccacgtgatggtctctggttgggtaggcctggggttattccgaggacaaagtaagggtgtcatagaagaaagtcaagagagtaagctaggtaccgcaaacctgcatggcagggacacaggacctggacaagggctagtccatgtgccaggtccttttcgcctggggcagccagggcaacctaaacccaggaaggggcaagtgtagaaacagtgagggaaaagtgggatgaaagctacttggatccagcacagagggacgagtgagcaaagtgagcgccccagcgtggcgcaagacttgggatctgcagagaagctgtgtagctaggagctttcaacggagcgtgttaatgtaaatgtaaatgaagaaattacctaatttttttaataaaagaaagaacagacaggcaaaaaaaaaaggaggaggaggaggaggaggaggaggatggtgcgcgccaagggatgctctctataccttcgtcaaagtaccttctcttgggggacttcggaagactctggcactgcacccgagcaccttggcagcctcagagactcggggcctcgtgggcactgcaagagtttgggacggggcttcctcccgcctccaaagtgatgcgaaggtagttgcagggaatgtgtgtctctcctcagcgcacaagcccaggaggaggtccgcacgcgtcatgaacttggagacgggcagccggggctcagagttcggcatgagcgcagtgagctgcggcaatgggaaactccgacagtggttgatcgaccagatcgacagcggcaagtaccccgggctggtgtgggagaacgaggagaagagcgtcttccgcatcccgtggaaacacgcgggcaagcaggactacaatcgtgaggaggacgctgccctcttcaaggttagcagcattcagggatccctgggcaggggtgggggtggggatggggaatctgaaagctctgaatgtctgtggctcccgggcaagggactaagaggtgggctcctgcaaggaggaggccagagcatcaagcattggaccctgcttaggcaaagtccccaggagaagggaaagaggttgcaaactctccggggattgcatacacaagaaaccaggtcccaatactgtttgtgtggaggaaagaacttccagcttcaggggcatctctgggggaccgaggttccgtttgcatagcccattcgctgtttcctgccaccaccaccgactgctagggccactctctgcttccctgtctctctgtgttttgttatttttctgagtttctctctctgggttttgtttctttgattgggcacctctactgtctggttctagttctagaagctgcgatctctgattttctttctttgagtagctttgactattccgagtctttctctggtatccccctccgaccccgtgtgagtcccttaggactgatgtccccagagaactggctcactgaactgtgaagcccccagcctccacctgccagcaggccgaggaaggggacttcctgcgggaatttgttcaaagtacctctgtgattttgtagatgtcctctctggggcctgccccctccacagctctgtccccagtcttgcccacacttgattcaggcgctgggcgtgtacagcccatactaggggtctcaggaccccactaacatcatgttccacatttcaggcaacagcaaatttgaaacagtaaccttccttgctgaaatgcaatccatagaattcttttgacgctctgggcttgacttttcttctcatcgttcttaggcttgggcattgtttaaaggcaagttccgagaagggatcgacaagccagatcctcctacttggaagacaagattacgatgtgctctgaacaagagcaatgactttgaggaattggtcgagaggagccagctggatatctctgacccatacaaggtgtacaggattgttccagagggagccaaaaaaggtaaggggttttcccagcccaggtggcaggataaaggcattatggcactcagagagcccttcttcctagagacagtcacgtcctacctctgctgtaggttaagcccagatgtccttttgcccatgtcctctctgttataagtgacaaccctgtggtgttagtataggatgacctggcagactttaagccccatgggtgtgtgggttatgcacttgaaggcattattttcagttactccattcaattaggatctggatcaaatttccaaacaaaatctggaaaatccattaaatgtttacttacctaatatcctctagtaagcattttcaagaggagaaagcacatcccacaccccatacatattcacacttcttgtaataaaactgctagagtttctggtttaacatggcctgctagggtggttatgaatattcagatcttgagttccctctcttccaactagtctacctcaagcagtgctcaggaatctgcatttggttccaaccatacaggatgccttaactaggtaccatctcacaaccagaaaccacttggtggatcacagggatcctgggtggtgtttccttccctggctgtcactcacaagtcagcaaatgtttaatcagtttaatggcaaagacaaatatctctctaagaaattgcttgaaaaacaaacaaacaaacaaaacaaaacaaacctaaaatacccgattggttaatagggctatgcattctaagaattaagtgcataggtacttttataagatttaagtcagttccttgtcttactctgtgttctctcttccttttccccaaacacacaggagcaaagcagctcactttggatgacacacagatggccatgggccacccctaccccatgacagcaccttatggctctctgccagcccaggtatgtggtagactcttggtcttgtggaaggctggcccatgcccttttgactggctccacacagagaggcaaacacaaatgaaaagtgtagggctgacttcttatttgctatggctagtacacacgctgaacaaaaacttggtcagagaaggatgtttcagttccagtgtggtgtcactgtccctgacgccacagttttgttggggagtttgatgtgtcccacctgtggagagaggcttccactgatggtcagatcttctgggaatcagaccttttgtggaagtcaaaggttttggaagtagtactttatcatgtgaaaccgcagagcagctgacttctctaggcgtccctgatgtgaattacagtactgttttattcactttggtggcttaaaaagggcagatttcactgcggtattcttggtgccgtgttcagccatatgatgaagccttacaaaaatcacagctttatacaatgtcctcattgtgctttcagaccctctatggctgttttttacctagtgtgatagacagtccatgtcactttttgggcaaaatgacttggctgctggacaaaaaaaggggttccctgaggagtttgggtgatatgaaatgactccgacacccactgatgtcttcctcttagcaatccctgtgctctgtcagcaggttcataactacatgatgccaccccatgacaggagctggagggattatgcccctgaccagtcacacccagaaatcccatatcaatgtcctgtgacgtttggcccacgaggccaccactggcaaggcccatcttgtgaaaatggtaaggattgtgccagggcagcagacagaagaacaacctgagctcggggtgtggacagcaccacagggcttttccctaccattgagataccagagacacatcatatgaagctgctactgttgttgttgttgttgttgctgctgctgctgctggggtggtggggtggtggggtggtggggtggtggagtggtggtggtggtggtggttgtggggtgttggggtatgttgccttgtcctgtgaaatgttgaagtccttagatccatgataggcctcagtctgtgtggggacttaactagaagaccccagagatcattccaagtagctgaaaagtgccccatttttaatacatagagaaaaacatggatgacaacaaattctcaatgacagtaatgtcaattataaaactcgtctatattttgttttaactgagttatcccttatttccgatggtgattaagttggggggtttgttgtatcccacctatctccctagtctgtatctttctactctcctgtaaagtagagagttgtacccagtccacctcagcaggaaatcattgctagttcatgtctcttgaataataatgagtcatctatagctgttcttggtactaaggaaggaaggatcagagcgaaagtaatccacaaagtgtctctacaaatgagtgccctgcccgaaagacccacaggggtccccccatgctagctgggctctcacagaagaaacgcccactaaccagacacaaaaaaatttcacaaactatgttcagtgagacttgggtcctttagtgtttatttaggtgagtgcaccaagctccacctcgggtccttttttggctgtgtattttaaggtagagtcttgctaaattaccaaggctaggatcttcctgccttcaactcttgagtagctgggactacaatcttgttctaacgggctgaacataaaacaagtttttaggacttacaagttcactgtttaaatataagtcttgacatgggtcgccgtgcgagtagttcttttatattgttctggcaatactttccttgtgacaatttcatcaacaccctcactcagtctgtgcatgcttacactaatcttgctttagtgtgacataacttctctgctgccagagaacacggttcagcccctccccctagctaacaaacagtgagcagaataaatgagggttgaataattaattcatctttgaactagtcttatagaagtttgaactctgaccctgctggtaacttgctatgtgggctggtgcaagtccctctccttctgggcctcagtttccctatagatttggagtgagccccaggtttccatccagagctgtactgtggctccttccttcatcaccctaatttttatcactggatgtggactttggactttgtcccataatcacacgttatgctgctagcaggtgcttagaggctgtcaggcttgggttggaggccatggcctctcccaactcaagagcctccccgcactcagactcgatacttagacatcatctgatttttatttgcaaatgcaggttgccaggtgacaggaaccttttatgcttgtgccccacctgagtcccaggctcctggaatccccattgagccaagcataaggtctgctgaagccttggcgctctcaggtgagtgtggcgcttcctgtaaagctccgagggagggggcatctctcctctactgaggttgggtgaggatttagactctcgccttgcaggccccggggtctggagtaggcatggtccaggctatgtggacatcacgctgagtcaaatacactattagaaatctccacagcagtaccagctagccaaatactatttggacgatgtctttaaccttctacatcattacctgcccagttttccaggaatgtgtaaccaggctcctcctccagccgacattctccattctcgcagtgtggaaaggctttataggcacaaaagaatgctgtttgtccttttagggtgtagggttggccacaaacaggtggtctgagttgcttccaaggaacactggttctgaaccctggtctctgagaagttcttatgccccctaaaggatcatataggtctgactccctcacaactttgacagaattgctgagcatgtgtggatgtgatctgattttaaagttctgttactaaggaagcctgcacttggagatactgaccagcattttaaaagcccacactccgtggaagcagacatcttatgtccatttagtctttagatgatttttttggatgttttcaaatggaattattagaattctcatcatgccctcggctaccttaaaagcctctgactgaaaacatcaactgcattttgacaattttagacacttcccttgttctcgagggaggaagaagttttaaaatctagttccttccagctctgatgctcagggagactttgtgagccactcaagaacagccgaggagcacatctgggcatcagggtttgtcacagacactagaatgctctagatcctcttctggagcgccaaagacttgtgtgggtgccccaagagtaggaaataaacagctatttatatctctgcaatcttgtgattttggtgacattaaatgaaatgaaacctgccctaccactcacctcagatggccaacgccccctctctttgggtgcaccacttgtgctgttcatagctgcagctatcgaagacaccatgatgtgggctgtcagaacttgccattgaagaatacgaggcttttgtgggtttcttcttctagtttgcataattaattatcaaccctgagtgcacttttcagaaagctattctttccaggcattgttggggctccaaccaccagcacgggtatctatctctgcctggggagccctttgcacacccagcttgccctttcggcccgtgggtggtattttaaagtggcttctgaaatcaacaaaatcatgtgtcaataaattcctgtcttaaagctgtagaaaacctagttgttgggttcttttcagagttgaacacgaagcttagagggatttcagggggttttacattaaccactggcttttagagcagttctcatcaatttcttcccctactccaagagagctgacttaaaaataagaaaataaaggtatcattttccagagcccagaaattgttattttagtgcctgtctctaacatatctatgtgggttttgttgttgtttggttttacttaatgacatcatggtaacaccttagggaagttccagagctgaggacactatttgcttttcttctaagatgtttctgtatttcttttactaatagaaatctgtcccagaggtcaactccaaaatcaaaattgagttgctggaaaacgaattccaattcggtagtattatttcatattgtagacaaaatgccaccactgttaacaccatcatccgaaaagccctcataacaggggtgtgctttctaataaaatttggctgaaaattcaagaaatatatacctctccccaagagaagtaaatggccacaacaacatttgaaaatgatcgtgttagagagatcagtttctttccacaagcttctcttagtattctgtgcttgaggtctaagaatctacagggaataagagcagctaacatctccaagacttccttggtcctaggatctttcacttgttcgtggagcatcttgacactcaagtgttccacctgctgtccttcgtatcagtctagtcaccgagtttttggggctctgagcaaggtggcacctttttcaaatccatcagcactgactccagagttttgttcacagactgccggctgcatatctgcctgtattaccgggacatcctcgtgaaagagctgaccacgacgagccctgaaggctgccggatctcccacggacacacctatgatgttagcaacctggaccaggtcctgtttccctacccggacgacaatggacagaggaagaacattgagaagttgctgagccacctggagaggggactggtcctctggatggctccagatgggctttatgccaaaagactctgccagagtaggatctactgggatgggcccctggcactgtgcagcgatcggcccaacaagctagaaagagaccagacttgcaagctctttgacacacagcagtttctatcaggtaacacacctcacagtctgttagaatggaggtggtggtgggtgctggctataaaggtctcaaatggcagtgtctgcctaccccagacagaggtcttcctcctgagatctgtgagctcatgcagaaatagaattcctgcctgattcatgcctagcctttgtctgttgtgtactcccctgattagcagagggccagaaagaggatccatatttgctggccaggatagacactggtgtgggttgatctcttaatttatcatcattcttttcactctaggcttttgttttgtttgttttgtcagaatatatgtagctcaggctggcctagaactcctgcctcgggattttatctgtacaccagcacatctggccaatgaattaaaatgtgggctttcagcggcatgtgccccacccccagagaggtttcactgtgttggctctctgctctcagcaagtttatctgctgacacctcagctctttaggggtttctagaaaaatcaagaaggttagaaacaccatcttaacatttttggttatgagatgtgtcacccttataaaattgtcacacttgcgaggcaggaccaaagctgagaatgtaaggagcagattcagcgagggggaaattcggagaagaatttggtcttatctctggcatacgaaggcttctaatcatattttccagaacctgtacttcttatggtatgatttttgactttgggtagttacgttagaccagggctggcttatatgaagtcattagtcttgccactggtgggtaccacccagaggcctcccctagaaacgtagccgaggatgcctttaaggaagcaggctgctctgctgactgctaattgtcattccctcaccccatcatatcctaagcttgctttcttcccaatgcccttcccaagcagctcacagctctggctttcctgtgctttccttttcttgaaccgggacttgccttgctccttctcatccatgcacactgtgatgctttaaaatgcgtgcacactaggatctggctaaatccactaattagcatgcatatcaccttgcctgtctatctttttttaatttggtaagaacattacttgaaatctactctcgatatttttttaagcacatggtccattcattattagtcatgaggattggtccttgagcttgtgttcagcaaactcctcatgtcttagtgacagtttatattctttgacccacagcttcctagccacttcccacgtgtggtgaccgccatttggcgctacttttatgagctcaactattttggagttcgcaatgcaatggagcgtcacggtctttgtctttgtgtgcatgggtaatttcacttggcatgatgttctccaggctcatttgtgtcattactaatgacaggccttccttctttataaaggctagggatattccactggggtatctgtatcgtgtcactttctctttatctgtgtatcactgtgggtacttgggatgatgccttgtctaagcaggtctgacgggtaacgctgagtgggggagtatagctgtctctccaaaaccaatttgctctgccttggttacgttagaccagggctggcttctatgaagtcattagccttgggtctgcacacagaaggggactgctgagtcctcaatgtgctgcttccttctgttcatttacaaagaagacgacaagccctagtgtgcttggtactagtggtgtttcctcagccttttgagctccagtggccaatatttgtttaggctcatccaaatcctctttcgtttccaaaaacaaacatgctccttgctaaatatcctcccctgagaggtgggacacagaaaagagaatcatctcaggctccaaggtgtctcaggctccaaggcgtctctggctccaaggactgatgaagatccttggagctgggtgtgatctaagccttggtcagacagcctttgcctctcttagagtgagttctagtgtttgtggtccaaggcaaagaaaaataacttctggagatggataggtacacacatcctatatctgccctggggtctggaagtcctatgtgccctccagaaggctaccactcactccctgcttgattaaggtagctcagaatagtgacaattgccagcgacagggctttgaggtacactaagtcttggtgtgccaaagaggatccaatttggcaggaaacaaatgccaaaacagagcagacaccttggactagaaatttgcttcctaggacttattagttattaatgagtaagggctatttccctttgttcccttcttctctagtggggcctgttgtttttgctgtccacagtccccaagccccacagaggctcagggaagatgacattgctgcagagaggcccaacagcctcagaacctaaggatgcccacccaatggtccgggaagagcaggctgaggtgggctttctcagagagtcgcatcccttgctattctgacctagcccctcgtaggtgtcttcccggccacagtgctatgcactttatacagtgtgcctaaacccctgggtttgatttaaattctggaagaagaaagagaaagaaatgcaggaagtcagttctgtgagcttctagaagcagttcggttgcagagagcagtggaaatctttgatgtctacccattctggatttgcaccccactagggacagtccccataggcacagttgagaattcatatctgatcagggcagagtcttcatgcctgctctgtggaggcagctttttaatgtcagttctttgatgcagacaagacctgggaacctagctctgggaggaggaataaaggttaatgccagtgagtggatgtggctttctgcttgtgctgggggaggaagccaaggccttgcacatacaaggcaagtgctctgctccaagtggcgatgcccccagccatgggcaggtttcttttcagcaatcttgtctgtttcatgtctctcaggcaggactagcctcagcatgacatccttgtcagaggggcttcattggtccccttctccctgtatcatcctgtccccaaagtgagattgaagcctactctggttctccagttttggagttttagacctagtgccaagtaggacacagctgccaacagctggtgagagaaacagatgctcttggtgcccagacaccacgtggcctccatggttagctagtgaggttaaaaaaataaccctgggccatcagaacattgtgactctttacattaaaatgtctccttggcctgtgctgattgcttgactcagcatggctacttttctttttcttctttgtcttcttctctttgaccttgtgcatttctgtgagtgtagtgctgcagacccaagttcttaaggttgggtcatgttccttaagagtaatgaagtaaaaccagtgccaagtcaggagatcatatgtgaacttgaccatgtgattttgtgtctagggtctgctctaagggctggacttaggggaacagagcccgggctctcccaaagcagacttccacgtgactctggctttccgttcacccgctttaccaggtgtctgaacagtttggtttttttttttctttctttcttgtgggttttcagagctgcaagtgtttgctcaccatggccggccagcaccgagattccaggtgactctgtgctttggtgaggagtttccagaccctcagagacagaggaagctcatcacagctcatgtgagtacctggttacatcacccgtaaatcacacactgtggagctgtcccttttagagaagtggcaagtgacgagtaaatgtcagctcacctgggaaaatagatgtagaccttaaaatagtgcaggaggaagcaggctccagtgaacaccacagctcagggaggcacccgcaacctacttccagacaaattctgtcaccaccgaatcagcagggcagatgacttggacccaaggctctgtttgttctgtattctttattgtttcatacagacagttacctgcccttttataggaattttcaatagttgggaccaagtactgcccttcgacatctctgtttcttgtgtggttttaaagatgctgtcctttcgagtagagtagcactttctccctgggaggctgcctgttatgtattatgcttcatcgtgcctcctaacttcagatagttcccagaccctcgttttgttgctggactttagggagttatttaacagttggacaagggaggtggaggaggctgagtcttcccaggaatcaggtaggtcggtctatcctcacagctagggtttattcggataatgttcatcactcacttaataattaaaaggtaattctgaatacatgatgttttttaattagaaaattttacttaattacatatcttgaaaagtatgcagtgtggagtaaaggttgtgtcccagatagccacaatatctcagtgcaaatgggatattagctctgatgatatctcttagtggagactgaagactaggcatacagcgcaatggaaggcatttgctaggcagtggtaaagccctgggttctaaaccccgcctaggatgggggttgggcactgatgttgaacatccagcctcccttctcggttgcaaaaagtaaaatctaagaagcaacaaacgggctggagagatggctcagttgttaagagcacaggctgttcttccagaggtcctgagtttaattcctagaaaccacatgtgccttacaaccatctgcagtgagctctaatgccatcttctggtgtgtttgaagactgctacagtgaactcacatacatataaatcttaaaaaaataaaaggcaatgaaactatgatcctggccttgagccttttctcagttctaactggtggttgatatcaaatgagactgcagatgtgtggatgaatctagcatagataagcagtatttttttttttaaggtagtgagtaaattctagcatagatctcattttaaggactttgggtgcagtggggctccgcaaaaagggagcaacaatagtcatataggcaaagggcctcaaaatgctgccccgtggtccacagatggaaaacatacatggtcacccatgaactctgctggtctccttattacagacttaattcatatgggtgcttacagaggaatcctaccagacatcacatatcaaataacaaagaggcttgatttattgatgattggttgttacagagcacacagcctgacttggtgaggctggctttgactggggatgcaatcgatgcttataaacaaactaggtccatcagagccagcgagctgctgtcttgtggctggccagctctgtcttctacttgtggttcagagttctgtctatttcacagtcatctggttcttcaggatgagcccttctgtcagactcatgagcctcacttacccagcatgttacttagccttttaatttggtcatctcattcaataatgtccagttaactcattcgctaaatatcaaatccaagaggtgattggtttcaaaatgccatatttatcttctattatagaatcaagagttctttttccagggtttttaattccaggtattataagagcaaatgaaactggtttttcaaatggctctgaatgtgaactgcttcactgtgttatgttatcctgtgcagcttgtaggtttttacttagagtcctagggtcatttcatgatgtcccaattgtatggtgttgagaagaatattctagtgatgtctttttttcttaaatgtcttattaaaggtggaacctctgctagccagacaactgtattactttgctcaacaaaacactggacatttcctgaggggctacgagttacctgaacacgttaccactccagattaccaccgctccctccgtcattcttccatccaagagtgagaagaaatactctgacagggcagccggctgctgccctttctctttggaagagctaagaagtgagtgggtttccacttgaagacaacaacagggctttgtgaggaaaaacagctgtatctgctcaacagaggagcttcccccagaagagtgcctgtcatccaggtcttgacaagtgccaggacttgggtgactgtgccctggcttataactgtgaaacttgatcagtgttgtgtttacatgtacttgaatgctggctttagcctggtatagatggacttttgcttgaagactgaaaacctgtgccagcatgaatccctgacaagagaagacatacgtattattggtccatttctcagggaagtaaagtctagactagagactacgctgtccactcacagagaaacgcattcctggatagaggagctgtaggttgcccagatcatgtccactgagtgaagggacttggttcttaggtccagtctaggctatcatgtcctgatcctgcactctctctgagtagaccctacatcctgtttgctccctcttcttgcccttccctaaaagccagctggtggactcttgttgccacatacttgagccaaaaaaccatcagggacatataagatgagacatgtttgcatctcctctgatctaacaacggctacaaagttttttgttgttgttgtctcccctttctgttttgcctctcattctttagaattgttgcttttttgtaaagaaaggaagagagagagaccgaatatactagagatagatttttaaaattctgtgccatttccccttctatttgttttgttggccatcagtggtccccatggcaacactggaagggcggagcctttgagcaggttgggaactgtcccggacaccagtggttcagtgtacagctgtagactcagtgagctgtttctgcttattttgtatattagatgcttccttgtgccaataatagtttgacagagtctcaaagctaccgggcttcttttccaacaacacattctttcacagaatcccaaagagtctcacttgccttcacaaccgtctgatcctttattgttactgttttgtttaggtggctttgccatgctctgggatttttctcctaccacaacatcattcctgactctttcgggctcagaaagagttaagcgctcttgcacacttggcacttacttctttttaattttttttttaacatgccactcttaatatttcttcttaagtctttcagcagcatacattcaataagcaatggaccattgggtgtctcatttcattgttttatttttaaaaaggaacctttgacaaataatacacattacagaaaatggaagcatttttcatagagaaggtaagaactgaaatgcattttatgttcgaatcctccttgctagtattagccccaagagttcagtctgtcctttaagcatgttttagttttcaatacatatatatgaagttgccctttcttagagagagagagagagatatgtgatgacactcttatgtacccaactatacagatttacctcatcttttgagtggcatgtggacttccactgctatgtgcctaggtgcagtttagacatcttcttagctacccatcccagcagcccactgagtctcgtgaactaaagtcacttatacatcttatagatgcaaaacattctggggtatattatcccaagggaagatgaaggcaaaatcgggaagcactcttcctgaggccccaagccacagctgtcctcctggagtatcttaaccatatctggcacttcaccaaggtcccttgcctggtcctgtatgaccatgactcttcagtccataagcagatgctttgtctcaattgccatgtgaagtcttttggtttttggtttttttccttaatgttaagctgttttaacagtgaagctgaattttctggaaaatgctgtatggttcgagcccccagttcatgtttcactttacagccatgcatgctgatgccttccatcttgacaaatggaatgatgggtaaacactcctgacacaaagaggaacaccttcctcgtcccttgctgaaacaaagtgcaatgcacacagtagaatttagtttgcttgcactggaagatgccgttgaagaggtaggctgaggaacactgtatcctagggagaaaatatgcaagtctcacgggtgctttctgttggcttgtttctggtccttgagcaggcttaagtatctagtttcaaactagaagccccaaagccctcagtcgttgtcctggacagagttggtagaccccacctgtagaaatccagatgcactctgggattggagcacagagaggcttgctctatcgtgagaatgcccagcctgcagaggcccaggtgcggtgcctgagtggctgtatgccagacacaggaacgccagcaggctgagtgtggtgactgatatgtgaggtgcccttgccctgcagacaggctgaatgtgagccccagcagcagaggattctgagagtcagggtggtgtcatgtcctacacaggaagagccttcaatattactttttaaacgaactttccccattgctgatattttgataaaaacccacacaaggtttaattacatgccccctcatccctctccacacagtcttgcccatcccactggtgaattgttgttgttcttgttgttgttttttgttattggtgaaaattgtgaaattgttaaggtctctgtttttgttatttatctccctaaatcacatggctgctgcatacattgcaatgttgccctaccacatgtatgtttttgcaagttgcttcttcactcattgaagaagcctgcaccgtaagtgaaactcacttagtccttgctaattgctgctcactgtcacgtgaacgcagagaaggctgattttcctggacccattttcagtgctttgaggaacatgagtccagagtatattgaagtagaagacagtgtttggcaagccagttcttattagacactgctacaggcttcacaatcttcaaggtggacccacctcatgtggaagggcatcattgcccctctgctcccatgcgctgtgcacccccttcacagtgaaagacctgctggggaccaggactcagagatctctggcttcgagctcatatcttggcttcctgtcatgtctaagcccgacaggaaagtgtggcaccatcctgcctgcggcgttggatggataggccatggattttgctgtaaacttgcttcacaaggaaagctgtgtgttttaaaatatttgataaataaaggatttctagaaagattgactgaggagcatatttaataccatcctcacagcccttgaaacacttcctctatctgctgggttcttggtgaggctgtcagtggcctacttccttcctggctgcctgtgagtccctgaaatcagatctctaaagtgttcagcagagagagagagagagagagagagagagagagagagagagagagagagggaggttctaactcatggctctcaccattccttccagcatacttttctcagatcactatcccccactgttctggctgttttgatccttagtcccaaaggagaggaggcaaagcaagagaaagtatgaaatcgtttctcagtggcacagagatgccactgaaaggtgaagtgcttagaaagaaaggatgttctatcatcatgagagagagctggccaggtgagcaggtgggcagaagtcttccagggaagagcagggtacctgtgtagacatcnnnnnnnnnnnnnnnnnnnncctatgttctgaaaggcctggtagacttggtgtttttttttttttctgtttgttgtgtttttttttcatttttagaaaaaaaatttaatatctagtgtgtgagtttacctacttgtaggtacatgcacatgcagtacttgtagggccagggaggggggtctgatcccctgtaactgtaggtacaggtggttgttagccacatacgcgagaacctggaactccagtcctctggaagagcaacaaggactattatccaagttgagccatctctccaattagggaaaatattttttaacttgttttaatggtttgttttatactttgatttcctctgagtttgttgtcatgagggtagcatatagtgagcctgcactctgataggagagattccgggggagaggcacagggtgtcggtagactcttgggtatccctaggagaaccttggctgaaattcctctctgagaagccaagtcagagaatgccgttctcagctgtatcacacacacttcctgacatggctgtgaacttccgtatcttccagtgtcataggaagactgtcagcccaggataggactgtggcctgtgaaaagctcagagattcagagatctgagaaaagcatttagcaaggatctaaacaacatattgaatttactaaataaaaaccaattgctctactattcctactttgggagctctgtgtgtcccataagtatagatgggctcaggccagcatgcacagccaggatttctccagaaagttctactacttgaacctaagcttgtttgaagagattttgctgacttttgagttcttacatgatattcctattcccacagggcttctggtcttagacttttctttccagttacaactttggttgttggatttggttttctatagttggtagtattaagacaaatacagggtttttcacatgggcaacactcatccatcccagaaacaaacaaacaaacaaacaaacaaaaacatggcgtctcctacatgccttatttctgggaagggactgcaaggttggttgtaatatctcatgttttctagcagaaatgtcttttaataaatgtctagttaggaattatagggcacccaaggatgtttcttctacagcctaagccaggggccagaggatgtctacacaggtaccctgctcttccctggaagacttctgcccacctgctcacctggccagctctctctcatgatgatagaacatcctttctttctaagcacttcacctttcagtggcatctctgtgccactgagaaacgatttcatactttctcttgctttgcctcctctcctttgggactaaggatcaaaacagccagaacagtgggggatagtgatctgagaaaagtatgctggaaggaatggtgagagccatgagttagaaagaaccatagctgcaagatgagagaacaactccatggttaacggtgtggatcaacacctgaaaatgatggagatgctgagatgggtctgatcagagctgactgtgggccagaacttacacacacacacacacacacacacacacacacacacgtgcgagaacccctcacacacacaggatggtggggcagagtttaggtactagaagctccttcaagggtgcatcttcaataataatcttcaattatctaacttttctcacactagaccccacctatcaaaggttgtacttaaggttgtatcacctcccagtagtgctcatcagccacaaaagctattaacattggtatttactgtttgtgtctatggcatatcactggtcattccttttttatttttttaactttttattgattgtttatgaatttcacatcatgtacctcagtcccactcatctcccatctcttcatatccaccctccacccttgtcacctacccgcctccgaaaaaaaatttttggaagctgcagtgtgtcacagtgtgtcccacagtatacccttttgtccacacttccttatatgcaaatgttcattgcaatgagtcattggtctggttcaaggcctctggcttctgttacactgtcaatactggatcctcaccagggctcttctcatatagaatctcctcctgttgtcctatgtcatggagatcttgaagctttgggcctgtagtaccctctccttcacatataccagcagttcatagatggcatagagctaactcaaaaccctggatctgggcctgggtggtagctaagttggtcagcatgccagctctcctgcacccacaccaccagggcaagctctccaggagtaccctggctaactcacccaatgccacaggcatctagagccagagcaagctttccagctctgccgttgaagctcacccacaccaacaccagcagagccaactctattctgctgctcaggcaagggacaggactcactttctttagtgttatagctagtgaggagcagggccagctctcctgttctcatggccttgtggccagcttccccttctaccttaggtggagaggggtaaggtggaagaggagggcatctccttcttgctcatgccaccccacagtagacaagttgtggggccagctctcccatgctcatacccacagggctggctcacttgcacctctgctgccagggttgactgtaccgtgctgccctggtgaggtgcagggcccacttttccaagtcctacagccagtaattgtcagggaacaatggccattctaagaaacacacatcactggcaaagtcaaccactgtgacatcaacaggatacaacctagagtcgttagatagaggaaacctcagttaaggaaacgcctccatgatactggcttgaaagcaagtctgtagtgcattttcttaattagtgattgaagtggggagggagttaaggtcctggggtcctgggtgctatggaaatcaggctaatcaagccatggagagaacaaggcagtaagcagcactcctccacagcctctgcttcagttcctgtctccaggttcctgccttgagttcctgccctgacttccctggaaaatgaactacaagctataagctgatataaaacctgtctttcccaagttgttttatctgtcatgttttatcacagcaatagaaaccctaactaagacttcataaactaagagtcaaaggatagaaatcaatctactaagcaaatggaagctaaaacaaaactgttagaaccatcttcatacctgataaagttgagttgaaaccttcaaaccaaaaatagccagaagagataaatcagatcactgtaacgttactgaaaggacaattcttcaggagcaaataatagagacactaccacaatactcttagatctgataaacatttttagcaaaataactgtatacaaaagcaacatgcaaaaaccaaaaaacaaaaacgccatagctttttaaacatataaaaacaagagatgacctaagaaagaagaaaataggataactacacaaaaatactagggctcatgttcattaagaaaccttaaaatgcacaaaaaaccgatccaggtacaacaatagtggaagatgtcaataattcccactcaaatcttttttgtttggtttggtttggtttggttttgccagatagggtttcaccatgaagtcttgccggactataacttgctattcgatcagactggcctcaaactcacaaaggtccacaggttagggttagggttaagttctcctgcctctgcctctggatgctgagattaaagactgtgacaccatgtctagtctcatccttagataggtctctgggatggtcagctttaattgccaacctaataaagtctagggtcaacatgacctgagaggagagtccagatgagtgactgtcaacatggagtgtcaacaactttgggcaagcctgtagagaatatcttatgtaagttaattgatgtaggaagacccagcccactgtaagtggtaccatccccttggcagggttcctgatctgtttaagagtgggaaaatgagctgagaaccagcaggtatgtgtgcattcatttttctctcccctcaactgtagttttaatttgacttgctgtttgagttgttgtcttggctctcccaaaatgatggactgcaacctagaattttaagctgaaatacaaacccttttctctctaagtggttgtgtgtgagagagggagagagacagagacggaggcacacacacactcagagaggggggagagagggagagggggggagggagagagggagaaagaggggtattttttaaaattacaggaacaaaaatgaaactaggagtttccaaactaaaagtaagcaaaaaaacttcacaattaaaacatgtcaggtatcaactggacttaagaggtatcaaacagactggtccatctaaaagatacaaagtatacattattctcctttagccatagaatcttttttaaaactaacctgaatctgttgcctacctgtggatcctgttctcctaactgagctgccttgtcttgcctcagtgggagaggatgtgcagtaacttgatgtgccagggtggggtgatatccagagcggctctccctattcagaggaggaatagggaaggggctatgtgaggaggggcctgggaggaagggaggctgtggtcagaatgtaaagtgaatgaataaattaattaatgaaaaataaaacaaaacaagacaacgcacattataaaccacaaaacaatccttatccatcaaaggaacatttgaaaacgcttgcactgcattataccatagtagaataaaactaaaattaaaaagtaacagcaacaaaaccaacacacattctaggaaagtgagcaatgagtcattgaagaagcaagggaagaaaaaatttcaatccctagagtcagatgaaaagaactgctcaacttactagaacttctgtggcacatctaaggcattctgcaaggaaggtgatggtcatatgtgtttatattagcaaaaagtatcaggtagacctcaaatacataattaaataatggggggggggagagggagagagagagagagaccaaatttgtatgcagaagattgcaagaaaaataaagagaaggtcagagatcaattaaatggagactaagagagcaatgcatacagccagtcagagagttggtatttgaagagataaacaagtttgataatccttgcagagcaaaaaggagaaaactctcagatgaagaaagtaagaacaaagcatgggatcactagggaatactttgaaaattaatttcaaaacctcagaagtccagaggaaatggatacatttctaaacacatatggtctgctagagttaaatcaggaaaatacaagcagcataactggactcaaaataaccaaaataacaaccagttgttgaagcagtaactaaaaatctccacacaaagaaaagtctcaaactagatagattcactgcttaattctaccaacctcttaatgaagatttaacagaatactcttaaatagattcaccaaataaaaagagaaggaacaagaccaaagtcattacacaaagccaataaaatcctgattccagagccaacgaaggatacaacaacaaaaactgaaaactgtagaccaacttcctttaagaattcacaagctctttaagcgctcacctttcttactctctagctctccttctctctctcccttctccccctctctccacatggcctctctctaccttctctccttccccctgcctttctacaataaagctctaaaacaaaacaaaaaaaaagcattcacaacaaaatacttgcaaaccaaattcagaatccaatagacaatgcatcttaatcgagttactttcatctcaggaaagcatgattagtctaacatatgcaaatcaatacatgtataaggacagaaatcagaagattatctcaagagatgcagaaaaggcatttgaaaattctcaatatcactagacatcccgaagaaactaggaatagaagaaacattataaagaccttgtaaaagcttacagctgactaaatggggaaaatccaagaggatttcttctaaactctagaacaagacaaggtcctcactgtgtctattattattcaatatactgcttaaagtcttagctagagcgacaaaggaggtggaaaaataatgggaatataaataaggaagaagtcgaggtatccttatttgcatatagagctatccctatttggagacagcatgcatacatttaaactctactcaagactccaccaaaaacctcttagatatgattaaatagtttctgcaaagtaacaggatacaaaaccatacaaaatcagtagcttttctatgtagaaatatgaaaccacctaagaaagataagttaaaaaaaaaaactattcacaagagcttcaaaaagagttagatgtgaacctaataaagaatatggatgcctctaaagtaaggcctttaagacactgaagaaagaaattaaaattgatattagaagatgcaaatgtcttccatgcttatggaatggcataagctaatattgcaaaactaactggaccactgaaagggaatatagtttaattcagtgtccaacaaaagtctaatgtttttgacagaaattctaaagttcgtattgaatcatgaaagtcattaaaaagctaaagcagtcctgagaagaaaacaatggtgaagggatcgaactatctgacttcaaattgtaccacagcaccacagtgacaaagacgttggtactgaacagattaaaccaacagactggattagagtaaccagaaattagagcccacacaactgtagccaaatagtttttgataaaggggtcaaaaacatacatatatacgttagaaaaaaagatagcttctttaaataatactaggagacccagatagccacatgtcaaagaatggaatcggattagtgtgtatcgtactgcacaaaaataaatttgtaattgatcaaaatccttaatataaggtctgaaacactgaaacttctagaggtaattcactcaagacagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaactgtccccagactcagaaaacaatcaccaacaaagcctggcaaggacaggggtggagcaggggctgactccttgtcagtgttagggcaagtgtgaacccatatggcctctatggagatcagtatggaggtttctcaaaaacactaaaaatagaactaccaatgacccagtcttttaaatcctggaatagaccaaaggatcctaagtgcaatcaagagatgtttgcccatccatgtttattgccgacctattcacaaagggataccctgagtgagacaaagaggagactcaaaggaataaagaagaggtaactacatggtagacatagaaaagatttaatgggttgaacaagttatgagtggtcagggaatgggccaaagttcatggacaaggcattaataataaacaattagtctcagaggtgtctttctgagagctgggactaggaaggaaaaccagattttttttttttaacaaggagaatctcagagctcccttctctacaggtctaatctcagagatttgtcctagggatggaccacagcggtggctgcctacatctgcctaggtctcattggccctccatccttattccctgcgttttatgtaacactgtgaccaaggagatgtccacacactcattaaagacttcacatagaaacaaggatcagagttgagtggcccaactttggagacctggggaaggttttagagctcaagtctttagtccaagagaatggatggatagacgcatgctgactaaggaggagatagatggctacccttttgttcttacattgttcctgagattcgcagaatggcatctcaccccagaggtaactgagtccaacaggcagggagcccccatcatttgatattttccagatttgctgtatgccaccaagagagcacacatagtgagaaaggaccgtgtagcccagggcaccggctttggaaagtgcgtgatgggaatggatggaaaacattgctgtgggtgaactttgttgttccgggtctttattctggtgatgctgttgtctttgttcagacatcttaaactcagttgttatgtcagtattagtaattccaatttcttctttaatttccatgcaagatagggcttgcctgtaaagtgcactgacagaggcagcgttctatatttagtgaggcagatgctatctgcaaattacagggaaatgattgcatcaaggtccctggttggtgaaataaaccacaataaagaaatgaggagccagagaggggcaatgttctagaagtcactaagaaccaaagttgcttgactctgactggtaatgatttcttggtccccaaatgccctcccatgcccaagcagcatggccttcatgcccttggggttagaggaagaataatcacattgaactatttcctctacaccctgagaaaatgattatcatcttcaccggacagttaagtgcctaaacctcaaaccaccagggcaactgtgtgattttaggaaggacgagaaacagggcatctattttgtgacttacctaaacccaggagctatcagagggcttcctgacacttttaaaagaaaagaaagcgtaactacaaggcaagcatagggccttcctgggccatgatggagccgagggttcaagtttgtagtgaccgtgccattttcttcccatcctgaatacagaattcactctgggattttcatcatagacaaacacaattcaggtcaccagagtaaactgcttctgtaatggtaaatttcccagcaggtcttaaaataaatagataaataaataaataaacaaacaaacaaacaaatacacacatacatacataacatacacacatacatacacatatattttataatagtctgtgcaacctaatgttatttttcagctcacatttatttaattattaggaatccaggttaccttaatttttttgtgcttgctacacactttcatgcataccaggt

SEQ ID NO: 1002 - DNA, 4683 bp, Mus musculus
gggaccctttgctgccctcagctaagagtgcgggtgagcgcacaagcccaggaggaggtccgcacgcgtcatgaacttggagacgggcagccggggctcagagttcggcatgagcgcagtgagctgcggcaatgggaaactccgacagtggttgatcgaccagatcgacagcggcaagtaccccgggctggtgtgggagaacgaggagaagagcgtcttccgcatcccgtggaaacacgcgggcaagcaggactacaatcgtgaggaggacgctgccctcttcaaggcttgggcattgtttaaaggcaagttccgagaagggatcgacaagccagatcctcctacttggaagacaagattacgatgtgctctgaacaagagcaatgactttgaggaattggtcgagaggagccagctggatatctctgacccatacaaggtgtacaggattgttccagagggagccaaaaaaggagcaaagcagctcactttggatgacacacagatggccatgggccacccctaccccatgacagcaccttatggctctctgccagcccagcaggttcataactacatgatgccaccccatgacaggagctggagggattatgcccctgaccagtcacacccagaaatcccatatcaatgtcctgtgacgtttggcccacgaggccaccactggcaaggcccatcttgtgaaaatggttgccaggtgacaggaaccttttatgcttgtgccccacctgagtcccaggctcctggaatccccattgagccaagcataaggtctgctgaagccttggcgctctcagactgccggctgcatatctgcctgtattaccgggacatcctcgtgaaagagctgaccacgacgagccctgaaggctgccggatctcccacggacacacctatgatgttagcaacctggaccaggtcctgtttccctacccggacgacaatggacagaggaagaacattgagaagttgctgagccacctggagaggggactggtcctctggatggctccagatgggctttatgccaaaagactctgccagagtaggatctactgggatgggcccctggcactgtgcagcgatcggcccaacaagctagaaagagaccagacttgcaagctctttgacacacagcagtttctatcagagctgcaagtgtttgctcaccatggccggccagcaccgagattccaggtgactctgtgctttggtgaggagtttccagaccctcagagacagaggaagctcatcacagctcatgtggaacctctgctagccagacaactgtattactttgctcaacaaaacactggacatttcctgaggggctacgagttacctgaacacgttaccactccagattaccaccgctccctccgtcattcttccatccaagagtgagaagaaatactctgacagggcagccggctgctgccctttctctttggaagagctaagaagtgagtgggtttccacttgaagacaacaacagggctttgtgaggaaaaacagctgtatctgctcaacagaggagcttcccccagaagagtgcctgtcatccaggtcttgacaagtgccaggacttgggtgactgtgccctggcttataactgtgaaacttgatcagtgttgtgtttacatgtacttgaatgctggctttagcctggtatagatggacttttgcttgaagactgaaaacctgtgccagcatgaatccctgacaagagaagacatacgtattattggtccatttctcagggaagtaaagtctagactagagactacgctgtccactcacagagaaacgcattcctggatagaggagctgtaggttgcccagatcatgtccactgagtgaagggacttggttcttaggtccagtctaggctatcatgtcctgatcctgcactctctctgagtagaccctacatcctgtttgctccctcttcttgcccttccctaaaagccagctggtggactcttgttgccacatacttgagccaaaaaaccatcagggacatataagatgagacatgtttgcatctcctctgatctaacaacggctacaaagttttttgttgttgttgtctcccctttctgttttgcctctcattctttagaattgttgcttttttgtaaagaaaggaagagagagagaccgaatatactagagatagatttttaaaattctgtgccatttccccttctatttgttttgttggccatcagtggtccccatggcaacactggaagggcggagcctttgagcaggttgggaactgtcccggacaccagtggttcagtgtacagctgtagactcagtgagctgtttctgcttattttgtatattagatgcttccttgtgccaataatagtttgacagagtctcaaagctaccgggcttcttttccaacaacacattctttcacagaatcccaaagagtctcacttgccttcacaaccgtctgatcctttattgttactgttttgtttaggtggctttgccatgctctgggatttttctcctaccacaacatcattcctgactctttcgggctcagaaagagttaagcgctcttgcacacttggcacttacttctttttaattttttttttaacatgccactcttaatatttcttcttaagtctttcagcagcatacattcaataagcaatggaccattgggtgtctcatttcattgttttatttttaaaaaggaacctttgacaaataatacacattacagaaaatggaagcatttttcatagagaaggtaagaactgaaatgcattttatgttcgaatcctccttgctagtattagccccaagagttcagtctgtcctttaagcatgttttagttttcaatacatatatatgaagttgccctttcttagagagagagagagagatatgtgatgacactcttatgtacccaactatacagatttacctcatcttttgagtggcatgtggacttccactgctatgtgcctaggtgcagtttagacatcttcttagctacccatcccagcagcccactgagtctcgtgaactaaagtcacttatacatcttatagatgcaaaacattctggggtatattatcccaagggaagatgaaggcaaaatcgggaagcactcttcctgaggccccaagccacagctgtcctcctggagtatcttaaccatatctggcacttcaccaaggtcccttgcctggtcctgtatgaccatgactcttcagtccataagcagatgctttgtctcaattgccatgtgaagtcttttggtttttggtttttttccttaatgttaagctgttttaacagtgaagctgaattttctggaaaatgctgtatggttcgagcccccagttcatgtttcactttacagccatgcatgctgatgccttccatcttgacaaatggaatgatgggtaaacactcctgacacaaagaggaacaccttcctcgtcccttgctgaaacaaagtgcaatgcacacagtagaatttagtttgcttgcactggaagatgccgttgaagaggtaggctgaggaacactgtatcctagggagaaaatatgcaagtctcacgggtgctttctgttggcttgtttctggtccttgagcaggcttaagtatctagtttcaaactagaagccccaaagccctcagtcgttgtcctggacagagttggtagaccccacctgtagaaatccagatgcactctgggattggagcacagagaggcttgctctatcgtgagaatgcccagcctgcagaggcccaggtgcggtgcctgagtggctgtatgccagacacaggaacgccagcaggctgagtgtggtgactgatatgtgaggtgcccttgccctgcagacaggctgaatgtgagccccagcagcagaggattctgagagtcagggtggtgtcatgtcctacacaggaagagccttcaatattactttttaaacgaactttcccattgctgatattttgataaaaacccacacaaggtttaattacatgccccctcatccctctccacacagtcttgcccatcccactggtgaattgttgttgttcttgttgttgttttttgttattggtgaaaattgtgaaattgttaaggtctctgtttttgttatttatctccctaaatcacatggctgctgcatacattgcaatgttgccctaccacatgtatgtttttgcaagttgcttcttcactcattgaagaagcctgcaccgtaagtgaaactcacttagtccttgctaattgctgctcactgtcacgtgaacgcagagaaggctgattttcctggacccattttcagtgctttgaggaacatgagtccagagtatattgaagtagaagacagtgtttggcaagccagttcttattagacactgctacaggcttcacaatcttcaaggtggacccacctcatgtggaagggcatcattgcccctctgctcccatgcgctgtgcacccccttcacagtgaaagacctgctggggaccaggactcagagatctctggcttcgagctcatatcttggcttcctgtcatgtctaagcccgacaggaaagtgtggcaccatcctgcctgcggcgttggatggataggccatggattttgctgtaaacttgcttcacaa

SEQ ID NO: 1003 - DNA, 1353 bp, Mus musculus
atgaacttggagacgggcagccggggctcagagttcggcatgagcgcagtgagctgcggcaatgggaaactccgacagtggttgatcgaccagatcgacagcggcaagtaccccgggctggtgtgggagaacgaggagaagagcgtcttccgcatcccgtggaaacacgcgggcaagcaggactacaatcgtgaggaggacgctgccctcttcaaggcttgggcattgtttaaaggcaagttccgagaagggatcgacaagccagatcctcctacttggaagacaagattacgatgtgctctgaacaagagcaatgactttgaggaattggtcgagaggagccagctggatatctctgacccatacaaggtgtacaggattgttccagagggagccaaaaaaggagcaaagcagctcactttggatgacacacagatggccatgggccacccctaccccatgacagcaccttatggctctctgccagcccagcaggttcataactacatgatgccaccccatgacaggagctggagggattatgcccctgaccagtcacacccagaaatcccatatcaatgtcctgtgacgtttggcccacgaggccaccactggcaaggcccatcttgtgaaaatggttgccaggtgacaggaaccttttatgcttgtgccccacctgagtcccaggctcctggaatccccattgagccaagcataaggtctgctgaagccttggcgctctcagactgccggctgcatatctgcctgtattaccgggacatcctcgtgaaagagctgaccacgacgagccctgaaggctgccggatctcccacggacacacctatgatgttagcaacctggaccaggtcctgtttccctacccggacgacaatggacagaggaagaacattgagaagttgctgagccacctggagaggggactggtcctctggatggctccagatgggctttatgccaaaagactctgccagagtaggatctactgggatgggcccctggcactgtgcagcgatcggcccaacaagctagaaagagaccagacttgcaagctctttgacacacagcagtttctatcagagctgcaagtgtttgctcaccatggccggccagcaccgagattccaggtgactctgtgctttggtgaggagtttccagaccctcagagacagaggaagctcatcacagctcatgtggaacctctgctagccagacaactgtattactttgctcaacaaaacactggacatttcctgaggggctacgagttacctgaacacgttaccactccagattaccaccgctccctccgtcattcttccatccaagagtga

SEQ ID NO: 1004 - DNA, 39292 bp, Homo sapiens
  misc_feature (10575)..(10594): "n" at positions 10575 thru 10594 can be any base
  misc_feature (37148)..(37284): "n" at positions 37148 thru 37284 can be any base
tcctgagatcttatctttgatataagttagctccatttacacttagcagataataccaaattaaaacagagactgaattcagtgagcagagaaaacagcctagcccatggatttgttctcaatgcactgcctcctggctttggtgattttgcaaagaactgaaagaaaaagcacaacattcagaatagaaagggaatttctgaagggagtttcataactgaaatttcagtttgaactggatgagggacgctgtttagttcagtgaccactgaggacctccggcaggcttcggggtgtacaaagacagccaggattcagcccgcctcagtggagggccccacagcacaaagggaccaagaagggatagcaagaggacagccagagtgcccacaagctcggcaggaaggaggctcacatcgccgcggaagtctcgtgatggttctggtagaatcgtcctcttgaaaccttctgctgccattattgggttctgtccaatatgccttacgcaaaacactgacaatagcatacacctttccagaatgccggcacgcgctgtgcaatgcccaaactgtccctgtgagttgaatgcccctggcaggatgcgtgtccactcccgcagggccgtgggtgcctcccttgtctcactcctctgcttcaacccttcccagaactctgaaggtttgagatgaaatgactgagccacacctagtgcaggaatgagcaccagggcctctctgcaacggctgcttaagggccacaggataagcatagtgtggcacccccagttattccctgtttcgctcattggaccaccctgataggcttcagggaggcaggaacctcctctaaggcagcaggagaggggtggatggggcagccaacaggtgcatctcatgcctccgtgttctccatagggagggaggtgggctaagaggcgagtggggcagaggcctgggccagcgtgaagtgtcaggagtaaggggggagaagactggagggggcaaatccaggaggcagctgaggctgcactgtgcaaatacaagcccggttacgtctgtgtagcttagcttccccagcccacctgagccagagctgggtctgcccgtgctcccgcttctattgacatccagcaactccaaatgacctctcccatatcaatgggctcatctccgaagccgaatcttatagcctgcttctcctccccaccaggctatagtgggaaatcattgaggaaactatggttgaatgcatcgcacggcctctctggtgtctgagagaagcttcatagccagcaggctgcccctggtgggcaggtgccgcatggaggtaccacgcctcccgtgcagcgagtaagaagggcaaggagagcttgtcaggggagtgggccaggctatcacatcagatgggccaggcctcgcatcgctctctgcatcctaagcaacgtctggacttgagtgcgtgggtttgtggtactgcaatgccacagtaccttggggagcccccaggcaagccaagaaagttctgggaggccacagcccttcactcaagttcaaaggttcaaagcagggattctgtgtcacacttgcgaaggtgcccaccccaacagaagctgtggctctgcaggacacgtgcggggtagacctctaaggccttgtcccagtggaaatgccctcccacttggcctgggtagctgctcacgcttctgaaacgggaaaaatcaactgcattcctgaatgggagcctcagagcattagaaaagataatgttctgattttttaaagctaaacgtatatggaaggaagctgaaagaggacttttgatgagtcacctaatgttgatgttgaaataaacctaatgaccctctggctaaaatctgttctcatttgggaagcacctgaaccctcattctcccgccactgctctgacctctggaaagcaaggagcaaaggcacactcagcagctcccgctccaaaatgctctcccgagtcctcccaagcagccagaggacgactccacacccagaacccagagtggcctgggaaccaggcctcaggttcctggcccatttgtcatcgcccagggtcctcctgccaggaatccccccacatcctgccctgcctagagaagcccagctcttccatcaaagttctgctcaaatgtcactgcatgttacgtcttcctcacacactcccactagccttactgcatcatgcttggtttgctgagctatgtgtggggtctttccttgccaacccttctttccctgagaggtgcaatgacctcatattgaggctgtccactcccccactcccgaccccatccaccaagcctgggaggcactggcttaatgcatcatggttaaaagaaatggatggttgaattgcacagagaagacactgtgccccaggagatgtgccttgcacaagatccctgcagcacatgctgggaggctctgcccgggtagcacttaggaaagaaggatgtatgccctgggctgctgggagcactgtgggaactctgggatccccctcctcctaagggctgtgctaccctgatttggaaacaatacagaggcttctctcctgcaagaaaacatgccccctgcccacccaggatccacctggctggggaatctgcctagctggggaccaggtgggcatgctaaggaggaatggggctgtgtctgaaagaaagagatgccagcaggatccaggagagcagtcacggtcctggggtctgagagtgctgggccaaggaggtgtggggagcatagattcatataagagagagtggttcagtctgtggccatgctcctgggacacagcactgagcacccagcaaggccccaagagatgctgaaacacacagctaggatggctcccaggaacgtgagacagcattaaccacaggaagccaggcagaagtgctgcagccagggcgtgctgtgggagaagggctgggaggatgcagctcgctcgcacactgcgtcagaaaccttcacatagtgcttgtcctcagtacgagccaaggtgggggtgaggaacggcccacttaccaaaactctcagagaccccttggggaatttgtgcttcttgtttctgcaagtttccaggagacacagaaagggtgccactagactctaagctgtgggaggcctctgggaggctccttgggtggagcttagcagcaagaaggcatgttgaccttggtcatcaggaggtgtggagctgctgctatacaatggggcaggaccccggcaacccatccgggcacctcttggctctccctgtgtgtattgatggaaaatggtatgtggaggtgcagcacccctggaccaggaagggcaccgtgaccagttcaaagccctcaaggatgaaggcttgggtctggccactgagctgtagttgaaaggtgggagcatctagaaaggacagagcaggaggcgctcacgagtcttcactggcgttccagctgcaggggctgaggctggaatctgttccactaactttcctcttctaagttttctccaggataaagttgctatttgaatttcagataaacaacaagtagtttctttagtgtaagtacgtcccaaatattgcatggaatacacctatactaaaacaagttattcaatgtttatcagaaatgccaatttaactgggagttttgcatttttatttgctaaaactggcaaccctcctccagggatggaggcccactggaaccaggaggagctgccctcaggagctatgagaggaaatggatcacagcagaacgaggtgtagacttgggtggatgttgctgtgcactgcttggattcccacttgggagtgagaggttcattccctcgggtactgagactgctcctgggaggtggttctcagcaggcagccttctgtggcgatggctccagctggagaaaacgaacttcccaggtcacgtctcctctagaggcagctggcacccaatgctagctcagtcagggctgcgggggccctatcccttcactccacgctggaacaggctcgtcctagctccagagctttctgcagcattgactggagtccatttggcttggcgttgcatcacgggcacctctcggcccagttctgctcccttccccttgactccaaccaagcatgctccctaatcatacatgctgacctccatctcagagtctgccaccgtccctgttaaaggctgaaggaggactaggatcactgtcaacaaaagcatgacccaagaggcaagacacagtcatgtttatagcatattactatgagccactcactacttctagatgtcacggttcaaaggtgattgaaagaaactctgtgtttcccaatgcctgctggataaataactcagcatggatggtgagacagcatctctaacttcgcctgtctccccggtaatcgtgttcctcctcctcacttctttatcagggttcttggtaatagtagtccccccttattctcaggggatagatatgttccaaaacccctagcagatgcctgaaatagaagacagtactgagccccttatagactatgtttttttctgtacgtacatagctaggataaagtgtaacttataaattaggcacagtgagagattaacaacactaataataacaccaagcaatgatgaccatacgctgtaatgaaagctgtggatgttgttgctctctccaacatctcactgcatggcacttgccctctaatggcctgatggctgccacatggctgatgggccagcagcatatacagtggggtctgctggacaaagcagtggttcacatcccagaagggatgaagcgggaccctgcgcgatgtcaccaccctgcaaagaatggcatgcaacttcaaacacaaagtgttgatttctggaattttccatttcttattttcagactgaggttgccctcaggtaactgaaactgtggaaagggaaacggtggatacaggggactcctgtgtcattccccatcctggaaaccctccagcaacccctgactccccgaccgccccaccccctgccgagcacgtctactcagccccataactgcttgtccttccctcctctgccacccatgcacctgcccgtctgagagctctctacctcaccccgaggcctccccggcctcctggccattgttctctctcgggcggtacccacactatggccagataattcctcctttactgtagttcttaccttattacgggggaatatgagccaaagccatgtaactcgctgccgggcaggaactaacagagccagcacatgcttctcccgtacccttctctccatcaggtggccaggaatgttccggatccccgtggctttgccatggatatctcatttgaacaagaagtaaccccccccccagaatctcagggggtctcgttaccacagcataacctaacctttctagaaagatacactcctctatccagcatgcctagagtcttatgtgtgacaagtgacggtatgctgtttcacaaaatttcgctgaaagagccgttgatgaactttagaataacccaacattaggcgctgttacaaatgggtggaattagacaaagccgtttgcctttcacctcttgcttcagttttcagaaaattgcccaaaggtattgcaaaccatttgcgttttcattggcttggttaaggagttggcagtgtcaactggccctgtgtaaagccacgtcactgtttctgtagagagcatgacacgtcagagaggtgggaagtgttgccaggactcttcttagaatgctggcaagaagagcaggcgaaaagggaagagctgtttataaacagggaaaggagacatcacctcgtatccttggcttctcattacgtcatcgattacaatcacaagtctcatttcctacaagcctgaaagcgggttcttctctgcatgtaggaaaaagccccgcttactaactctgccctcaaagagatcacaagctggtcctgaacgccctgtgccctgggaatgcttactgtcgaagctctgcaaattttctcattgaaggcactcagggcattctgctaattaaattaggaaaatgtgtacagctctacttgaaaaaatccaggtttatgctctgtattctattaccaaagaatttatcacttttcaaataacattcaattattttaaactgagtgtgcagtgagagcatttataatataatctcatttccagagtgttccatcccaactcctctctggtataagtagcttagaaggttagattttttttttccagaggattaaacattcgagaagagtggctaagaggcagcaccaggtttctctcatttcctcaaagagaatttagccttgtgaagaagaataaagtgaaggtcaatggttagatccatggcttaaaaataaaatgcagctttccttactctgaatttaccataaccaaaaaggccacgaggcagccattaatgatcctaagttgcaacagaaagaaaaaaacacctacttagggttaaacgaggattcagtggtcacttgccgccggcctccacttcacaggggcggaggatgaggccagggaagactttcttacccacactgacctgaccagagatgaaactccccctcctatgacagcctgcactcagaggctgattctgaaatagtcatgccaaatgcagccaatccctgtgtacaaggagaaaaaatagttcctcagagctgtgtccttgggccagccatctggacctctcacaatctctttcgttctccctacacttgggctgaatcccgccttccttgcctgccaggtttggtttgggggccaaatgagtgaaagtccgtgagatacccctaagtattgaagtgcgtagtaaatgataatagccctgatttgttgaacatgatgatgtgccaggcattgcgcaaagcatcatttcatcatcacaacaaacactgctgggaggcagggacacccccaccctccttgtacacccagaagtaggactttggttaaatggctctcccaaggcctcacagccttaaaaactcaagcacttatttaatccccaatgatactaccttttggccatgcaatgtgtcatggccagtaattagatttgcaaacacatataaccaaagaggattagaagagacatatattctatataaattacatgaaaatagcactttcagtattttcctgattttttctggtaattaaaaatgattgccctttatatttctttatggatacagttgcattgtttttagccaattgtagcccccccctttaaagagtgaattagtgggaaaatagtgttatccaagattttaagaatctagtgtgtgtgtttgtgtgtgtaggatgggtttttctgaaatattttacttgcatgtgaatgtataattttaaagattggcttttaaaatactgaattgaggtaaattcagcttttcttgcagactctttacgataaatgtgaaattgaaaatggaaatgctccattcagatggtgtgccgactacaacctcaacatacggataattcactaaataagtaacttcctcgtggaatatcacggtcagcctttgttttgggtacacattcaatgaactggtttcctattagtttctgcttgtcaacaagttgtgtcatttactgataaatatccagccttttactaaggaataccgattttctcaagtctcagtgtgtggagggggtgggagtttggtggggaagcttttcaatttgagaacctttgccgttttttgtttcaatcgtgactaagatataaaagtccttggtcaccactgccagctgctacctgttcactgcctccctgacgggtaatgaggccatccggagttttagtgattaaaatgttttattacttgtattcacatcatcattaagaaaaataacttctagtggatcaatatggcaaatgagtaaaccagaagatggcgttgaagattagcaattacatttaaaaacaaggtagtggtgtgaaggctcagagtttcacacaacgactgttgttctgaactaaaagcagaggatgtggatgagtgaggggagggtatgttgaaaatgactaaacccggtgcagaggacacgtatacgaaagtgcaaaaagctctcatttgccattttttgtcctcagcaaactcctctctggtatgtttgtgaacgtttgagggaaaggtaacactgattaaaatataatgcaacaagaaggcaacgatctttgctttgttcactgatgtgttccaagtgcctaggacggttcctgacaagtagcaggtgctcaaaatacatttgtcaagtgaataaatctgtgaaaggaaaggaagaaaaacaggttgtgaccagaactttttgtgaacaaaaccctgttgtttattacatagactttggtaatggaaaacttacttgggtgaaataaaaaatggcatcctgttaatttctgagaacgtctgttggttttaggaaaagcatacctatccatacctcactacctgttttgctctagcctaaacatagattcttctttggttaggagacattgacccaatatataagattaaaacaaaaactgagaaataagtgaaatcaaaagcttttcaaaagttgcaggttgacctacggtggtggtggtctaaaatcatatagaaaccagagatctgatggtttacctgaaaatgcgaagtaaatgcacatactcagcatctcagacgatcgaaagctcaacgggtgaaagctcagggggttaattttgcgattaaggacatcttggaaaagtatgtaaaatccctggtccacttaagtattattcctattttgggcttttatttatttattttgagatggagtcttgctctgtcgcccatctcggctcactgcaacttcagcctcccgggttcaagcgattctcgtggctcgtcctctcaagtagctggggccacgcccggctaatttttgtatttttagtagagatggggtttcaccgtgttggccaggctggtctcgaactcctgacctcaggcgatccaccgcctcggcctcccaaagtgctgggattacaggcttgagccacagcgcctggcctattttgggcttttataccccactggtaaactgctttcctccaggttgaggttaaaacgacatcattttaaggtgaactgaagtctggaagtgattaagcacttggatccttagggagcctctccccgcccccatctctttcatgctaagataattaaaacttcggggccggggcattgtctgagtcacttcaattcaccagcctaatagatgcaaaaggatgtaagcatgtcagacacgcagagacagtatttgaatcaagcttaatagctcaagggagctgggccatttcctattttctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctcgcactctcagtttcaccgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgcgggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatcctaggctccttcccctgctcttcgttcctaaggggcccaagctcacggcggcctccggcgcggtgctcacccgctggcgcaggaggaggaggagctccacatttgggtcgctccgagccttgcgtgcggtggcnnnnnnnnnnnnnnnnnnnnctccggggtccggcggacgctctgcgcgcggaatcccccgtactggggctgcagcccccgcgtctgcgccacttgtcgtttgcagagcccacttagtgcgcgctagctgggcagggataggggtcctattcggggcgaagggtctggatgcgagcagagaaagcggagggtggaggaacccggggctgcgcccctggaacgcccggccgcaggcgaggtcctccgcgcgtggaggccgccaggggagtggaaactgacagagtcgcgggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcccggacgaccctgacacggcacgcgcgcgcttcgcagcctcaaagactccggggcctcgtggtcactggcgcaggggatcggggcggggtgcccggagtgcggtgcctcgtggctgaagggcagctcttctccccgcagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcggggcggacgggcgggcggcggaggcatcaggtggcgtcgccggagccgcaggaggaggaaaggaggcctcggctctcagcgggaccgcgggggccgggagccgggtcctgggcgcgtggaggctgcagggaaaccgctgaaggcccggccgggcccggggaagggcggccaaaggcttgaggggttttgcgcgttcgtccgtgcgttctcgtttccacgcaagcctcccgcccttcctccgggctcccgtctgccgcctccgtccgtgggtccccctcgccctctccgtgcgtccgcgcctgtgccggcggctgttttcgtctctcaccgcgtctctgtttctcttttcgctgcttttctctctgagtctctctctctccatgtttttcctgaggtcagcctctcttctcgctcctgctagctctctgcgggtactcccacctctgtctttctctttgtgtgtctctgtctctctctttcccccatcgcagtggaactcagggcctctgtctagagctgtctcccttgccctttgcgcgagtgcacacacgtgtgtcgttgttacgattgttctcccctaaggcagtttacccagagaactacgtgtctgggcccagcccccacctgtgggcagagcaggggaaggggacttcctccgggaatttggtctcaatttgctctcagagtgcctcagctgtgctgccatccagatgtctcctgtgggtgacagctcacaccacagctgtccttagtcctaggcaagctcactcagacactgggtgggtagagccccctgaaggaacctccgcatctcactctaccggttataaatacccagaaaatgtgtcttcaacttggcagtgatagggtccaagatggaaaatcattttcctagagcatagctggggtctttcagtttacgttctgagcaacggtgtaaatctgaaggacctatgcgccattctttcttttagaaatacaatttcaagattccttataaaatatctgtattttgggtttagcatggtggctcacacctgtaatcccagcactttgggaagatgaggtggaaggatgcctatgcaacatagtgagaccctgcctctgcaaaaaataataattaaaaaaattagccaggcatggtggtgaacacctgtaggccgagggcccagctactctagaggctgagataggaggaccctagaactcaggagttcgatgctgcggtgagctatcatcgtgccactgtactctagcctgggcagcagagcaggactctgattccaaaaagaaagctaataaaccagacatgtattttgacttttcgttctcttcattctttcccaccaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggtaggggctctcctgaatttgggtcacctaacagaggcagccagatccttgaggcaccttaacttcattctgagcatcactttctagctttccttttgtattgcctgcctgcctgccttctgcctcacagtgaagcccagcctccttgcctgagttatgtgggtcacaagttgaaattcctgtggggttcagcataggagaattaatcacactgtatgcctcaatgtatatgggggggggtgcattgaatatgtgttttccagttagtctttcaaaaaaaaaaagaaaaaagaaaactggataacttgttaaaatttacttatctaatagtctttagtgagtgactattttgcagaaaaggagtaatgagaggaatatctcatcactatgcatggtaataaaactgtcaacttttaaagtgtaacatggtcagctgaggtgtttattaaaagtcagattcctggacccctcttttcaagattctgaccagtgtgtctggaagagagctcaggaatctgcatctggaacaaatccttcaggtgacctcacttgggaaacatctggctggcggggtcctttatgtcacaaggcacattcgcatgccatctgtcatgtatttctttacctgtcctgtacaactcagaccttgtagaaaaaaatcagtttaatagcatgaaaaaataacttcccaagggagttgctgaaaaataccttatttgtcaacaccgtgttatgcattctaagaattaaatgctcaggtatttttacaagatttgacatttagttaggtcagttcctgtttttacgttgtgccatttcccttttccccaaacatgtaggagccaagcagctcaccctggaggacccgcagatgtccatgagccacccctacaccatgacaacgccttacccttcgctcccagcccaggtatggtggagggcactgggctccctgagggcgaggctgtgtgggccagctgcccacatggccagagaaccacagcagcccagacagcagaacttgccatttgctatggctgctccaacagcccagaaaaaccccaggtcactgaacgaatgtctcactttccacacggtgctgccattggtgtggattttaagttggggagggtcgggcgtgtccgcctgttggaatatgcttctcaggtcttctgggaaacagatgttttgtggaagtggaagattttggaagtagtgccttatcatgtgaaaccacagggcagctgatctcttcaggctttcttgatgtgaatgacagctttgtttcatccactttggtgggtaaaagaaggcaaattcccctgtggtacttttggtgccaggtttagccatatgacgaagctttacataaaacagtacaagtatctccattgtcctttatgatcctccatgagtgttttcacttagtctgatgaagggttcactccagtcttttcggatgataaaatgcttcggctgtcagtctaataagggattccctgaggagtttggaggctgtaagagcaccccccgtctcaatgccagtgcttcttatctcagcctctcctgcactcctttacccccgtctcgatgccagtgcttcttatctcagcctctcctgcactcctttacccccgtctcaatgccagtgcttcctatctcagcctctcctgcactcctttacccccgtctcgatgccagtgcttcttatctcagcctctcctgcactcctttacccccgtctcaatgccagtgcttcctatctcagcctctcctgcactcctttacccccgtctcaatgccagtgcttcctatctcagcctctcctgcactcctttacccccgtctcgatgccagtgcttcttatctcagcctctcctgcactcctttacccccgtctcgatgccagtgcttcttatctcagcctctcctgcactcctttacccccgtctcaatgccagtgcttcctatctcagcctccccgtctcaatgccagtgcttcttatctcagcctctcctgcactcctttagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaactgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcttatttaaacaccacagagatcactccaggcagtggaaaacagccccccactttttatatagagaggagattgtggaagctcataaataataagtagggatgctgggagattattgagctggtatatttctctcgaatagtggtgtgttcattgttgctattgttggaattagaggtgatactaaaaaaggaacggaaaaataccatggcaaacacataaaacgtctctacaggtgcctacctaccactgggtcccagaaagacttgctgattgtggattagatgtggtcccctgccctcgggagttccccagacatcaaaatgagctccctcagcagaagctctcattagctgggtgcagggagaatctagcaatgcggtaactcaggccttcaggacttttgagttagttacttaaatggaagtcctgagacaggtcaacacactgaaccctttggatgttttaggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaattgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcggtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaaggtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatgaaacctgccccgagaatcacctcgaatggccaacacccactctctttggggcgcactgtctgactcgctttcagacagtgtgttgaagcagagaattgagacagtgatgtgggttaagtctcaaaacctgctgttgaggaataagatagttttgtgggtttctttttttggtatgcatgatacagattaattatcagccatgagcacatttattagataactgtgattcccattgattttggggttccatacagttaccagtggcagctgcctcctgtctgtgccactcccctgcggtctggctgaggagcttgtgcaaacccagcttggttctttcaactcatgggcgatattttaaagaggcttctgaaatcagcaaaacgtttgtaaatggattcatcttgtttaaagtttcagagagcgcagttttagagttcttttcaaacttaaacacaaagcccagtgggaatttcagcagactttacatgaacttttagagtatttttctcattaatttctttcttttcacaagaattaattttgtgataaaaacaccacatatccagtgtggaaaactaatttaaaaatcagaaaaacaaaaatggaaaataaaaacatcacattctaccacccagaaatcaccattaaggcctcagtgcttaccctttaatgtgtgtatgtgagtgtgtttatatataaattatatagacataaataattaagcacctaattctatatataatttatatatgtacacacacacacacacacacacatttgctttttacctaaatgatgtcatgttattattttggggacgtttcaggtatgtggaccgacttgcttctttctgaaacaccgttatattttttgctagtataaattaaacttagggttcatttcctccaaagtaaaaattgatttgcttaaagatgaattttcattcagtgacacatgacttaaatgacatcaccactatcatcatcataattcacaaataagacttagcaagttcttaatagtgatgctctataataggaattcaacttacatttccagaaaattaatgaaagatacacttgttccttaaaaaaagagtcggtggccacatacgtttgtaatatgctggtttagacagattaaatgggtttctttccacgggacttctccaagtgttgaccgagctcatgctgtctgtggatctctgggggagacaagggcacgctgtgtttcccaggcctccttgacgcgggaaccttttgttcccccacgggacatgtgggacactagagttccaccacaggtgcttggctctgtggagtcgttggcctcgaggtggtgtccttggcccccagcactgactccggagctctgtgtttgcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcccactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagcccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcccagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccataggaagagggagaactgtgctggttccccgaggcggcggcaagtgaggaagtcacctggggctggacacctctcattctaagggcagaaccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggcccactgggcctggatttctgaagactctggaccttggtgccagtggattcagaagataccacaaggtgagggctttctaatgaaagtgtcacaaggaactggcactggcttttctgagtgcctcttgctgggcgtttttagggaggtagagcccccgtggtgactaagctggaaggtgcacattgagtcacaggtgcactgcgtgagagacagcacaggcagggggtggacgcctgtgagtgtcctggggctgtagacttgcacgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaaccagcttctgcataattaaggattcccaccaaacactctcatgttatctagggttggagccatgctttctcagagaattgtgccaactcgccattctgattagcctgtgtaggtgtagtctcagatcacggcagtgtgaatgtattttacagattctgactaagtcatttgggtttgatttgaattctggaaaaaaaaaaaagcaggaagtcaaatagtcctgtaagttagctagaaacttctgttcagttgaagagaacagtggagatctttgatatcttcctattcaggtctgcacagcactagggacagcccccagggcccggcccgagggtgtgtatctgataaggacgcgtctgttctgcagaagctgtagcggctcctgtgtcaactcgtttcttttgcgggcgtgacattttattgtagctacaggcagaagatttgtcttgtgtacaggggagggagcatgggctaaagtcaggggatgggcacttgtctttccaacaatgttccagtccgttttgtatcttttgggtaggtgtggtggcttcaggatgtacatgtgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgaggggatgaggttttaaaatgatcctgggatgtcgaaacattctgattttttaaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatcacagtaagctcttgcttcctgtttaacctggtgtgttcggtgatgagggtttctgaacatggtctctttcttgtgggcttctacagagctgcaagcgtttgctcaccacggccgctccctgccaagattccaggtgactctatgctttggagaggagtttccagaccctcagaggcaaagaaagctcatcacagctcacgtgagtcctcagttacactcctaccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacatacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacaggaattgctaaatgactaaataaacttggcattgataagcagcatttaagaagttgatgatcggccgggcacagtggctcacgcctgtaatcccggcactttgggaggctgaggcgggcagatcatgtggtcaggagttcgagaccagcctgaccaacatggtgaaaccccctctctactaaaaatacaaaaattagccgggcgtggtggtgcgcacctgtaatcccagctactcgggaggctgaagcaagggagtcacttgaacccaggagtcagagcttgcagtgagccgagattgcaccactgcactccagcctgggtgacagagtgagactctgtctcaaaaaaaaaacaaaaaaagaagttgatgatcagctcagctatcacatcaatccagttttaaagttgacatggatgcaagtcactgtcctctaagtcagggaaagatggatccccagatgaccccctcatgctgaagacgaggctgcgtggtccataaaatgaataaacacacgtgtacacctatgagttccacttttaaaaattattaatttaattcatttcaggtacttaggagtttagcttaagtcgtcatatataaaatacagtctctaatatcatgattgatggagagcattcagcttgccttagatgctgtaaattcaggaaaagctgaacattaaggcgtttttgttttttggtgagtgtgatccacgctaataaccagacagtataaatttgaggccagttagcttctctttttccacaatagtagttttgttgttgtttaactttactttttatttcttttacctctggttgagaactatacagattacctagaaatcaaatcattcaggatgagctccttgtttctttcaaactgcagttgtggaaaaacaaaatcattggcctaaattaccctgcagattccctcagacttccttttaatttgatcactttacttgatttgatgcagttttagttaaatgtacattttaagtggcagtcgatttgaaagtaacatctttaacccagaattaagtcactttggctgtttttttacatgttgatctatggaaggactaaccaaaaaattgcttctttagatggctccaaatatgaaatgttttgatgtgttctaggatgtaactttgggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaactcagaagtggagatttcagttcagcggttgaggagaattgcggcgagacaagcatggaaaatcagtgacatctgattggcagatgagcttatttcaaaaggaagggtggctttgcatttcttgtgttctatagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaacgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttatggaatgtgtgtgtgtgttattaaacatgcatcctgatagcttttaaagcactttctcctgcggttacgttccttcagagaggctgctgtacgtgtctctgaaatcagatctccaagtgttcaccttgttaaagagacaaacgctggccaagtgccgggctgctcctcccacacagaggagtgtctgtgaagagtaatcatcctgctctcccgttagcatctgcctcctcttcctttatctgtactttaaaaggtttagggctttcaaggaagttgtttttaatgttttcttttgtttatattcgaagctcctctgattttggtcattgctaaaaagaagggatataggttaactaacactccaaatgtgaaaatcaaatggaaaactggataaagagaacaggatttagatggaacccctggggatccgtacgtctgctgttgacctcagctccaaactcttcctctctctgagcagccaggcaagggagtctcctttctcagcttcatcgcttctactgattacatggctcagctcctatgcacctactaacttccagtccagcagaaaaactcaaagaaccaggctgcagctgctggtgctaaaatccttgcagctgaaggttacatagagctgtcagaaaagtttgtagtttggatctagaaccccccctagaatagtagattagcataattttgattttgctaaatggtaaaatttcttttctaaaccctcacaagttcagttgagaaactttcctgaaaacaaagatcaataaatcttagcatagtgataagacaaaggagacagcagctccagtgttttaaaaggggacaaaaatgagagaaggtagtaaaatctgttcccagattccactgctgccttcgctgttcccaggaaggaaggatttatgtcctgatctcaggagacaggcttcagcagagtgcttccctgtgagttctgtgttcctaacttaacaattctcaatattttggggagaaatattttggtttccttcagtccccccttgaagctttactttcagaaagtttcacatgttaaaagctaagttggtagttttggagagatttgggttagaagttttaagataagagatttggcaaaggaggaggagaacatagtttggaacaagcagaaaggaaccaatttgggtacattgttccatctcttattgtatcagtctttcagtcctgaaaataggtcagttccgttaaatcattgcatcccatttcagaggtggtgtaagtgggcttccataagagttacgtcttccatatggtgtaggcacacaggtactttatcagagacatttgtatggaaataaaaagaaaacaaaggtctatgtttcaagcagtctataagctagtttctggagagcaaccagctgagatttctagatttgggttcaaataattttaagttggagtggacaggcagtggcaatctgacagatttttctggattatagtttgcatcagacgttccagtgaagtttttgtccataaataaattgtgatgacttctccaaagtttatatcaagttgttcagctttcatttgcagggcttcaggaaaggcacggttttaattcctagtgatttcaagtcagaaaggtgggagaaagttgggaatgttagtctgaagagccatagcagatattagaggaaactaaaacttcaggattcagtccagataatttttaaaaactctaaaacaatggacagggctagaatctaataacagctatgctatagctgttctgaaacattttttctctctacagtcacctccctgtttaccaaagataatcacaataagtccagtttacttacaaaacaagtttagtgtcattatatttaaccggatcatttacataagtacagcaagaacagtgatttaacatataagctctttttaagtcagcgttgctggaacttttcgtaaagaattttattagattagaacactaaaaccctcttcagactaggaagccgtgccacagacttaccaacagattttatctgagatacctgggtaaatttttttcttgaggtctccaaaatgttttgaggttcctgggcttgtcagaaaatgacattatttacttactgcaaggctagaagtgctggaagggcaccgcatagttcaggaacaaagtgccaggccagttctttcaagggttttattggctccttaaagttaacgttcattccttaaagcagtctggtcacatctgaaaaaatgacgtcccagtcatagccttgatgatataacctgtgtttccaatttttccagtccgaagagaccagattcctagtgaacttatgcaaataactatcttgccataaaaatagaatttctcacatacagtttctaaatcctggagggctcaggtaaagaaaaagataaatgtttcaatatttgtgcacaaaaatatactttacaaaattactgtaaagctgtagattacttaagagggaaaaaaagttttctcaactatggaaagaaaacataaaaagaatcagcaatgctttaaacaaaaaatgttgcaaaaaatcattttagtccttccttggtttagtttcgtgtaattcttgttttgcttgatttggggttactaattttatgagtccagtttttttttcattagcattctgggaatttttaatgactccaataatatggtctgaaagttgtcaggaacctgtattcaagagtacttctttcagtcctttctatgaaccttcttgaagacataacactttaggatctgcaaagagcttttagaaaaagtatcataataaagcaattaatagcagataacaagacttaaaatggacatagttaaagacacaattgacatggaaatttggttactttctgtggcttacaacaatttaacataatacccataattataactgacaacattaccaaaacatatcagatttttaggaatctcatacaattttagaacacatattaataacatatccatatgatatagtttggatctgagtccccacccaaatctcatgttgaaatgtaatccccaatgccagaggagaggcctggtagaaggtgactggatcattggggtggtccctcatgagtggtttagcaccatcctctcagtactgctctcatgatggtgagtgagtgctctcaagatctggttatttaaaagtgtgtagcacctcccccacttcctccttctgctcctgccatataagatatgcttggttccccttcaccatccactatgattgtatgtttactgaggccttcccagaagccaagcagatgctgccatgcttcctgtacagctggcagaactgtgagctaattaaacctcttttctttataaattacccagtctcaggtatttatttatgaagtgcaagaatggagtaatatagaaaattggtaccagtagtgggatattgtgataaagatacctgaaaatgtggaagtgggtttggaactggataacagacagagattggaagagtgtggaggctcagaagaagacaggaagataagggaaaatttggaactcccgaaggacttgctgaatgattgtgaccaaaatgctgatagtgatatagacaatgaaggccaggctgaggaggtctcagatggaaatgaggaacttattgggaactggagtaatggtcgctttcgttacgcattagcaaagagcctctactctaaagatttgtggaactttgaacttgggagcaatgatttagggtatttggcagaagaaacttctaagcagtgaagtgtttaagatgtgacctggctgcttctaacagcttatgcttatatgtgtgaacaaagaaataacctgaaactggaacttatatttaaaatggaagcagagcataaaagtttgaaaaatttgcagcctggtcatgtgataaagaaaggaaaatttcactagcacctctatctagggtctcaggttctcatctgacaaagtacacaaaggccttacaaccccatgtgtccatagatagaagaataaaaaaagacagtctgtaagagaggaaatcaaaagctgttcatggtagtagaaaggattaccaatgggtaccacaaaaagtcaagactcatataaataattaaaaacaaggcatttacactaatttgtataaatgtttctctcccaagctaaggtatttactaaggaaatcaatttggtggtgggtctaaagaactttatttaactctgtgtcaaatccaatctctgcttgaatgctgcttaattaattccctgaataacatttcaaaaacatggtaagattaacatcttccatgggctgagaaaggcttagagaattaggctgaagagtgttttgtcaatcttgcaatgacttacaggcatttgaaaagtgaacttctctaaaagaaatttattttaaatatagccagtctaatttatttcaaagtgatgtaaaccaataagccaaaataaaaacaccagagtcactatatccaagagccaatttatacaaataattttctcctatttaaatttggaaatgaaggaaaaaagaaaaaactcttaccctcccctctcaactgagcactaaaaatagagatgtgaagagctgacgttggtaagaaaccttacccttttctgctggtttctttcagatctctcagagctccatccattggccctagtgtgagcaaagtgtgcctttgtggttgtcaaattgaaggaaagaaaatatgatttattttctcaatcctcatattttcttacctgagacactttcctgaaaaaaaaaagattaacaagagaaaagccagaagaagtttattgatgaatattgtacccatcacctagaagaaggcctcagttcaaatgtatttctctcccagggcagagtagatgaggaatctttcttaagtagtattttaacaaaaaacaataaatcttagcatagagacaaagcaaaggagggggcagttccagtcttttaaaaactgggaaaatgtgggaagatagtaaaccttgttcccagattgttctggtgcttgctgatgccttctctgggccaatttctagtaaggaaggatttatgtcctgacatcaggcaaatagaggtggggcagagtgtttccttgcattttcagtgtgtttaacttaataatcctcaatatttttggaagaagtattttggtttccttcataacgaaatagaaataatggacaaataaacaatctttcttcttcttggggctccatttgctcaacaaatacaggtggactcaagtcagtatacatgcataggcaagtttttcttcaaataatatatcaactggttatatctaaaagggtattccaaagggttttgagcccttgagattgctctgaagtaattttatgtatctctaaggtaccagtgtttattctcgtaaactgttctgtaactgcagcacaagtttggctgtattggatttgatttcctaaaaacaatgatcacctgacaaacacgcttgttgcagtgtgccaccagtactcccctaggccagaaagacacgttgggtcctgtctcatctctctgcaaaggagctctggacaggctatacctaaattaacacaggcagacatatattctctgttttagtgtagcattatgaattatatggtgtttgaaggcaacccggccttttcagtgacccctcctcctgccacactggtagtgtgttggcaaaatgtctgtccttagggagtcctcaaagactccttccttctcttccctctgccctctgcctctgctcccctggctagtctgcgcccacaggtcttggctgtggcacactccccttctgcaggcattgcttcccttattccaccctctgtttgggtctccaaagtgtgatatttgtcttgagaaacactttgccccactatgtcattcccctttccttactctccaagcagctgggtcactggtgctcaggactcaaactggctgggaatgtgagaaaagctccttttccctcctggcctcctacttgagactaaagcaaaatgctgagggttgaggaagggagagcgagtgctcgctgagaaaggaagaaatgagtgtttagacttcagccactccctgataaaggggaacgatcttctgcctcctgggaaaaactttgatgagacagcaaacttgagaaaagtttgtgggaaggagcagtgagaaccgcaggttacgaaggggccaggtgggcaggactgaaggataactccatggtaaccggcgtggatcgatgactatggggccaaagagtgggcatgcctgggtgtgtctgagcagaaactgcattgaggacaagatcccctgcccaccagcacaggctctggctctgtgggagctatgccaaacttagccccagttcaagggaaggagagggaggagagggaggagagggaggagagggatccaaagtgaactgaacttgaatttgcatcaccctagtggaatatgagcttaaaattaacaattatattgttaaagaaaatatgaactacatgtcttaaaaactttggctctggacttagatttctacgcaccatgtccgcagcataacactgcccattctttattgtaattgtctgtttattaatttgtcttctgtactataaattccttgaggaagggaactgtgctttccagtaaacacccagtactggtgcagcacctggcttatagtcagcaccatcgaatcctcaggaaatgacacagttggcgaacctagatgtctaccatgtccaacagtgtccaataggatgctggccaagtgatgagccacctatggcatgaaatgctatagaaccacttacaaattgtgcagtatacaagtatttcatggcatggggaaatggttgttactttgtaaagtaaaaagaaacaggtttcaaaacaatgtgatatctttttaaaatttcatggagctcatacatagaattttttaaaaagaacattcaacagtgtaaattatacccctgagatgtggggtcatggaaattttttattttcttgtgtgcttttttgtacttttcaaagtttctcctgagaccacatattttgttactagaaagggagaaaagcacaaatgtaatctttctaagttgatacgtccctttatattttttggtgggcttccagtttctcaagctgccttgtggggtccccagagctctgggggtgggaccagctctgaggtgaagggaccaggggctcagggtctcagggcccatctcccagtcctgcctccattaatttcttttcctaccatttccccttgatatgctttcccccacctcatctttcccaagatgcttctttgtcctctgagctatgacactgaggatgaacgctctctcagctttctggctgcagctgcctccatgcagggacccccagcctgtgaacttccctctggcacccccactcccccatgcggaaactccctcggccacccgttctcatccccaacccaagcgggacctccctcccccaccagcacccccatgcgggacctctctcccccaccagcacccccatgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctcccacccccatgtggggatctccctccatccctagcacccccattgtgggatctcctttcctcacctccaacccccatgtgagaacctccctctcactctcacccccattctgggaccctcctgagtctctgcccttcctcagtcatcacagtctctgtacagctagggactgactctttgcctttggccctgctgtttcccctcacgctaatgtcagcatttggggttgcctggaaacaggaaggataagaacattgattcttcttttttatttgtggaaaatatgcataacataaaatttaccatcttaaccatgtttaggtatacagttcagtggcattaagtaattcacattgctgtgcagccatatccagcatctgtctgcaggactttctcatcttcccaaattgaaaccctgtctccatcccacactatctccccattccctggcccctttgcccccagcccccaccattctactttctatctctatgaaactgactactctggataccttgtatgcgtggaatcctgcagtatttgtccttctgtgtctggcttatttcactgagcttgatgtcctccaggttcgttcatgttgcagcacgtgtcagaatttcctttctttctaaggctaaatcatattccattgcatgggtggaccatattttgttcatttatctgtcctgaacacttgagttgcttccgtgttttagctactgtgaataacgctgttgtggacatgggtggacaaatgggtcttcaagaccctgctttcaattctttcatgtgtatacccagaagtggaactgctggagcgatgaaaattctataattaatattttaaaggtaccactgtactgtttaccacagtggctgcatcattttacattcccaccagcaatgcacaaggattccagtttccccacatcctcaccaacacttgttattttctgaagaacattgatttttttaaaaaggattcattccacaaacatcttctgaagactccccatgttcctgaccctccctgctttccagggatagccagctgtaatcgcacagcttctgtgtgggtgcaggaggccagcaagcactgagacagacgctacgggcagggcatttccgagaaggaaatattttcattctccatttttaaggtgagaaactgaggcccaggagtgtaaagccagtaccctaatatacaactactaaaagaggaagccaggattcaaatccaggcctttgtggtttcatagccttatctcttaattctgatgccagcctgccttcccttccaccattgacgtaccaagagtcagagaggtggcacggtgtacctgtatccacaccactggtgagcagccctccagcatcacacccagactttctaagatgcttggtatcccacagatgggagccaatttctttaggtggggaaagagaatgggagcagagagaacagcctgttccacaaagaaaggagaagaaccaagagtttgggattaagcataaaggtctaattaacatttattaggtgctaagtgcactgccatgtgtcaactcctgtaatccttgaagtaatcctgggagacaggcatttcatttctcaccttacagatgggggcacagagcacagggaggatcttgagagggtcccatggtcagcaagtgttggtgaaaggatatcatcctggctggtcctacccaggtgctccatcttcatcctataaaactctctgtgctttagtttcttctatgaaacaggacacctatttcatagggtagttgtcgggattagtgataaagtgctaagagtaatagctggggcacagttaatcctatgtaaatattggcgaattgtcttagtctgttgcctgttgctataatggaataccatagagtgggtaatttacaaagaaaagtatgtattattatgattctggaggctgggaagtccaagagcatggcactggtacctggtaaggacctccttgctgc

SEQ ID NO: 1005 - DNA, 5065 bp, Homo sapiens
cgctcgatcttgggacccaccgctgccctcagctccgagtccagggcgagtgcagagcacagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccacaggaaaaacattgagaacctgctgagccacctggagaggggcgtggtcctctggatggcccccgacgggctctatgcgaaaagactgtgccagagcacgatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttccttttttttttttttttttttgatacggagatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaactcagaagtggagatttcagttcagcggttgaggagaattgcggcgagacaagcatggaaaatcagtgacatctgattggcagatgagcttatttcaaaaggaagggtggctttgcattttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaaatcccaaagacctccacttgcttaagtatacctatcacttacatttttgtggttttgagaaagtacagcagtagactggggcgtcacctccaggccgtttctcatactacaggatatttactattactcccaggattcagcagaagattgcgttagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacacttttcatgcagtgctctttgtagctaaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatggaaataactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctccccaggtgcattttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactgtgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtacc

SEQ ID NO: 1006 - DNA, 1356 bp, Homo sapiens
atgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccacaggaaaaacattgagaacctgctgagccacctggagaggggcgtggtcctctggatggcccccgacgggctctatgcgaaaagactgtgccagagcacgatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatga

SEQ ID NO: 1007 - DNA, 37051 bp, Mus musculus
  misc_feature (36527)..(37051): "n" at positions 36527 thru 37051 can be any base
gtctggaggttttatttgtccctgagggggtgccattttggtttgggggtatgatatgaagaacctgtgtctgagagcggagttgtagagagtgggcagcagccagcatcctggcatagtccccttgctacagggcaggaactgaagagagagaaagcacacacagtctccagtctgctctgcttcccgcgtccactgtgctattgatgtttgaaagtggaaggaaccgtgaactcttttattacccagatgatgcatattcatgacagaagctgggagagaaaagcagaccagcctcctaaatgagagtttcacagagtctatgtcgacatccccccacagggctggggggagggggctctgctgcgcctgtaggctcacttcgagtgtagacccagatttgaaatctgcctggtttgaaattcaggctggtcttgtctctagcctggccccaattaacagtcattattatttcttttttattgaggtgaggttcacttagtatgtgaaagtaacccctttaaagtgagcgcctccatggcatgctccagagcttacgtcatcccagaaacctctgcccagcaagcagccactgcacctccattctagagcctgattccagttgcacccactgcccaaggtcgggtagcctgtggccatgagagatgagggcggggagctgactgccctacatgtctgtcaacagctgcagcggagcctttgtgggccaacgatgccaggactccaatccttgcctcagcacaccgtgtaagaatgctggaacgtgccacgttgtggaccatggtggcactgtggattatgcctgcagctgtcccctgggtttctctgggcccctctgcctgacacctctggacaacgcctgcctggccaacccctgccgcaatgggggcacctgtgacctgctcactctcacagagtacaagtgccgctgcccaccagggtggtcaggtaagggctataggaggttgtgaacttcacggttgggacccttaggcctgggcccaaggaccctatctttgttgacttgacatactctggtacactaaactttatcctctcctggatcagagttaagctgggatctactatccagaaaaatcttggggattccttgggaactctggtccttttcaaccccaaactatctgatttttggctgccctgttccaggaccccaacctctcactgtttctgtgcgtaaagaatgagtcctcatgtagcccgggtcttaccatctccttgtcagggtgcctcaggtttccattgcttctctatgtggggtccaggagacagctaggtacaaattttagactgccattcctactttctgtccttgagcagtcacttagtctcttatgacttacagtcctctgtatgcagaaagatggccacattctgcaacagatactgagcatcatgaagataacactttagatctatccctggttggtacctacatgatgtccaaatctgccctgggttcacagggaggccctggcaacagctgaccctcttctctgcctcccaggaaaatcatgtcagcaggctgacccctgtgcctccaacccctgtgccaatggtggccagtgcctgccctttgagtcttcatacatctgtcgctgcccgcctggcttccatggccccacctgcaggcaagatgttaatgagtgcagccagaaccctgggctgtgccgccatggaggcacctgccacaatgagatcggctcctatcgctgtgcctgccgtgccacccatactggtccccactgtgaactgccctatgtgccctgcagcccctcaccctgccagaatggaggcacctgccgtcctacaggggacaccacccacgagtgtgcctgcttgccaggtaggttccatctcagtatgctggcatctagcctggttgtccatgtccatgcgtgttccactgtcaagcccgagggatgcagaaagagttaataccctttgaagggagcccaaaaagaagtttagagaagggcagcagccatggagccttaggtgtggtataagagcaggtcaggatagggataccagaagtgaggggacactctcagtgacaccacacacgtctatttctgtctgggccatctactgagatccagttagtttggtgcataacctccaagccttctttctgctgataagagtgccttcccttggtattttcttcatgctgggcctcccctgacccatagccaactaatacccaccatgtcaataccctgagcctcttagggcagggagccagcctgcctttacagatgctcatgaactgtttggaatccacatgtgactctctgtatgttacgggagcaccctgtcatgggcagtccctggggtttcccctttctctggggatggtaattgaataacagggtcttgagggccttaggggcctcacgtttttcattacttcctctgcagtgttcttcccactgtgctcaatgtctctgcaggggtggggcctgcaggcacagccctagtcctttctgttgctgctctaacgatggtaactcggtgatctaaggcagcttggagctgccgccaacccacttttggcaagggtggggttggtcaacataccaggccgttgagaggaaggaggagtgggctcaggaaataggaatagatttggttgctgggggtgacctcggaccactccccttgcaaccccggggccaccctacacactgaaaaagggaagttcccttctgccccaagcttgcagagccagcctcaagactgcgtgcagacactggcttatacatttcctgaaagtcattgggcaagctcggaggtagccgacagctgcctacacgcttcccagcctccctgggggggctgggacaggatcctcacgctcaggagggccccagagctgagttcagctctgtcttggtggccacctaagacctcagctgttagaacctgtgttgagaggctagactgggtctgtcatgcagactgagagaaagccttgttcaaggagcttgtgaatggagctgccaccaatccaccttaggcagggtggggtgggtcaactcagagtgctggaagatgggcaggagggaagcaaggactgggtggggtccctttaccttagccggtgggtcatccctgaagacggaacacacactaccctgtgctgtgtggagacatgctgtttcagagtagggagaagtgaaaattgtccacccaaattgctgttgaagggagtccggtctgggcacagttatacccaccatttgggctcccaggtagctatttaccaggtttctgaagaatgtatgaactagggtggacataaagaactaagatgggaacagaacttaagcctgagagctgactgggaattaaagcgactctggctcctgtatatctatcctctcactctctcacaagcccggtttccctggaggaggctgtataggcagagaaggctttggccaggctccacataggacctatgatcccttctcctcgcccccagtgaaatccttctacacctgctcagggcccctccaggctcgcttcttcttggaagcgtgccctgtgctagaataaatctctgcacaggcagggagacaagctatttggtcttgctgacccctgggcgggcactaggctccaagttggttcctccctcacccagataagccttttccaagcctccagcttcttgctgtggtgcaagatggtggggtggaggggcatctttgaggaggaggcagacaggtgggttctccaagggcaggaggggttcaaaggcatccccagagatggtgttaattagtaaccggctgcaagtttggctgttgccagactcgcctttctgggttgatcattgacccggcaggagttgaggagattaatagctaactagctgctgagcaggccctcaggaagccacactgcaggccacaccttggggcccagccccaggctagatgggcttgtagaagagagatggttgccctggctgtgccctgaggaaatcacaggttctgactgagcgggcctgcctggatcccaccactctggtttctaacttagtgctcccaagccccacttttagctccagcagttttaggtattcgtggctgccccactgattcagtgtggacaaccatagagtgcaatcctctgaaactctgttagtggttttgtggcagaacctccaaggacactatgttcctagatccctgtctgttgagtcagctctttacatagcgactttctagagaagagctgtcacctgtggacacgggagtagggatgccacggaaggacagacagatgccttgtccagagcagaacattgcaggtccacccagaatctgaagataccggagcccacccgaggctcctcagcagacttctgaggtcaggctaacctgctggctggcccctgtcccacaggttttgctggacagaactgtgaagaaaatgtggatgactgtccaggaaacaactgcaagaatgggggtgcctgtgtggacggcgtgaatacctacaattgccgctgcccaccggagtggacgggtatgtatatgggacttgtaggcagcagccttccactaacaaaactgcacaccgcggagtggtaggaaggtctgaactctgttccacgctatgaaagcccacactgcaagacccagggtggctggtagcatgggagcagcagcttctgtgcttccagttggagtcagcacagctcagcatcagatggttcttgtgagctattagcagctaacatccagagtcaggcccccagcactgagccatacaggagctagcattctgggcaagctaccagggatgaatacaaggttgtcctcagccccacagcccagagcacggagctcatcttgtagctgaggttgatgttcctgtgacccctcataggtcagtactgtacagaggatgtggacgaatgtcagctcatgcccaatgcctgccagaatggcggaacctgccacaacacacacggcggctacaactgtgtgtgtgtcaatgggtggactggcgaggactgcagtgagaacattgatgactgtgccagtgccgcctgtttccagggtgccacttgccacgaccgtgtggcttccttctactgtgaatgtccgcatgggcgcacaggtaagtcggtgcaggaatgtcctgggagaagggaaacttggttggctcaccacccctggtggaaacacctggggagccatgtatgagatatatatacagatatatgtgtgtatatacatatatatatatatatatatatatatatatatatatatatatcagatatagatacagctcagatgtagatacagggctggaaatgcagcacagttggtagagtggctgcctagcatgcacaggatactggactcaatccctaggaccacataaactgtgggtagtggcacgtgcctgtcaagccaactcccagggaagagtgaatccaaaggttaaggccatctttagctatatagcaaacttgagttcagcctggaatatgtgagaccctgttttaggaaagggatggggagagagaaagctctgtctctttggcacctccagcaatgacccagtaagccttgctggacagaggcatcctggtgatctgaactttgtgggatgcttgagtgagtcagagagattcattccagggtgttgggtgaggatggccctgctgcaacaacctgttaatcccaggatagggaaaagcagcacccactcaccgcagctgccttgtctaggtctgctgtgccacctcaacgatgcgtgcatcagcaacccctgcaacgagggctccaactgtgacaccaaccctgtcaacggcaaagccatctgcacctgcccctcggggtacacagggccagcctgcagccaggacgtggatgagtgtgctctgggtaggtacagatgcagtggcacaggcagcaggaacgggctggctgtcacatatatgggatgtgatctgtcctggagaaccaccattttgatggcctgggctggggcattgcgggtggtcgggaggctgcaaggccagatgagccctcatccgtgcctctttcaccaggtgccaacccttgtgagcacgcaggcaaatgcctcaacacactgggttcttttgagtgccagtgtctacagggctacacgggaccccgctgtgagattgatgttaatgagtgcatctccaacccatgtcagaatgatgccacttgcctggaccagattggggagttccaatgcatatgtatgccaggtatgtcttatgccatttcccaccatgggggctgctaagagcaggcagcaggggaatgagtcaaggctgcatagcttcaagtaacatttctgtcatggttggtagcatctgggaagccgaggccaggataacaggacaaagtggagaatgtacccagagttgggtgcatagactcagtagatatagacatgaaccacagtgggcacactaggcccgtatgagggagggttatttctctcccaagtcttcagctggggctctagaaggacctaccgaagccgtcctcggtctcaccatctcccgtccacaggttatgaaggtgtatactgtgaaatcaacacggatgagtgcgccagcagcccctgtctgcacaatggccactgcatggacaagatcaatgagttccaatgtcagtgccccaaaggtgaggccacctacttaccacaggacccgtatcctcatgatctcttcccagactcctttgagggaggacttgagttgactagggcgttttcaggctttcctcaaaaggtaaaggcccacgtgagcagtggacgctgtaggggacctggcaccggaaaccctttactaaaggagggaaggatgggcaggagctgcagcgctcctaagataggagagtccacctgcttggctctgtcctcttcctgatggtcatgggagtaaggacatagtgtggggatctgacctctatgcctgggaaggacttggaggaactgaagaggggaccaaagtcctgggaatctgtctcttgcctactccagggctggaccaggccttgggccttctgagatgtaaataagccatcctagacttggtccagctaggggagtcccattcacagcctagtgcagctgtaaccatagcaaccagagtctatttaggaaaaaggcccctctgttgggccaaggaggcagccactgagcagtgctaaacaaggagctgattagaggggcagggtgcaaggggcaggatataagggctggttgaagcctggaggttagtggcccctgttatcaaagtaccctctagggagcccatgtgagcagacattcaactctaaggtttgtgggtagcaaccaaggggttaggatactgtcagatataaccatctcgtcttccctggccacaggcttcaacgggcacctgtgccagtatgatgtggatgagtgtgccagcacaccatgcaagaacggtgccaagtgcctggatgggcccaacacctatacctgcgtgtgtacagaaggtacaagaggcagtgcaagatctgggggagggaactcttgaggctagatagtgctgagaaggggacaggaaactggggaggccttagtttggggccatataatctgagagtcagaaacttaactccgcttggactccaggcaggagtgatgagaacatccctgggtatgtgataccccacatccatcgatgaccaggcagtgatcctgggcctgctcggtggtttgccaaggtgtggccaactaagtgttgagggagtaactggccctgaagctcactaatgtccacctttcctgccatctaggttacacagggacccactgcgaagtggacattgacgagtgtgaccctgacccctgccactatggttcctgtaaggatggtgtggccacctttacctgcctgtgccagccaggctacacaggccatcactgtgagaccaacatcaatgagtgccacagccaaccgtgccgccatgggggcacctgccaggaccgtgacaactcctacctctgcttatgcctcaagggaaccacaggtgactggccggagctggcagtgggtggaaaagggtgaggccaggcttggaagctgaccacatgtcatgctgcccctagggcccaactgtgagatcaacctggatgactgcgccagcaacccctgtgactctggcacctgtctggacaagattgatggctacgaatgtgcctgtgaaccaggctacacaggtgagtggctgaaggcagaggtcagggtcatccctagagtctgggagggactgtggggctagccagggtccaagggctggatgtcacaagctgggtgtcaactacccagatcttgatctgccaaccagtagaggtatctatcataaagactgggtggcctccatatgcctcctttcccctgtcagtgtcagccctggccatgccagacttaaagccccagtagcctgaagtggggtggccagagctccgaggccaggcttttggatatgtgtttagatctgataaaatccttagtttctctgagcaccgaggacattgtccaccagaggatagaagaggatgggtggtctcaggctgaggtaaagctgggctgcagagtgactcagttggtaaggtgttgacctagcatgtgtaaaccctgggttcagtcctcctgccatgttaaccagatgcagtggcatgcatacgttgtaaccctagcactctgacattggaagcgagaggatcagaagtttaggtcattctcagctacatgtgagtttgtggccagactggatcacatgaggctcagaagctactggcactacggtcatgtaactcatcgatacataaggcactttactatcgctcaaagtttcatagattagcacaaggggaaacttagacccagctaggtctagctctaggaggggtaggctctgggtggcaggcctggaatctgagccccttcccacccacaggaagcatgtgtaacgtcaacattgacgaatgtgcgggcagcccctgccacaacgggggcacttgtgaggatggcatcgcgggcttcacttgccgctgccccgagggctaccatgaccccacgtgcctgtccgaggtcaacgagtgcaacagtaacccctgcatccacggagcttgccgggatggcctcaatgggtatggcagactgacctgggagggactagctgtagccttgggcagacacaggctgggtgaatgggtgctcctgtgagaccagtgatctgaggtcagcccctagtgtcttcccagcatccctgggctgtatcctcattggctagcatcagctcaggatatagactctaagcacactgtggctgctgaaacagttgtctgatactgtggtgacagcagccctttgtcagtgtgtgggggacgaggagattactaaggtctccgttaaaactattaaagttttatacagagggtcagcattgtcaaggtggcattgttccagtctggaacccttgcacggtcttgggccaggtgggtacctccagcccagtggatgatgtggccttgtcctcagactggaactgtagtttagcaggagagctctgagcccaggctacagctcaggcctctccgtaggtacaagtgtgactgtgcccctgggtggagtggaacaaactgtgacatcaacaacaacgagtgtgagtccaacccttgtgtcaacggtggcacctgcaaggacatgaccagtggttacgtatgcacctgccgagaaggcttcagtggtaagtgtggcgggtgacacagcagaatgggtcctccctttggtctctttctcggtccacctgatgagctagcatttctcaggcagagatcctagttctcttgaggaaaggcatagggcagaggctctggcccacctcctcttgctcaacttccttacaggccctaattgccagaccaacatcaacgaatgtgcctccaacccctgcctgaaccaggggacctgcattgatgatgtcgctggatacaagtgcaactgtcctctgccatatacaggtacgaacagccagggactggaattggctctggtggtagctagtggagctaagagtatatgggcttaccaggcactgaagaaggttctgttcctcgctgagggtcttaggtcctcagactggaactgtagttaagcaggaaggctctgagcccaggctacagcccaggcctcctgggcctggggatagtcaccagatgggcaaacacagaggatgcctaggaggaagctccaggccgtgtgtccgggtgtttatctggtatgtctggagtgaggtgagcactggactcctccagagaaagtctgggaggctgactggtaggtactgcatggatcagggtccactttgcctgtgcctctgggggccctggctgccctcctctgctggctgggcctgggattcctttgatggcagcttctttgtgtgaggagacaaggagccctctgttagatgaacagaggcagctcctgccatgggcactgcctgaggaatggcgagaaatagaccccctgcaggagagatgtgcattgaacatgaaagccgtgaccacatggcccccaaccctgcagctcccaatactgccacagagtactggtggcttcatgctgctgctgctaggttctggacatagcaagtgggtctgtgaaggtggaggcccttccagtgttcctatgatgcctggcaggatgctgttttctttgacaaagttaaagggcctggattttgtctcctgtgttggtcagtgaggaaactgtcagcagccaggcacaccccatgttccttttggtcttgctgctatcggggctagcgggaggagtcaagccgcgctgaccagcttcctgcttccctttgcacaattgtcggaaactctgtcaaagttcctgtctgcccaggtcaccgtggaaaccgatagagagagaggccctggagagtctcaccagtgggctggggacatggtgggagacaaggaagataaggtttccttgcttagctcctggagccaaccatggccataaacaggaaagctaactgggattgcaaggagagtcacctgggttactcgtggctcccccaagcggttatcagatttcactgccctagtgtgaggctgcaccccatgttccccaagtaggatatgcttggggtagccacagtagctctgtctcaggagtgagcctgctgtgacctaaagcttcagaatcagctcaaggattttcctggaatggggagcaggccaggttcctccaggctcaaccacctgttatagtagggtcttgttttgaggttttctggttgggcaaggcccaggcttcatcgtggagcatttgggagatgagagatggcttccgggactacatagatggctcatggagaaagagtgcttgtggaaacatgaagcctgtttcatgaaaacagggtacctctaaatgcccataaccccaacatttgggagcagagacatcttgagagctctctggctggccagcctagctaagatggcaaagcatctgattcagtgagactctgtctcaaaggaataagatgcggggttggtagaggacacctgatatccgtctctccttctgcatacactcttacacacctgcatgcaatatactatgctcgttaaaaaaaaaaaaaagtgacttaagagagaaacttgattctgctttatctctaacctcctgtcagtaatcgtcattcctcccgggatcagagtctggctggccaatcatacagcatctcctatacctaccccccgcccccctttatggaagaccctatgggccaggctcactgggttctatcttctacaaatctttctttctaggagccacgtgtgaggtggtgttggccccatgtgctaccagcccctgcaaaaacagcggggtatgcaaggagtctgaagactatgagagtttttcctgtgtctgtcccacaggctggcaaggtgaggcttgcctggtcccaccaggctgggacaaggatggtggatgggaagtcaggggccctggccagcctgtggggcagtctcgagaaaggagcccatcaatgctgagctacctgctctgggaagctctgggaagctctgggaagctctgggagcaggagatggtccttcccattccaactccatatccttctgttgcccagaggtcaggggagaagctctggagataaacagaccagctaggacagaggctcagagggtgggggcaggtaaccaaatgagttttttgtcttcacaggtcaaacctgcgaggttgacatcaatgagtgtgtgaaaagcccatgtcgccatggggcctcctgccagaacaccaatggcagctaccgctgcctctgccaggccggctatacaggtcgcaactgtgagagtgacatcgaatgactgccgccccagtaagtggtacccagctctgtccatcctatgtttgggtgcctctgttcctaagcacacatgacagggagctgctgagagtctgaggtggaaaatagccctggtgcccggcagtcatgaaggactgtggatagctgtgccctcagcttagtccacttgcctgtgccttaaaaagagacaggccagaggctagacaggccaggaggaggctgttgagcatcagtgtgtgcttctcacgggctttgctgctagatttcccagcccagttgagtgatatggagcagaggcaccaggcacttcaaaatgatggcatggggcctagttgtattcaaccttgacactcggcccttgtcaggacccattgagttgtgtagggctttagagatgccctgcatcctgagtcaaagctaaaggcagagagagattgagggaggttctgcctggcaccatcagtgtgtgtgtaggggaatgggcttccctatgactgccttgggcctgagggaaaaagtgtatgcggagcagattccaggctcagtgctgggatgggcccctgttgactactgtcatcaaggcttgctgtgagcacttgccaccccataccaccttctcagcatcaggtccccgaagcatggccagtggccacctaaggctcatctttctgtccctccagacccgtgtcacaatgggggttcctgcaccgatggcatcaacacagccttctgcgactgcctgcccggcttccagggtgccttctgtgaggaggacatcaatgaatgtgccagcaatccctgccaaaatggtgccaattgcactgactgtgtggacagctacacatgtacctgccccgtgggcttcaatggcatccactgcgagaacaacacacctgactgtactgagaggtgggtcccagcctcagctgagacagggaaagaaatggactgtggaagacacaaagtcttgacagcatggcatctcaagctggtgtcttgcccagacccagtgggcatacagcactaattgaactgaatccagcgttgttcattatgttgcagtatccctcctaaaggggcctttgtgacctccagtgacttagaacaaggaagtttgtgcagaggaattggggaactagcctcctatcaaacaagagctttgtaatctgtcttagttccccttttgccctggttgccaggaagcttagagttaaatcaatctcaagcctggtttgtgatgcgcttcctatagtgttcctattttgcccttgattttgtttttctcaaccaccacgtgtctatatgctataaaatctctgctcgtgatttgggtattgtggccaggtaggcatggagttgtctctcctggcaaggaccttagggaactcctcactcttccctgcttctcatctgcctctagctcctgcttcaatggtggtacctgtgtggatggtatcaactccttcacctgtctgtgtccacctggcttcacgggcagctactgtcagtatgatgtcaatgagtgtgattcacggccctgtctgcacggtggtacctgccaagacagctatggtacttataagtgtacctgcccacagggctacactggtctcaactgccaggtgagctgaggttacagggtatgacccagaaggcctagggctctccagtgcccattgcccagccctgggccacactaccttcagagggccagggacacagaagcagagaggctccctggtgtcatcattggttgatgagccagaatgaacccacatcctctgggaaaatgccaagttgggtgcttctgagggagacaggtgggcatgggtgccagccaggctcttctgtggagtgcattatgtggccatctgtctgaagcagcctggggcagtgctcacttctggtggaggatgtccaaggggaggtagccagtgggttgtggagagccttgaaagagagcaaggaagacgtggagcccaggcctatgttgttcggagggcgggcagtgtttgtgagtcctgtgcctgggatttcttaggtgatattctttctgagatggtgggggtgggggtggggaagtcagagcataaaatgccttattccagtggcgctcagcctgtgggtcatgaccccaataggggtcatatatcagatatcctgcatatttttgctacatgacagtagcaaaattacagttatgaagaagcaatgaaataattttatggttggaggtcaccacaacacgaggaactatattaaaagactgcagcattaggaaggctgagaactgctgtgcttctcagagccagccaggaccagggcaggagggtgccctagcagtcagagttggtcagggagaagctaaccagcgcctgtctcctcagaaccttgtgcgctggtgcgactcggctccctgcaagaatggtggcaggtgctggcagaccaacacgcagtaccactgtgagtgccgcagcggctggactggcgtcaactgcgacgtgctcagtgtgtcctgtgaggtggctgcacagaagcgaggtaaccaaccggccgggcccacctgtccttgctcaggctcagcttaggccaggagtgccccggtgcctgccaggtcaggtgacaatgggcagtagtcccgagaatcggagcccaggcctcagctccttcccgtcttgtccccacaggcattgacgtcactctcctgtgccagcatggagggctctgtgtggatgagggagataaacattactgccactgccaggcaggctacacgggcagctactgtgaggacgaggtggacgagtgctcacctaacccctgccagaatggagctacctgcactgactatctcggcggcttttcctgcaaggtgtgggccgtcatggggtggcggggagggtatcagcgtgagtgttgctgcaggggagggcttttgactgggagctagtgcatcatggcagactgagcacatacctgtgcaggatccggtcacattacagatgtgctgaaggaggagaactatgccaagcagtggcttagggcacccctttcctatatggtttcatggtacctaatacctgctccaagacctcatccctgggggaccaggtgttgccccacacacacacaccttggacacttattttaacttactggggtctactgggtggagccctcgctgcagggtgggacagtgtagtctaactgggtatatggcctgcatggcaagtggaggacatgataccacaaccccagctaagctgtgacctgtgccatttctacagtgtgtggctggctaccatgggtctaactgctccgaggagatcaacgagtgcctgtcccagccctgccagaatgggggtacctgcattgatctgaccaactcctacaagtgttcctgcccccgggggacacagggtaagggtagggacctggatgatgggcaggatccagccagagatcactcaggtgattgagagctgaccacggaataggaatctcagaagggaggtgggctccagtggcactgtgctgcctcccccgggccccaggtcctaactgatttctggactgggctgcacaggacagagcacagtcagcatcatccgacggtgtctctggtcactctgcaggtgtacactgtgagatcaatgttgatgactgccatcccccccttgaccctgcctcccgaagccccaagtgcttcaacaatggcacctgtgtggaccaggtgggtggctatacctgcacctgcccaccaggcttcgtcggggagcggtgtgagggtgatgtcaatgaatgtctctccaacccctgtgacccacgtggcacccagaactgtgtgcagcgtgttaatgacttccactgcgagtgccgggctggccacactggtgcgtgccttgggcaggtgggtcgaacgggtgggtgggcagggtcaacagggatggctccttactgtcccttcttcacacaggacgccgctgtgagtcagtcatcaatggctgcaggggcaaaccttgcaagaatgggggtgtctgtgccgtggcctccaacaccgcccgtggattcatctgtaggtgccctgcggtaggtgtccctggccctgtgcggctgcaagggtgccaggtctgagggtgcctgaaccctgaccgactcttatggtggatctgtcctccacccaccctcactgtgaatagtcagcctgaagacctctagcagaggctagggtccaagccacatgcttcctcgtgtccattccccagctcgtttataaaacccgagcgggcacgatccatacatgccttgctcccagtgctctgcagcctcaggctgaaagattgccttgtatttgaggtaccttaggcttcacaacaagaccctgtttaaaaagtttatttcctgctgtgctatgttgggaacctcacacatgctgggcaagtgttttgccactgtgtcttagcccaattttttaaatagatgtttattttagagcggttttaggtttgcatgagaacttagcaagagggccaggtccccaccctgcaggccgttccctatgtttgctgccttgcgtggaaggtgttgagctggcactaatatgcagtatttgctcttgggtgttgacatccagggatctgtacacatacaatgtaccagcatcagccttgggtttcatggctctaaaaactcctagggttctccccattcacctatccctccagtttgaagcccttggcaaccctgaccatcctatggtgagatgtttcaagggtcttgttattggggcaaggccatagacacctttcacaggccacagactggggccaggtctttgctggggtgtgcatggtgtccctgattgaatgcaccatcctctctccaccacagggcttcgagggtgccacatgtgagaatgatgcccgcacttgtggcagcttacgctgcctcaacggtggtacatgcatctcgggcccacgtagtcccacctgcctatgcctgggatccttcaccggccctgagtgccagttcccagccagcagcccctgtgtgggtagcaacccctgctacaatcagggcacctgtgagcccacatccgagaaccctttctaccgctgtctatgccctgccaaattcaacgggctactgtgccacatcctggactacagcttcacaggtggcgctgggcgcgacattcccccaccgcagattgaggaggcctgtgagctgcctgagtgccaggtggatgcaggcaataaggtctgcaacctgcagtgtaataatcacgcatgtggctgggatggtggcgactgctccctcaacttcaatgacccctggaagaactgcacgcagtctctacagtgctggaagtattttagcgacggccactgtgacagccagtgcaactcggccggctgcctctttgatggcttcgactgccagctcaccgagggacagtgcaagtaagtaaggctgagtttctttagagtcccagggctcaggatgctacgggaggacctaaccaaacaccaggctcctgaagccaatgtctatccctgcccattgcgagtcgccaagcacatttcccagatctggcctattcaaggtatgggtttgaggtccacaggctgggatgggactgagtgcatcctatacctcctcagccccctgtatgaccagtactgcaaggaccacttcagtgatggccactgcgaccagggctgtaacagtgccgaatgtgagtgggatggcctagactgtgctgagcatgtacccgagcggctggcagccggcaccctggtgctggtggtgctgcttccacccgaccagctacggaacaactccttccactttctgcgggagctcagccacgtgctgcacaccaacgtggtcttcaagcgtgatgcgcaaggccagcagatgatcttcccgtactatggccacgaggaagagctgcgcaagcacccaatcaagcgctctacagtgggttgggccacctcttcactgcttcctggtaccagtggtgggcgccagcgcagggagctggaccccatggacatccgtgggtgagtgctccagctcctgctgttgtgggctgtttcccagtgtgtccctgggttctctaaccagcttaaccctggaggtgtaacctcaggggaggtagtattcaccttattttatagtcagaaagcacctgggatgaagagggcatccctctgatgaggacttggcaggcctcagggtttgcccagatgtgattttcaggccccactgtgtaccaggtgttggagaccaagctgattaaagcctccagggtgtcccctggggctaagtcatcctagaccaatcctgaccctcagtcactacagcccttatccctactacagaggaggcagtgaggggtacagaagggcactgttgctgagcctggaaggctgaggagccgagggaggcacaaataagagcatctcctggatgctgcacagagccatctggggatgggcagggaagcaccagccaggcatttggaggttccaggagccttcgctgttgggcatctgcctggtggcacctcagtgtctcctgaccccagtggttcctggtcctggttttcttgtcgtgggactgtggtgaaggtcagaaattaattgtttcctggaggctgttagaatcctgtttctgagaggccagtgactgagagttggtgacttggctggcatgagagagctgactctctggcatctgagcctgctgtcacctcaagctacaccatagggagtcacaactgcatccttgcagttctgtggggccccaggcactgctctcaagagggcattggatgcctaaagactattctttgaagtaaggaaaaggggtgctgtgcacctaaggggcaaggctagacagtggaatgacccccgctgagtgctaaacactggggcagcagggagagtgtcccattgcggggctgtcgtctgataagccctgtgggtcagggtgatgggctagggagtcagagctggtgtgtaggcagtgtactggggtgtatctaatctcactgtgccatgtgtgttctcagctccattgtctacctggagatcgacaaccggcaatgtgtgcagtcatcctcgcagtgcttccagagtgccaccgatgtggctgccttcctaggtgctcttgcgtcacttggcagcctcaatattccttacaagattgaggccgtgaagagtgagtaatcaggggctggagggatggctcggtggttaagagcactggctgctcttgcagaggacaagggttcaaatcccagcacccacgcagcatcttataactatgtgtaactctaattccagggcatccaacactttctgacctctgcaggcaccaggcatgcacagggtcctgacgtacatgcaggcaaaacacccatacacattacatattttttaaatgagttccctaccccgaccagccctgcctcttcagggatgggttcattgggtggcgggtcacaggcaggcggtctctcactccttgtgccagctgccattcccagctcaggaagtgcttttctggaatttttttccaaggccttccctccctgtggctagtgggagccgtaagtaaaagctgtcccctaagatgtatacatataccagaaagtatggaggagtctttcttctctcctcattctttacccctgatttttctttgttggatattatttcaaaatcattactagagtttttttgtgtgtgttattttttttaagagagagagagaattgatcggtgtcatgtgaagtgttgaagtttgtatcttgaaaatccccctaaatcctttgtcttaacagctcaatgcgagcgcagtgatttgaagttcgctaatcctccttctcgaaaggggagaagtgagcactgtctccagacagatcagctggtgcaggagagaatttagcgatagtttgcaattctgattaatcacgtagaaaatgaccttattttggggggtgggatggaggagagtgggtgaggaggcaccggccgtggagccagtcctccgccccccgccagcccacagcatcaccacgcctgacgaggggtgcttgcctgccgcccctgcccgcaggtgagccggtggagcctccgctgccctcgcagctgcacctcatgtacgtggcagcggccgccttcgtgctcctgttctttgtgggctgtggggtgctgctgtcccgcaagcgccggcggcagcatggccagctctggttccctgagggtttcaaagtgtcagaggccagcaagaagaagcggagagagcccctcggcgaggactcagtcggcctcaagtgagtggacactgctcccactgtgtgtgggtgagtgagtggcagggttggtgggggtgcttagctccagaaggcccatgggcccatccatccctgtccgttaccctaagcccttctgcatgtagaggatgcccatatgagctgtggcttcagggcatctcctggagtacctgctcagtctccctacccccatacccaggcccctgaagaatgcctcagatggtgctctgatggacgacaatcagaacgagtggggagacgaagacctggagaccaagaagttccgggtgagtcccgcaggctcccaagccccccctgggtggcacctcctgccttggccccaagtgatgaggctctgcttactctgtccacactcagtttgaggagccagtagttctccctgacctgagtgatcagactgaccacaggcagtggacccagcagcacctggacgctgctgacctgcgcatgtctgccatggccccaacaccgcctcagggggaggtggatgctgactgcatggatgtcaatgttcgaggaccaggtaaggccactggagacacatgcacacattccctagcatagacttaagaggccagtaggacttgaggagggctgggtcactgaagggctctgccagagcagcatcctgccctgagctgatcgtctggctcctcctgcccacacagtatactttttcatgaaatgctgctttgcaatagtcaaagtgttaatttttttttttttttttggtctcagtttttagtatgctgggattataggtgtgtccccatgcccagctaaagtgttgacttttaaaattatatgcatataggtgtatataaagatatcttttattttatgtgcatggttctgcctacatatatgtctgtgtagtgtttagatacccagtgcctgtggggagcctgaagaggccattggatcccctgaagctgcagttacagatggtagtgagcagctatatgggtactagggattgaactcaggtcctctggaagagaagccagtgctcttaaccactgagccatctctgcagcccttattttatgttttaaagcatttcttcatttgagtgtaaggggcacacatgtgccatagtacacacgtggaggtcagaggactacttgtatgagtgtgggttctctccttctaccatgttggtcccagagtgccttccagggaggcagcactgcatccctggggacttcatccggggtcccttaaactgcaggactgcctgccagggctatggttgaatgttgaccctccctgaggctgacaccatccttcccacacctacccttgtttctgtcctctctgcagatggcttcacacccctcatgattgcctcctgcagtggagggggccttgagacaggcaacagtgaagaagaagaagatgcacctgctgtcatctctgacttcatctaccagggcgccagcttgcacaaccagacagaccgcaccggggagaccgccttgcacttggctgcccgatactctcgttcagatgctgcaaagcgcttgctggaggccagtgcagatgccaacatccaggacaacatgggccgtactccgttacatgcagcagtttctgcagatgctcagggtgtcttccaggtacgcagcactgcatccttggagccagtgacctcatcaggtctgactggcatggaccctgcaatctctaattccaagtgtgactgggcagggaaacttggcacctccacactgcattttgaaggaagtccaggtacaaagggcatcaagtcccacctgtgttctctgagcaggctggctgaaggtggtcttgcggaacctacagggtgaggcagggcctccttactctcagtaaaaccctcccaatctcaaggctatggccttgacttgaggtctccacctccgtgctaaaacctttgcagactaaccctaccccattcagctgtggctgcaggcatagcccatggcggcagaaagagagctttagaggctgctggtcctggcctgcaaagctatctcctggctttgcctagaagcctggagccagcctgggtggatttaaggatttagctgcctgggtctgcagggaccaaccctagtagttgctcctgcatgttgccagccagtgacccctgctaccagacctgtcctctaggcggccctggagcaaactccaatggggaatagaccaggcatcaaaaagcttgtcatttaatcatttcttaacttgaaccacactttgtcggtctgtagaagaaattaaacaagacagggcaatgtacaccttttatcccagcactctagaatctgagaggattgtgagcatgaggctagcctggtcttcatagaaagaccctatttcaaaatagcaaagagaggttgagaccagccacaggttatgttgactgcctggtgtacagctctccacatggcctgccttgcttgcatagacagatgtgtgtacgttttgtaggaatccaggcagtgctgtgaatccttacccaggtcaccaacccactccctcctctcaccttaacagttccaagtacggctatgggccatgagcgggattcctagcctggttactctcccctctctcccccatgctatgcagtttgatttcctcaacctggaggtagttctggcaaccataaccaaaagatgaggtcccagtagatcccccactgtcactagggactgggtaagagccccagctcttgcacatggaatgtagctcctgccttcctcaggggctcagctgagcccagtccaggcattggtttctggagatacaggcttgcatttagatcaccctgcctgaacccatccctgccttccagatcctgctccggaacagggccacagatctggatgcccgaatgcatgatggcacaactccactgatcctggctgcgcgcctggccgtggagggcatgctggaggacctcatcaactcacatgctgacgtcaatgccgtggatgacctaggtaggcccgagctacagcccagctaccgaggacatcagccagtgcctggtctgctcagccccaacccactctctcctctctttgcttcctttccaggcaagtcggctttgcattgggcggccgcggtgaacaatgtggatgctgctgttgtgctcctgaagaacggagccaacaaggacatgcagaacaacaaggtaagcagacgggctgcttaaccgcaggcgcatgatggggactccggggcacccatacgttgaccacttagaggtttaagagtgtctgggacaacagcagcctaaaataacccgtgctcttgctggagaggagctgaggcgtaagcagctgtcccatgtcacggttacttgagccttgccttctgtccccttctgtccctggtggctgtggtgaccctaggggttcaggattggccaaggggcagggatggggtggccctgtctcttaaggcctgcaaggcttctggcttggtccaccactaccatgctccctcctttgggataagaaaactgctgagctgggctgcgtgtctccacctcgcctcccagtgtctctgtttgtgcagggctagttgcttcatcaggactctgcttagttgctcacagggcagagtttgtgcctcccttaccagctccactgcaggctgggaaatggagcaggagtcaggtacctggagttgctgttgggcacaggttctccacagtccagggtgggccagtggttatagagaatccaagcctgatagacattctgttgtggtgtatgattatgtctgctggacagagcagacctggaaggagctgagatgccctagccactggtgaccctttggcatggtagtaccttccccatggccattcacttgccttaaaggtccctgagtcccaggattgcagtacttgtgcctgcattttggggaggaaagcaaagggcacacagttacattctgttttcggcagtctgactccacacaggggaagaagccctatgtatttatcccacagatctctggggtgtgaggtgttaaatctaggttctctaaaaaaagaactcgggaccagccatgtgtgcgtgctagcaccgagaagctgaggcaggacgatactgagttccaagtacggctgtgggccctgagtgagattcctagcaacataggaaggccccactataaatactctctgagcctggtggtctaggatgcttgggtctagatagatctctccagataagagaagagaaagaggcagcacctgcttccctagcccctccccccaggccatccatcatcaatgactcagcaaattctacacctgcccgctccctcatgtacctcctgtccgtgtcctacaggaggagactcccctgttcctggccgcccgtgagggcagctatgagactgccaaagtgttgctggaccactttgccaaccgggacatcacggatcacatggaccgattgccgcgggacatcgcacaggagcgtatgcaccacgatatcgtgcggcttttggatgagtacaacctggtgcgcagcccacagctgcatggcactgccctgggtggcacacccactctgtctcccacactctgctcgcccaatggctacctgggcaatctcaagtctgccacacagggcaagaaggcccgcaagcccagcaccaaagggctggcttgtggtagcaaggaagctaaggacctcaaggcacggaggaagaagtcccaggatggcaagggctgcctgttggacagctcgagcatgctgtcgcctgtggactccctcgagtcaccccatggctacttgtcagatgtggcctcgccacccctcctcccctccccattccagcagtctccatccatgcctctcagccacctgcctggtatgcctgacactcacctgggcatcagccacttgaatgtggcagccaagcctgagatggcagcactggctggaggtagccggttggcctttgagccacccccgccacgcctctcccacctgcctgtagcctccagtgccagcacagtgctgagtaccaatggcacgggggctatgaatttcaccgtgggtgcaccggcaagcttgaatggccagtgtgagtggcttccccggctccagaatggcatggtgcccagccagtacaacccactacggccgggtgtgacgccgggcacactgagcacacaggcagctggcctccagcatagcatgatggggccactacacagcagcctctccaccaataccttgtccccgattatttaccagggcctgcccaacacacggctggcaacacagcctcacctggtgcagacccagcaggtgcagccacagaacttacagctccagcctcagaacctgcagccaccatcacagccacacctcagtgtgagctcggcagccaatgggcacctgggccggagcttcttgagtggggagcccagtcaggcagatgtacaaccgctgggccccagcagtctgcctgtgcacaccattctgccccaggaaagccaggccctgcccacatcactgccatcctccatggtcccacccatgaccactacccagttcctgacccctccttcccagcacagttactcctcctcccctgtggacaacacccccagccaccagctgcaggtgccagagcaccccttcctcaccccatcccctgagtcccctgaccagtggtccagctcctccccgcattccaacatctctgattggtccgagggcatctccagcccgcccaccaccatgccgtcccagatcacccacattccagaggcatttaaataaacagagatgtgggatgcaggaccccagcttccgttcccaagccctgttgggagtcctttccagtgcttcaggatgctggggcgaccaaaggagccttttaaaaaatgtttttatacaaaataagaggacaagaatttccattttttttttttagtatttatttatgtacttttattttccacagaaacactgcctttttatttatatgtattgttttctatggcactagggaaaaacatatctgttccaagaaaataaactagttctcagagccttgattttcctggtcagggtgaagttccctgtgtgtctgtaaaatatgaacaaggattcatgatttgtaaatgctgtttatttattgattgcttctttccaaaatcgaaaagaaagaaaaaagaacgtgacaggagaagggaagctggaaactgccatggccagaattgcccctcccccacactcactgcccctccccccagcgtcacctgggatttgcagatgtgtttagaaacacgcccagaccttgaaccttgggttcatggattagttttgtatctaaaacaggaaacaagtcagatgatgtggtttgtacactttctgtaaccaccagtgtggacttgaagaagtgtcctcagcatgtgcagagtctactacccagtaccagtcgtgagtctgcaggctccagtgttctgtagtagtgtttatgggccttgggagtacttctcccctgccctgccccactgtccccttcctgacaacttgagccagtaagccatgcagggtgtggtgcctcctagagaaaacactgcctggactgttctgtgcatccctccaaacagcatcatccaaatccaactgaggacagacggactgtcccggcctgggcctgggctcctaacacctgactgccaaagggctccaatgtgcattgtggactcgccagagtagcctgcattgagactccaagaaaacagaagctatgtggcctctgatccccaaactggcctgggtggggacatgccttgagtgtgctggaatgtgggtggagcctgcttctgggccacccctcctggttcagggctgtgctcacagcagattcttgcagtatcaagtatacgcctgtggcagaataagtatctgtaaatacatgtttaaagatggattttgtttaaaaaatctaaaggaacaagtgtgtcgtgtgtcaagctgatgaggactgtcagactgtggcttagctcagtgtgacccagaccttgtgacctgtagctgccgaaccagtagctcctaagagcacaacccaggatggcccatctgctgcccaccaagtccctttccagccactgtgtgctgggggctttcgggggcagttgcccacctcctcagggcagctctttctggccttttggggggcagtgtctgtgccatgcctaatagatatgaccagacgcatcctaagatgttgattcttactgtgttgtataaaataaagtgtagtttacaaaaaaaagaaacgtaaaaaaaaaaaactacatgcaaaactgtaggtaatgaaaatgatgtatttttttcatctttttttgttaactaatttgcaataaaaatgatactgatggttgtccacattttgctaaacttggagtgtggtttggttcactttttggggagtgtgacagagaaagggccacccagcactgaaataaccaaatccaaaccctctcttacacagaaatacagaggttgccataaggacacaccattttcagaagctgcacagcgcagggcatcaaggtgggaagacagtttccaaaagagttgatgcagtcctctcagggatgtggatctgattgatgccagctgtattcctgtgagcagcagaggagtgaaggcaccttatgttgtcatagatgactatcctctgagcccagtaacccccaacctcttcaaattcagccatgccttgcaaaaggtcatcccagctgtgcttgttgactgcttatagaccccctcaaagagttgggaaggtcatgggactcaaaggacccttgcctgatgatccagtcactttgttgtatgcagtcctgccctaattgtgcatgacctcagggaggtactagagtatatagtctgggaagactagtggagagactccatctatgtggctgtgaggaaagccttatccctgctgggtaaatgttgtattaatattcatttaataaaggctgggcgtggtggcacacgcctttaatcctagcactcaggaggcagaggcaggtggatttatgagttcgaggccagcctggtctacagagtgagttccaggacagccagggctatacagagaaaccctgtctcgaaaaaccaaaaaaaaaaaaaaaaaaaaaaaaaaaaaattcatttaataaatcctggcagcaggtcactatccaactcaatggtttatgaaagacacacaacctttctttatattttattatgtcttattcagcacaatagctgggtagctgcctagcctccatattgctaagactctgtctccccattctgaattcctgcttactaattctatgttctatcgtggctgatctagaccaagttgggcagccttataggccatgctctcccagctccttcaggtggtagccttgcctctctgtcctgcactcttcccaggcatggcatctctcctctccccaactctcccttctcccactgcctcaagtctcaagcccaggagtcctaaacggtccaccttgtctgtcctccccagctactggctattggtatctttatttaccaatcagaacccactggggacaggttcccaaaagctatgtgtagaccttcctgtgcagttcgggggaacattaacatttgtaatacaaacagctacaagtaaagagttccaatgtggactcagtaagtaaccctttacctatgttctgctcttgtcagcgctgcaaatccattggtgccctagtcagctttggtgcctaggaccttaggaggagggttaagtgttgtctcttcctgggaaggaattttagcaacactcatctagtccgagagcccagcaggtacaaaggcatcttagccctaagaagaaatcataatagcacaggtgtggatctcccttggcctgctgtactggctagttttgtgtcaacttgacacagctggagttatcacaaagaaaggagtttcagttggggaaatgcctccacgagatccagctgtaaggcattttctcttagtgatcaaggggggaagggccctttgtgggtggtaccatctctgggctggtagtcttgggttctataagagagcaagctgagcaagccaggggaaccaagccagtaaagaacatccctccatggcctctgcatcagttcctgctccctgacctgcttgagttccagtcctgacttccttggtgatgaacagcagtatggaagtgtaagccgaataaaccctttcctccccaacttgtttcttgctcatgatgtttgtgcaggaatagaaaccctgactaagacacctgcctaggcctctccatttggcccacaccttggagcacagcaggagtctctaaccaaagtgacaatggggaatgtgatgccctctctgagcctgacatctgaggacaagtgtgaatccatcaagttcagatgtcttgccccggctcagtgttgcacactgtgaaagcggagggggcccaggggcccagaaggggtgctcacacacagaattgtgataacttgtctcattcttgccctcaaggggaaggtcggagcctgaattctgcccggagaactagcatctccaaaattccatccggaatggaaatgtcagctcggaaagggcttagcaggctcatatgcctgggtgttctctagagcatcatccacaatggcatgtgcagcccagggttcacaactgatggctggaccactgagaacacatctggactgggttcggggtgaaaaacattgatgtttgcagatcaaagcaagggcctacccatgtgggcaaatcttctccagtgagagaccaaacaacaaaaggtcagggaagaggggatggatcctgcctactgcggcagaacatgaatcctctcccctccaggctcccacggaaagattgcctgttcttgggtctccagcttgccaggtacagctctggggacttgccaaccccacaacctctctttgtatctaccctagtaaacattcagtggagtatttttcagccattagaaggaacaaagctctgagacctactaacatgtgggtgagctgcaggaggacacagggctcgtgaaagacatctcaaaaatgaccacatgatttcatctttatgaaatgtcctcagtaagtaaagccacaaagacagagaacagagtggccattcctgggtccagggaaatgggtatgactgacaatgcctatacatttgactttgcatggatagtccagcactgtgtacgtctaaggcagaaggctgcatggcactgtgaaggtcccagacccgtcaatgctagaattccacaatctgtgagtctactaaaactagcaaaaaaaaaaaaaaaaaaaaaatccaagcaaaatgggaactttcagaaatttgtcccatggacacaacaagttctcttttattttgtgacaggatcttgctgggtatcccaggttggcctcaatctcaccatcctcctgcctcaatctcccaagtgttgggattctaggtgtgtaccacgccacccacttaaacctagtactcttaaggagcatctatctgcccctaaaagccactggaaataaataaaacatgtaaaacaatatttttaaagggctaaagatgtagcctagtagtagagggtttgtttactctgtgcaaggctctggatttcatccccaggaccaaataaagtaatcaataaattggcttgagacaaccttcaataaattccttgttctatgaacctgagctcctcattttgagtcatgtaaaaaagttgggtatgatcatgtgctgtaatcccagcatctgtgagatggggaggtagagatcggtagagtcctacttagcttttgtctaatcagtgagtcgcaggtcccagtgagagaccttgtctcaaaaactaaaaacaaaaaggccgaggactggggagatggctcagatagtaaaaattcctactgcactagcacaaagacctgagtttggaatctccagcatccacatgctgtcctggaatgaccatacatctgtaatcctgtgctggggtggggagggagacaagatcctggagcaccacttgcctagccaatgatcaatcaagcactaggtccagtgagagagaccctgccccaaaaaccaggatggagtcaggcattgtggcacatgtttaaccccaacattcaggagacagaggcccagggctaaaatagtctctgtctcaaaaacaaactaaaaaaccaagctgagaatgagaatgataccttctggcttccacatgccatatatacatatacatgctcacacgcacaggcacacacatatgcacagtgtaaggactaaattgggcacccagcagctagacagcccagagagaaaatagagtcttgcagcctcagccttcctttgtttaggggggattacaggacagtgggccctgctgtctctcaacagaaatactccaggaccaaatcccaagcagacagaggtatggagatgagctctgtgtcatacacacactgaagatggtcatatacagacatgggagcagaggcaactgagtggtcttggagcaacttgccctgtggtacccggtcacagacctccaggacaaggaaattcctgtgaaatccaactggtgtggggctgtttacacagcaacctggatagattgatccagtctcgggctgaggtgatgtcttggatgccgaaatctctcagggacacaggccagttcagttccctaggtactgcctttcccccacaatgaaatgccatctgtgctggctagctgtaacacatcaacttgacacacaaactacagagttatctgagaggaagaaaccataattgagaaaatgccactgtaagatctggctgtaagacattttcttaattagtgattgatggaggagggccagcttatggtcctgagttctataagaaagtaggctgagcaagccatgggaaacaagccaataagcagcacccctccatgacctctgtctgtatcagcttctgcctctaggatcctgccctgagttcctgtcctgactttcttcagtgatgaacagtgctgtcaaagtgtaagcctaagaactcctttcccctccaacttgttttttggtcgttgtttcatcacagcaataaaaaccttaactaagacaccaccactccccagggatctgccatcttgtaatgtttttgtttgttttcaatttagaagaatagttattatgtatatactactagagggcagtgagttaggcagtagtgagtaagcaggggcacactacgtcctctggctggctgaaccttgtgatccttctgcctcagcctcctgagttctaggattgcaggtatgccccaccaggcttgactttaagtcctacttttcaacattcaagtatgtaagtagttccagacaagtatggtaaatccaacactctagaggctgaggcaggaggactgccataagttcaaggccagcctgagttatatagctaacttctgtttcaaaaataacaaaagcagatataaataacccgagaacagcctggtggtggtgttgcacacccttaatcccagcactcaggaggcaggcggaggtaaatttcttgagttccaggccagcctggtctacagagtgagtttcaggacagccagggctacaaggagaaaccctgtctcaaaaaactgaaaccaaaccaaatagcaacaaaaacaaacccaagaactagttctcttcctgtcccaagtgtccttcgctccactgtctgtgtatatcttcagtatgagagagaagggcttccttagcctcctggggtcattcagagaagcccattccaatagaaataagacggaaaccacataggtcattcaaagtacttcataacccttaaaaaggtcaaaggagcaggtgaatttatttcaatactacatcttggttcgtccaatgaaaccacagttaccacttaactagcagtcaacacaagcgaagtatgaaaaggacagagttgacattctttgtattattatttgtatttatttgcttatgtatatgtgtgctaacacatgccatacatgtagaggtcagaggacaagtgatgagagccagtctctccctctaccatgtgggtcctagggactgaacctgggttgtcctccttggcagcaggcacccttacccactgtgccagctcacctgcattatcaccatctgcactggccatgctgaaggtgcttagaggccacacatggtcaaaatgtcatcccagacaggctaatctccaccagcacagataaacaacccatggagccagatgtagtactgggagcactggggggcgaaggggaggacggtaaaggcaggaggttcaggagttctaagccagatcctgtctataaagatgtaagcaaaggaataaagaaggtgaggggagagactgctatgctggtgttgtttcttgtcaaaggaggcaccaaatgtggctctgcattgctttgtccagcacaaagagggacccaagggtattagtgccataaacccagccaaagcagcagggttatgcctacaatcaaaagtgatggagtgctgctgtccttctgagactccgggaaccagccagccatgagtcttgcaaagtttgctatcagggacactctatggggagatttttactatgtgactccagaccccaccctgtggagctgtggagacccaggccaatcctcagctgcatacgagttaggaaacagggctcttttactacagtatcctcaagcccgactgagctatgtgtactgtggatttcgaaaggtttgtgtggagcttctccagagaatccctctgttttgaagatcaaggacagggatgctgctctctccacctgcactttaaagatgatgtggtcctgtcctaattcctgaccaccctcacgggtggtgttctcatggactacctggcagctgtgggatagaaggtccctagagtgtcctcctgtgtgaggggtgacctccaaggtctatgtgtggatgctttggccatctgtgtagaactcacttctggtaaggacccagaaatagcatggctattgttatcacaatggattttaagaacattccttagcagccaagcccagcatacacagtcactggtcaccacaaactcattgagagatggtgtcttagttagggttttactactgtgaacagatattatgagcaaggcaactcttttttttttaaagatttatttattattatatgtaaatacactgtagctgtcttcagacattccatagtagggcatcagatctcattgtggatggttgtgaactaccatgtggttgctgggatttgaactcagtacctttggaagagcagtcagtgctcttacccgctgagccatctcactagccctgatcaaggcaactcttataaaaacaacatttaattggggctggcttacaggttctgaggttcagtccattatcatcaaggcaggaacatggcagcattcaggcagacatggtacagaaggagctgagagttctacaacttcatctgaaggccactaggagaaggccactgacttccaggcagctaggacaagggtattaaggcccacaaccacagtgacacacccactccaaaaaggtcacacctcctaataatgccactccctgggctgagcatatataaaccatcacagatggccaagaatggttgcttcaatgcttttatgtgcacataccacctagagtgttccacaaagttcagggttcagagctttcacacaactttgacctcaaggcttatttttagattctagtgcttgtgagatccattctctacaacaccatgctatttctatgactatttcaaatacaagactgtgttatgccgggtgtggtggtacatgcctttaatcccagcactcaggaggcagagtcagccggatttctgagttcgaggtcagcctggtctacaaagtgagttccaggacttccagggctacacagagaaaccctgtctcgaaccccgaaccccccctccgccccccaaaaaagacgactgtgttctgtttctcatgagattcttctgcatggggtgagcatgctttctactggagctgtggacactctggcactcagaaacaagtctgacctaagctacttatttactccccatcaatacaatcttcttaagctggaaaagggaaggggagagaaaaggtctctgaccttagcctcagcaggccaggtggaaggggtgacacagaacaaggccctttcctctaccttgaaagcaatgccacaggctcccacaaggttgaggattctgtctctgacctcagagcttggaaatccattgtcttctctgactccaatgtgctcaactcagagagcatttatgcagcacctgctatctttagtaagcccaccccctccagggagtccagaagtaaagacttccctctgcgagggctgctctgtgtgtgtgtgtgtgtgtgtgtgtgtgtgtgtgtggttaggggggtctgcagggtatgcaacacctgcacctaactcaagtgagataggatctggaaggagccctcaatggatggataatttgtaggtagatttgtaggtggctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1008 - DNA, 8064 bp, Mus musculus
gtggtgtgcgtcaacgtccgatccccgccggccaccccaagaggccgccgccgggctgcgggcagctggcgagcaggcatgccacggctcctgacgccccttctctgcctaacgctgctgcccgcgcgcgccgcaagaggcttgagatgctcccagccaagtgggacctgcctgaatggaggtaggtgcgaagtggccagcggcactgaagcctgtgttgccagcggcagctttgtgggccaacgatgccaggaccccaatccttgcctcagcacacggtgtaagaatgctggaacgtgctatgttgtggaccatggtggcatcgtggactatgcctgcagctgtcccctgggtttctctgggcccctctgcctgacacctctggacaagccctgcctggccaacccctgccgcaatgggggcacctgtgacctgctcactctcacagagtacaagtgccgctgctctccagggtggtcaggaaaatcatgtcagcaggctgacccctgtgcctccaacccctgtgccaatggtggccagtgcctgccctttgagtcttcatacatctgtcgctgcccgcctggcttccatggccccacctgcaggcaagatgttaatgagtgcagccagaaccctgggctgtgccgccatggaggccactgccacaatgagatcggctcctatcgctgtgcctgctgtgccacccatactggtccccactgtgaactgccctatgtgccctgcagcccctcaccctgccagaatggagcaacctgccgtcctacaggggacaccacccacgagtgtgcctgcttgccaggttttgctggacagaactgtgaagaaaatgtggatgactgtccaggaaacaactgcaagaatgggggtgcctgtgtggacggcgtgaatacctacaattgccgctgcccaccggaggtgacgggtcagtactgtacagaggatgtggacgaatgtcagctcatgccaaatgcctgccagaatgcgggaacctgccacaacacacacggcggctacaactgtgtgtgtgtcaatgggtggactggcgaggactgcagtgagaacattgatgactgtgccagtgccgcctgtttccagggtgccacttgccacgaccgtgtggcttccttctactgcgaatgtccgcatgggcgcacaggtctgctgtgccacctcaagcatgcgtgcatcagcaacccctgcaacgagggctccaactgtgacaccaaccctgtcaacggcaaacgaatctgcacctgcccctcggggtacacagggccagcctgcagccaggacgtggatgagtgtgatctgggtgccaaccgttgtgagcacgcaggcaaatgcctcaacacactgggttcttttgagtgccagtgtctacagggctacacgggacccggctgtgagattgatgttaatgagtgcatctccaacccatgtcagaatgacgccacttgcctggaccagattggggagttccaatgcatatgtatgccaggttatgaaggtgtatactgtgaaatcaacacggatgagtgcgccagcagcccctgtctgcacaatggccactgcatggacaagatccatgagttccaatgtcagtgccccaaaggcttcaacgggcacctgtgccagtatgatgtggatgagtgtgccagcacaccatgcaagaacggtgccaagtgcctggatgggcccaacacctatacctgcgtgtgtacagaaggttacacagggacccactgcgaagtggacattgacgagtgtgaccctgacccctgccactatggttcctgtaaggatggtgtggccacctttacctgcctgtgccagccaggctacacaggccatcactgtgagaccaacatcaatgagtgccacagccaaccgtgccgccatgggggcacctgccaggaccgtgacaactcctacctctgcttatgcctcaagggaaccacagggcccaactgtgagatcaacctggatgactgcgccagcaacccctgtgactctggcacctgtctggacaagattgatggctacgaatgtgcctgtgaaccaggctacacaggaagcatgtgtaacgtcaacattgacgaatgtgcgggcagcccctgccacaacgggggcacttgtgaggatggcatcgcgggcttcacttgccgctgccccgagggctaccatgaccccacgtgcctgtccgaggtcaacgagtgcaacagtaacccctgcatccacggagcttgccgggatggcctcaatgggtacaagtgtgactgtgcccctgggtggagtggaacaaactgtgacatcaacaacaacgagtgtgagtccaacccttgtgtcaacggtggcacctgcaaggacatgaccagtggctacgtatgcacctgccgagaaggcttcagtggccctaattgccagaccaacatcaacgaatgtgcctccaacccctgcctgaaccaggggacctgcattgatgatgtcgctggatacaagtgcaactgtcctctgccatatacaggagccacgtgtgaggtggtgttggccccatgtgctaccagcccctgcaaaaacagcggcgtatgcaaggagtctgaagactatgagagtttctcctgtgtctgtcccacaggctggcaaggtcaaacctgcgaggttgacatcaatgagtgtgtgaaaagcccatgtcgccatggggcctcctgccagaacaccaatggcagctaccgctgcctctgccaggccggctatacaggtcgcaactgtgagagtgacatcgatgactgccgccccaacccgtgtcacaatgggggttcctgcaccgatggcatcaacacagccttctgcgactgcctgcccggcttccagggtgccttctgtgaggaggacatcaatgaatgtgccagcaatccctgccaaaatggagccaattgcactgactgtgtggacagctacacatgtacctgccccgtgggcttcaatggcatccactgcgagaacaacacacctgactgtactgagagctcctgcttcaatggtggtacctgtgtggatggtatcaactccttcacctgtctgtgtccacctggcttcacgggcagctactgtcagtatgatgtcaatgagtgtgattcacggccctgtctgcacggtggtacctgccaagacagctatggtacttataagtgtacctgcccacagggctacactggtctcaactgccagaaccttgtgcgctggtgcgactcggctccctgcaagaatggtggcaggtgctggcagaccaacacgcagtaccactgtgagtgccgcagcggctggactggcgtcaactgcgacgtgctcagtgtgtcctgtgaggtggctgcacagaagcgaggcattgacgtcactctcctgtgccagcatggagggctctgtgtggatgagggagataaacattactgccactgccaggcaggctacacgggcagctactgtgaggacgaggtggacgagtgctcacctaacccctgccagaatggagctacctgcactgactatctcggcggcttttcctgcaagtgtgtggctggctaccatgggtctaactgctccgaggagatcaacgagtgcctgtcccagccctgccagaatgggggtacctgcattgatctgaccaactcctacaagtgttcctgcccccgggggacacagggtgtacactgtgagatcaatgttgatgactgccatcccccccttgaccctgcctcccgaagccccaagtgcttcaacaatggcacctgtgtggaccaggtgggtggctatacctgcacctgcccaccaggcttcgtcggggagcggtgtgagggtgatgtcaatgaatgtctctccaacccctgtgacccacgtggcacccagaactgtgtgcagcgtgttaatgacttccactgcgagtgccgggctggccacactggacgccgctgtgagtcagtcatcaatggctgcaggggcaaaccttgcaagaatgggggtgtctgtgccgtggcctccaacaccgcccgtggattcatctgtaggtgccctgcgggcttcgagggtgccacatgtgagaatgatgcccgcacttgtggcagcttacgctgtctcaacggtggtacatgcatctcgggcccacgtagtcccacctgcctatgcctgggatccttcaccggccctgagtgccagttcccagccagcagcccctgtgtgggtagcaacccctgctacaatcagggcacctgtgagcccacatccgagaaccctttctaccgctgtctatgccctgccaaattcaacgggctactgtgccacatcctggactacagcttcacaggtggcgctggcccggacattcccccaccgcagattgaggaggcctgtgagctgcctgagtgccaggtggatgcaggcaataaggtctgcaacctgcagtgtaataatcacgcatgtggctgggatggtggcgactgctccctcaacttcaatgacccctggaagaactgcacgcagtctctacagtgctggaagtattttagcgacggccactgtgacagccagtgcaactcggccggctgcctctttgatggcttcgactgccagctcaccgagggacagtgcaaccccctgtatgaccagtactgcaaggaccacttcagtgatggccactgcgaccagggctgtaacagtgccgaatgtgagtgggatggcctagactgtgctgagcatgtacccgagcggctggcagcgggcaccctggtcctggtggtgctgcttccacccgaccagctacggaacaactccttccactttctgcgggagctcagccacgtgctgcacaccaacgtggtcttcaagcgtgatgcgcaaggccagcagatgatcttcccgtactatggccacgaggaagagctgcgcaagcacccaatcaagcgctctacagtgggttgggccacctcttcactgcttcctggtaccagtggtgggcgccagcgcagggagctggaccccatggacatccgtggctccattgtctacctggagatcgacaaccggcaatgtgtgcagtcatcctcgcagtgcttccagagtgccaccgatgtggctgccttcctaggtgctcttgcgtcacttggcagcctcaatattccttacaagattgaggccgtgaagagtgagccggtggagcctccgctgccctcgcagctgcacctcatgtacgtggcagcggccgccttcgtgctcctgttctttgtgggctgtggggtgctgctgtcccgcaagcgccggcgccagcatggccagctctggttccctgagggtttcaaagtgtcagaggccagcaagaagaagcggagagagcccctcggcgaggactcagtcggcctcaagcccctgaagaatgcctcagatggtgctctgatggacgacaatcagaacgagtggggagacgaagacctggagaccaagaagttccggtttgaggagccagtagttctccctgacctgagtgatcagactgaccacaggcagtggacccagcagcacctggacgctgctgacctgcgcatgtctgccatggccccaacaccgcctcagggggaggtggatgctgactgcatggatgtcaatgttcgaggaccagatggcttcacacccctcatgattgcctcctgcagtggagggggccttgagacaggcaacagtgaagaagaagaagatgcacctgctgtcatctctgacttcatctaccagggcgccagcttgcacaaccagacagaccgcaccggggagaccgccttgcacttggctgcccgatactctcgttcagatcgtcgaaagcgccttgaggccagtgcagatgccaacatccaggacaacatgggccgtactccgttacatgcagcagtttctgcagatgctcagggtgtcttccagatcctgctccggaacagggccacagatctggatgcccgaatgcatgatggcacaactccactgatcctggctgcgcgcctggccgtggagggcatgctggaggacctcatcaactcacatgctgacgtcaatgccgtggatgacctaggcaagtcggctttgcattgggcggccgcggtgaacaatgtggatgctgctgttgtgctcctgaagaacggagccaacaaggacatcgagaacaacaaggaggagacttccctgttcctgtcgatccgccgtgagagctatgagactgccaaagtgttgctggaccactttgccaaccgggacatcacggatcacatggaccgattgccgcgggacatcgcacaggagcgtatgcaccacgatatcgtgcggcttttggatgagtacaacctggtgcggtccccacagctgcatggcactgccctgggtggcacacccactctgtctcccacactctgctcgccaaatggctaccctggcaatctcaagtctgccacacagggcaagaaggcccgcaagccaagcaccaaagggctggcttgtggtagcaaggaagctaaggacctcaaggcacggaggaagagttcccaggatggcaagggctggctgttggacagctcgtcgagcatgctgtcgcctgtggactccctcgagtcaccccatggctacttgtcagatgtggcctcgcaccccctcctcccctccccattccagcagtctccatccatgcctctcagccacctgcctggtatgcctgacacccacctgggcatcagccacttgaatgtggcagccaagcctgagatggcagcactggctggaggtagccggttggcctttgagcaccccccgccacgcctctcccacctgcctgtagcctccagtgcctgcacagtgctgagtaccaatggcaccggggctatgaatttcaccgtgggtgcaccggcaagcttgaatggccagtgtgagtggcttccccggctccagaatggcatggtgcccagccagtacaacccactacggccgggtgtgacgccgggcacactgagcacacaggcagctgggctccagcatagcatgatggggccactacacagcagcctctccaccaataccttgtccccgattatttaccagggcctgcccaacacacggctggcaacacagcctcacctggtgcagacccagcaggtgcagccacagaacttaccactccagccacagaacttacagccaccatcacagccacacctcagtgtgagctcggcagccaatgggcacctggggcggagcttcttgagtggggagcccagtcaggcagatgtacaaccgctgggccccagcagtctgcctgtgcacaccattctgccccaggaaagccaggccctaccaacatcactgccatcctccatggtcccacccatgaccactacccagttcctgacccctccatcacagcacagttactcctcctcccctgtggacaacacccccagccaccagctgcaggtgccagagcccactttcctcaccccatcccctgagtcccctgaccagtggtccagctcctccccgcattccaacatctctgattggtccgagggcatctccagcccgcccaccaccatgccgtcccagatcacccacattccagaggcatttaaataaacagagatgtgggatgcaggaccccagcttccgttcccaagccctgttggaagtcctttccagtgcttcaggatgctggggcgaccaaaggagctttttaaaaaatgtttttatacaaaataagaggacaagaatttcatttttttttttagtatttatttatgtacttttattttccacagaaacactgcctttttatttatatgtattgttttctatggcactaggggaaaaacatatctgttccaagaaaataaactagttctcagagccttgattttcctggtcagggtgaagttccctgtgtgtctgtaaaatatgaacaaggattcatgatttgtaaatgctgtttatttattgattgcttctttccaaaatcgaaaaaaaaaa

SEQ ID NO: 1009 - DNA, 7596 bp, Mus musculus
atgccacggctcctgacgccccttctctgcctaacgctgctgcccgcgcgcgccgcaagaggcttgagatgctcccagccaagtgggacctgcctgaatggaggtaggtgcgaagtggccagcggcactgaagcctgtgttgccagcggcagctttgtgggccaacgatgccaggaccccaatccttgcctcagcacacggtgtaagaatgctggaacgtgctatgttgtggaccatggtggcatcgtggactatgcctgcagctgtcccctgggtttctctgggcccctctgcctgacacctctggacaagccctgcctggccaacccctgccgcaatgggggcacctgtgacctgctcactctcacagagtacaagtgccgctgctctccagggtggtcaggaaaatcatgtcagcaggctgacccctgtgcctccaacccctgtgccaatggtggccagtgcctgccctttgagtcttcatacatctgtcgctgcccgcctggcttccatggccccacctgcaggcaagatgttaatgagtgcagccagaaccctgggctgtgccgccatggaggccactgccacaatgagatcggctcctatcgctgtgcctgctgtgccacccatactggtccccactgtgaactgccctatgtgccctgcagcccctcaccctgccagaatggagcaacctgccgtcctacaggggacaccacccacgagtgtgcctgcttgccaggttttgctggacagaactgtgaagaaaatgtggatgactgtccaggaaacaactgcaagaatgggggtgcctgtgtggacggcgtgaatacctacaattgccgctgcccaccggaggtgacgggtcagtactgtacagaggatgtggacgaatgtcagctcatgccaaatgcctgccagaatgcgggaacctgccacaacacacacggcggctacaactgtgtgtgtgtcaatgggtggactggcgaggactgcagtgagaacattgatgactgtgccagtgccgcctgtttccagggtgccacttgccacgaccgtgtggcttccttctactgcgaatgtccgcatgggcgcacaggtctgctgtgccacctcaagcatgcgtgcatcagcaacccctgcaacgagggctccaactgtgacaccaaccctgtcaacggcaaacgaatctgcacctgcccctcggggtacacagggccagcctgcagccaggacgtggatgagtgtgatctgggtgccaaccgttgtgagcacgcaggcaaatgcctcaacacactgggttcttttgagtgccagtgtctacagggctacacgggacccggctgtgagattgatgttaatgagtgcatctccaacccatgtcagaatgacgccacttgcctggaccagattggggagttccaatgcatatgtatgccaggttatgaaggtgtatactgtgaaatcaacacggatgagtgcgccagcagcccctgtctgcacaatggccactgcatggacaagatccatgagttccaatgtcagtgccccaaaggcttcaacgggcacctgtgccagtatgatgtggatgagtgtgccagcacaccatgcaagaacggtgccaagtgcctggatgggcccaacacctatacctgcgtgtgtacagaaggttacacagggacccactgcgaagtggacattgacgagtgtgaccctgacccctgccactatggttcctgtaaggatggtgtggccacctttacctgcctgtgccagccaggctacacaggccatcactgtgagaccaacatcaatgagtgccacagccaaccgtgccgccatgggggcacctgccaggaccgtgacaactcctacctctgcttatgcctcaagggaaccacagggcccaactgtgagatcaacctggatgactgcgccagcaacccctgtgactctggcacctgtctggacaagattgatggctacgaatgtgcctgtgaaccaggctacacaggaagcatgtgtaacgtcaacattgacgaatgtgcgggcagcccctgccacaacgggggcacttgtgaggatggcatcgcgggcttcacttgccgctgccccgagggctaccatgaccccacgtgcctgtccgaggtcaacgagtgcaacagtaacccctgcatccacggagcttgccgggatggcctcaatgggtacaagtgtgactgtgcccctgggtggagtggaacaaactgtgacatcaacaacaacgagtgtgagtccaacccttgtgtcaacggtggcacctgcaaggacatgaccagtggctacgtatgcacctgccgagaaggcttcagtggccctaattgccagaccaacatcaacgaatgtgcctccaacccctgcctgaaccaggggacctgcattgatgatgtcgctggatacaagtgcaactgtcctctgccatatacaggagccacgtgtgaggtggtgttggccccatgtgctaccagcccctgcaaaaacagcggcgtatgcaaggagtctgaagactatgagagtttctcctgtgtctgtcccacaggctggcaaggtcaaacctgcgaggttgacatcaatgagtgtgtgaaaagcccatgtcgccatggggcctcctgccagaacaccaatggcagctaccgctgcctctgccaggccggctatacaggtcgcaactgtgagagtgacatcgatgactgccgccccaacccgtgtcacaatgggggttcctgcaccgatggcatcaacacagccttctgcgactgcctgcccggcttccagggtgccttctgtgaggaggacatcaatgaatgtgccagcaatccctgccaaaatggagccaattgcactgactgtgtggacagctacacatgtacctgccccgtgggcttcaatggcatccactgcgagaacaacacacctgactgtactgagagctcctgcttcaatggtggtacctgtgtggatggtatcaactccttcacctgtctgtgtccacctggcttcacgggcagctactgtcagtatgatgtcaatgagtgtgattcacggccctgtctgcacggtggtacctgccaagacagctatggtacttataagtgtacctgcccacagggctacactggtctcaactgccagaaccttgtgcgctggtgcgactcggctccctgcaagaatggtggcaggtgctggcagaccaacacgcagtaccactgtgagtgccgcagcggctggactggcgtcaactgcgacgtgctcagtgtgtcctgtgaggtggctgcacagaagcgaggcattgacgtcactctcctgtgccagcatggagggctctgtgtggatgagggagataaacattactgccactgccaggcaggctacacgggcagctactgtgaggacgaggtggacgagtgctcacctaacccctgccagaatggagctacctgcactgactatctcggcggcttttcctgcaagtgtgtggctggctaccatgggtctaactgctccgaggagatcaacgagtgcctgtcccagccctgccagaatgggggtacctgcattgatctgaccaactcctacaagtgttcctgcccccgggggacacagggtgtacactgtgagatcaatgttgatgactgccatcccccccttgaccctgcctcccgaagccccaagtgcttcaacaatggcacctgtgtggaccaggtgggtggctatacctgcacctgcccaccaggcttcgtcggggagcggtgtgagggtgatgtcaatgaatgtctctccaacccctgtgacccacgtggcacccagaactgtgtgcagcgtgttaatgacttccactgcgagtgccgggctggccacactggacgccgctgtgagtcagtcatcaatggctgcaggggcaaaccttgcaagaatgggggtgtctgtgccgtggcctccaacaccgcccgtggattcatctgtaggtgccctgcgggcttcgagggtgccacatgtgagaatgatgcccgcacttgtggcagcttacgctgtctcaacggtggtacatgcatctcgggcccacgtagtcccacctgcctatgcctgggatccttcaccggccctgagtgccagttcccagccagcagcccctgtgtgggtagcaacccctgctacaatcagggcacctgtgagcccacatccgagaaccctttctaccgctgtctatgccctgccaaattcaacgggctactgtgccacatcctggactacagcttcacaggtggcgctggcccggacattcccccaccgcagattgaggaggcctgtgagctgcctgagtgccaggtggatgcaggcaataaggtctgcaacctgcagtgtaataatcacgcatgtggctgggatggtggcgactgctccctcaacttcaatgacccctggaagaactgcacgcagtctctacagtgctggaagtattttagcgacggccactgtgacagccagtgcaactcggccggctgcctctttgatggcttcgactgccagctcaccgagggacagtgcaaccccctgtatgaccagtactgcaaggaccacttcagtgatggccactgcgaccagggctgtaacagtgccgaatgtgagtgggatggcctagactgtgctgagcatgtacccgagcggctggcagcgggcaccctggtcctggtggtgctgcttccacccgaccagctacggaacaactccttccactttctgcgggagctcagccacgtgctgcacaccaacgtggtcttcaagcgtgatgcgcaaggccagcagatgatcttcccgtactatggccacgaggaagagctgcgcaagcacccaatcaagcgctctacagtgggttgggccacctcttcactgcttcctggtaccagtggtgggcgccagcgcagggagctggaccccatggacatccgtggctccattgtctacctggagatcgacaaccggcaatgtgtgcagtcatcctcgcagtgcttccagagtgccaccgatgtggctgccttcctaggtgctcttgcgtcacttggcagcctcaatattccttacaagattgaggccgtgaagagtgagccggtggagcctccgctgccctcgcagctgcacctcatgtacgtggcagcggccgccttcgtgctcctgttctttgtgggctgtggggtgctgctgtcccgcaagcgccggcgccagcatggccagctctggttccctgagggtttcaaagtgtcagaggccagcaagaagaagcggagagagcccctcggcgaggactcagtcggcctcaagcccctgaagaatgcctcagatggtgctctgatggacgacaatcagaacgagtggggagacgaagacctggagaccaagaagttccggtttgaggagccagtagttctccctgacctgagtgatcagactgaccacaggcagtggacccagcagcacctggacgctgctgacctgcgcatgtctgccatggccccaacaccgcctcagggggaggtggatgctgactgcatggatgtcaatgttcgaggaccagatggcttcacacccctcatgattgcctcctgcagtggagggggccttgagacaggcaacagtgaagaagaagaagatgcacctgctgtcatctctgacttcatctaccagggcgccagcttgcacaaccagacagaccgcaccggggagaccgccttgcacttggctgcccgatactctcgttcagatcgtcgaaagcgccttgaggccagtgcagatgccaacatccaggacaacatgggccgtactccgttacatgcagcagtttctgcagatgctcagggtgtcttccagatcctgctccggaacagggccacagatctggatgcccgaatgcatgatggcacaactccactgatcctggctgcgcgcctggccgtggagggcatgctggaggacctcatcaactcacatgctgacgtcaatgccgtggatgacctaggcaagtcggctttgcattgggcggccgcggtgaacaatgtggatgctgctgttgtgctcctgaagaacggagccaacaaggacatcgagaacaacaaggaggagacttccctgttcctgtcgatccgccgtgagagctatgagactgccaaagtgttgctggaccactttgccaaccgggacatcacggatcacatggaccgattgccgcgggacatcgcacaggagcgtatgcaccacgatatcgtgcggcttttggatgagtacaacctggtgcggtccccacagctgcatggcactgccctgggtggcacacccactctgtctcccacactctgctcgccaaatggctaccctggcaatctcaagtctgccacacagggcaagaaggcccgcaagccaagcaccaaagggctggcttgtggtagcaaggaagctaaggacctcaaggcacggaggaagagttcccaggatggcaagggctggctgttggacagctcgtcgagcatgctgtcgcctgtggactccctcgagtcaccccatggctacttgtcagatgtggcctcgcaccccctcctcccctccccattccagcagtctccatccatgcctctcagccacctgcctggtatgcctgacacccacctgggcatcagccacttgaatgtggcagccaagcctgagatggcagcactggctggaggtagccggttggcctttgagcaccccccgccacgcctctcccacctgcctgtagcctccagtgcctgcacagtgctgagtaccaatggcaccggggctatgaatttcaccgtgggtgcaccggcaagcttgaatggccagtgtgagtggcttccccggctccagaatggcatggtgcccagccagtacaacccactacggccgggtgtgacgccgggcacactgagcacacaggcagctgggctccagcatagcatgatggggccactacacagcagcctctccaccaataccttgtccccgattatttaccagggcctgcccaacacacggctggcaacacagcctcacctggtgcagacccagcaggtgcagccacagaacttaccactccagccacagaacttacagccaccatcacagccacacctcagtgtgagctcggcagccaatgggcacctggggcggagcttcttgagtggggagcccagtcaggcagatgtacaaccgctgggccccagcagtctgcctgtgcacaccattctgccccaggaaagccaggccctaccaacatcactgccatcctccatggtcccacccatgaccactacccagttcctgacccctccatcacagcacagttactcctcctcccctgtggacaacacccccagccaccagctgcaggtgccagagcccactttcctcaccccatcccctgagtcccctgaccagtggtccagctcctccccgcattccaacatctctgattggtccgagggcatctccagcccgcccaccaccatgccgtcccagatcacccacattccagaggcatttaaataa

SEQ ID NO: 1010 - DNA, 27740 bp, Homo sapiens
  misc_feature (5028)..(9933): "n" at positions 5028 thru 9933 can be any base
  misc_feature (14548)..(14694): "n" at positions 14548 thru 14694 can be any base
  misc_feature (18584)..(18836): "n" at positions 18584 thru 18836 can be any base
caggccagggagataatgggggacagggaagataacgcagtccccacggctataaacaggaagctcggccatgggcttgtgcagaaaaaggccctcggctgtgcacgtggttcctacatagcctttgccagacaccctgcgtggccctggaggtctccaggccgtgccccgtgccccgacacgcaggatgtgctgggggcctgggcctgtcccctccatcgcagcccttgtttgttggcctcccgtgatgggcgtttgctgcctgtgacacggagccccaggattagtttcaggcctcggtctcaggccagggcctttcctcgtcacccagagatgagggggcttgcgtccggggtgggcccaggtccctgcagtgtcgtggagcccacccgactgaggccgcctctcctggtgcagtccttgttcctgggcacgcctggtggggtgaggcctaggctgtgccccgctgccaaccgggaatgaggggtggcttctgagcgtgacatttgtgcagcttgtcttcagcgtccccccatctgtgctccactcctccctgggtcagggtcctggcacagccgggagcgctcaggggtctcggtgcacatttgcctcccggcgggaccagcagacggcactctgatggcggaaagaccagcaggcggtggccgatttgggagatccctctgggtgaggctcccggggtcacgtgtgtctccttcccgcaggtgccacgtgtgaggtggtgctggccccgtgtgcccccagcccctgcagaaacggcggggagtgcaggcaatccgaggactatgagagcttctcctgtgtctgccccacgggctggcaaggtgaggctggccagggcccggtgagggctgggatgggaggtcaggatgtctgcgggacacaggcagctcccaggcaggctagatgagtctttgaagaggagccggtgggtgctgaggaggccctggtcggagaagttctggaatcaggaattgacctgggagcaccgttcccaactccagttcctgtgaccttcttaggccaaaattaggggagaggggatggtcctggggtcacggaagcccactcctgggtcgggagaggcactgtaggtgggtgggccagcctgggaagggcctggagggccaggggccgctggtgaccaaccggcctcctcctgccccacagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccagtgagtagccccgcggctctggcctcctccaggaagctctcaggcctcagttcccccgggcagggttggtgcgcatggtgctggccataagcacccagggaggccggagtgtggccggggagggttgggtcaggtgtgggggatgtgctgagggatggccagggtggttcaggagggccccagagccggcttgctcctccctgcacttcgcggaagagtcacgagagcccctcccacggctcttcactgagccgaggatggctcgggcccggcctgcactcccgcctggctcatcgggccccgctgcaggccagggctctcaggcctcccagccctgcttcacagaggttgaggttggcagaagccgggggtcttgctggcatcacctggcaggcagaggcaagaactgtctctcctcccctgctcggtctgtgaagcctgcaaagctgccccctgccctggagcttgaggacaggagcaggtggggagagagaccccaagcacaggagacgggtgtgacgcagcctgtgggtgctggggctccccaccagacacctttgtcacagggctgcttgccgcagcctcggcaacgaaaggctgggctgtccccagccatgcagccttcccggccccctcccgcaggtgtgggtttgtgcctgcccctcacactcacccttccgtcctctcccagacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagaggtgtgcggggctcgagtgaggccgtggaagggaacgggcggtgcgggccacacgcagtagctggcagcctggcacaccatgcaggcgtccgcctaggccggctgggcacttagcgctggctgcattgagtccagacattgttcattgtaccgacctgtccctcctgagagggccattgtgacctcctcctgtgtcccgcaccaggagcgccggtagtctgtcctgaagaactggtgcgcttccttctattagacaacgagaactctgtccgttcttgtttcctttttgccgtgtttgccaggaagctcatttggtaaacgtcagtctcgtccctggtttctgacgtaattacctcccgtgttaccaggacggtttctggtttctccctcatttactttaaccaccctatgcccacgcgtttggtaaaaccactctcgacctgacttataaagaaagcaggggagggaggtgtgacgtggtgtgagagccgggccccgggttcccactggcctccctgggtcagccaggctgccctgggcctgtcctggccatcaggcccctagggttgagcagaaggggaggtgctggcgaggcagaatctgctggagcggggacccaccaatgccctccgctcagcccccgcctgcccacccccttgcagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccaggtgagtgcgccggccacagaggtgcccgaaggaggggccctgggtgggtgcctgcctgcgggaggtgggaacggtcacccccaggtcccactgtgtcggctcggggtcacccccacacccccgggcagagggtttctggggatctgagcagccggtgaaggaacctgatgcggaagcagcaggcaccttcgtttcaatcccaggtttctggagccggggcgggagctcaggaattggggaattgaggaaaagtgttccttctagcaaaggccgagggtggtctggacctgctgagggccctgagggagacccagcccaggctgttcctggtgtgggggtggtggggagtccaggggcggcagtctccacttctgtagaatgggttgcagcctgggttggagtaggccccttggcggatgtgcgttctgagctaccggggaaatggccggggcgcgggcacccagctgaccccaatctgtccccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtaacctgctgtgcccacccggctcgggtcccagcccatcaaggtcctctgtgggcctgggcctcacctgtctaccaccccatcccccgcaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaaggtgggggtccctcctagggtaagggttgtggccggcacgagtgttgccacacaccaggccctggctgggagctggcccagtggagaaaactgaacctgataggcccatgcactgttcagtctcattaggggagggctggggtaatcagggtagactgcctggaagaggtggcctgtggaaagcctgaaggagggtacctatactgagaagtgggatggggttttcccttcccctagattgtgtctgggcttggccaacacctaccctgaggccctcacctctatcctatgggacggggtccacccacccccaacaggcagtgactccggtcaccgaggccccgccagggtctgttgggctgggtctctctccaggtctgacaggagcgaggggcccgtggcttcgctggacctgagggcagctcatgtggccctgtcagccctcacagtggggtgtgggagcactgcatcctggcgccggctgagccgaagggcccctcgttctgtcgcctgcacagtgcgtggccggctaccacggggtgaactgctctgaggagatcgacgagtgcctctcccacccctgccagaacgggggcacctgcctcgacctccccaacacctacaagtgctcctgcccacggggcactcagggtaagggccgctgcacggagggctggtgttggccatccatggccagggcaggggcagggcaggcaccccgggaccggccagaggcatccaggaaccagccagaaactcccgttttcctgtgtgaggccaaggccgactcacagctgcccagggaaagggcccagagcgggggtcccagtgggaagggcgtctccacggcacccttgacacctgcctctcccgagtgtccgtgcagccccagacctgagcgcttgtcttccgggacggacacgcggcacggcagggccggggtgtggcgggcttgggccactgacgaaacctggccccgcaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgggccaggggtctctgggggcttcctagggagctcgctcagcctcacttctcgacccctcaccccccaggcccctgaagaacgcttcagacggtgccctcatggacgacaaccagaatgagtggggggacgaggacctggagaccaagaagttccgggtgagtcgcgaggctcccgggctcctgggctcccgggcacctgctgccgggctgccctgacaggctctgctcactccctctatgtagttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctggtaagggtgccagcagccagggcttccctagccccgtggcccacctgcctctctcccctaagccccgaggctggggtacagttgattctctggaaacttagaattgggggtgagagctttcatccttggggtgtttcccattcagagtagacgtgggggggtcctggagtcctcctgttcttccaccaaccccttcctggggtgataccgcagggccactctgtccctgtaaattactcttttctgaaaccttcttgagacatggaaagcgttgattttctttttcttttttttttttcttttttttttgtttttgagatggagtctcgctccgtcacccaggctggagtgcagtggcacgatctcggctccctgcaacctccacctctcgggttcaagcaattctcctgcctcagcctccccagtagctgggactacaggcgcctgccaccacacctggctaatttttgtatttttagcagcgatggggtttcaccatgttggccaggctggtctcgaactcctgacctcaggtgatccgcccacctcggcctcccccagtgctaggatgacagcgtgagcctccgcatcctgctgaagcattaattttctaactgcatgcttctggggtcctctttttcctgggtggattttgggtgccaggtcttgggcaggtcaggaagcagttgcccgccaggagtttaagctggattcggctctgtccactgagcagcccaggcggacttcagctgccccttggtggctgtgtgcacggggccaccaagtgctgggtggtgcatccacaccgtggccccttgagcttggggctgctgcccccctccccctgggctgcagctggggaccggccctccagactgagcacccgtctctgcctctgcagatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccaggtaggcagtggctgcctgtgtgcccacctgccctcctcagggccgcctggtggtctggggcagtggccaggcttacgtggccctgggagcctgaccccgagcacagctgagtccgggacaactggtgcctccacctgggaccttcgcagtcagcgaggtgcgagggggagggcgtcgggcccatctgtgttctccagggaagtcaggcagaggcgggtctggcaggaggcctgggggatctgctgagtgaggcagcacctccccacccccagcaaaacaggctccatcagggttgtgggccttgctcaaggtccaggttccactgctgcagcccctcgcagccccgcccctccctcaaccttggctgccggcgtagcctgtggcagtgagaagcagggtttagaggctgccgctcggtgcctgcagacctagggctcagcttgccggtgagctcgtggcaagaatggatttagggatttggatgcctgggtctccagggagtgtccctggcaggggctgcctttgcagtcacccctgctgcgagtccccaggctccaggcggccctggagcaagcaggttcagatgggcacagcccggggagttaccacagagcttctcatttcctgatttcttagctcaggtgacacattgtcatcttgcagaaataaatgtaggtgagcagaaagagcgtggaagggagccccgtgcgggtttggtgtgtgcctctctcagctgccttctttgcacagatgtggaagttcccaggtgctttgcaggaatcaggccaagttgccttttgcacccgccagtgagcaggggccattcctcctgccagatgccaagacccggctgcattacaagggctgcccaccccctctctgggcagagccggacactagctcggcggttctgagacggctgtagggccgtgagcccggcttcctgagtgccagctgtaaccgccgttgggggcagggacttgacctctctgttttgtaggtggtcatggcagctaggaccacagtgaggattaaatgaggccacacgtggtcacgatggatcccactgtcaccaaggggcctgtctgtgggcagcacagcccctgcccccatccgggcccctcctcaggggcagccccatggcgtttcgtcttgcccggccgtgccgatctcaggagggtctcgtctgtgtccggaagacagtggggcttcccgtccaggcgttcgttctgggcaggaggcatcggtgtacgtctgcccagcacccgcctgagcctctccctgttgcccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggtgagcccacgggggcacggctgctctgtcgtggggcgggaccgccacagggacgggtgggactgggttgcctccagctggtctccaacctaccccatctgcttctttcacgcaggcaagtccgccctgcactgggccgccgccgtgaacaatgtggatgccgcagttgtgctcctgaagaacggggctaacaaagatatgcagaacaacagggtgagcgcgaggctgggatgccaggggagacgtgagggctgaatccacagagaagtgagggccaaacccacggggcgcagggacacaagggcctgacccacagggtctcgagggtcgctgggcccgcatgtgggccccacccgcatgatgcgggcacctcgttagtgctcctgccctccttcagcccctgtttatggagcccttccaagtgcaggtccagctgtcaggacacggcggctcgcccctcagacccagccctaccctcctgggcggcagtcatggcagggcacacagcctggcgtggggaacgctgctgctgccactgctgtgtcaccgtcacctggacctcaccttctgtccccagctgtcaccaggcgggggtggggatgggaatgtggtgacgcaggtggtgcagattgagccagaacacgcgtggcggcagctccctgcggggcggggcctcttggtgtgttcaccaaggccaaggacctcaaggctcagaggaagaagtctcaggactatatccaaggggagccacccccagccctcatcctggccctgcagctcctggccctgcagctgctgttggtttcccctgggtgctcagggcacaggtgcagacacccccacctccctgccgccagaacccccacccccgcccccaactcctgctgcccccttggcatgtcaggctcaggcgtctctccctcctgggtgagggcacacagcgggcctgggcaccggggcatgttggcccaggcgctccccagtccgtggcagcatggccccacagagactgggccccagagggcatcaaggcctgggaagccccttcccactcccacacagcagcctcacccagacctgtgacgtgtccaccgcacagaggagaccccaggaaggagcttggtggccaccagggtggcttgatggccgtccagatgacgagctccctccctggtgccctcgccggtgcctctgaaccgctccaggaatttccttttgtgccttattgggggcagggaagagggcctgcagttggttagattttcagtggggtctgtgacccccccatagaggtggagccccgctgatctagggtagaggactgcacagatcccctctctgggtgggtttcagaagatgtatcaaagccttaacatttaacaagagtcaggctaggtggttgcaggacgctggggtggggtcctgaggagcagcctgcctgcccccaccccgcggaggaggttgtactgctgcttcctctggtgatggaaccttggggagggtccccacgcctggcctggcccccctcaccggcccccgccctcatcccccaggaggagacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggatggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacaaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagactcggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtgatctggcttccactcccctctgctctggcctttggctccctttctgggagggaggcagggctgctatgctctgagggagccaggagtcgagggccccttctgctgggagagtgacggtgaggctgcctagtcctggcccacgggggtgtggggaccacgctgcctccagggactccatggtgtctgcagcctgcctggtccaggccctttgtagggagatggacacacagcagcaagggggttgcagccctatgggaggtggggctcgtgcctggggtgacacggctcccaggacaccatgcgtgagtctggccctcctggcagctcggggctcttctcctctcagcctcggagggatgaaggtcccacccagccatcctggggacagcccctcagggagctctgcagcaggcagggggctgcatagggagggccttgaggcagtggcatgacccctctacgggctggagaccacagggaggactctggcccctataggagggcaaagggagctgtcgaagcctatgagcagggcagcatgggtcgtggcagagtctggaaagttgtgtgatcctaaggaactggctgagcgaggcagaggcggcctggtcctggggccctgcccctgaatagagctgccagcctcacacaagggtgggccccttctctccccactgcctgggcctctgcccagccccagaccttcagggcaggccagtggcttcaaaccagagcggtggggagtctgagatccctctttggattgcaaagcactgcctgccctgggcccagtctctccaaggagggatgtgagcccgaggcctctactatggctgggggctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcatcactcagtacagccacagacagcctgagcgtccactgccaacgacgggtcagcaaaaaccgtctgctgtgacggtgaaccttagtgtcagcttggccgggccatttcgccaaacggagtgtgtctctgaggtgttctggatgaggttcgcatttgcatccacagcctgggtaaggcagtccgccctccccagtgtgggtgggccccgtgcggtccgctgaggcccggggagaacaataggccgagtgccaggggtcctcccacccaaccgcttgcactggacattggtcttttcctgccttcagacttggactgaaaacgtgggctcttcctgggcctggagcccaccggccttcggactcgcaacgccatcaggcctcctgcctgcaactgcagaccctgggaactgcaggcctcgaggtcgtgtggccaattccctgcaataacctctccagtggcacgtcttatgggctccgcttgccggaagaaccctgacgaatgcgcacgagggaatatgattccaccgtagaaaaggaggcgctgacacccaccatgcggacaagccttggaagcacggtgctcagtgaagggtgccggccgcaaagggccgcaggtgcagtgactccatttctatggggtgcctgtggtcaccgaacccatggagacagaaagtagattgatggttcccagagccggggggaggaggaaaggggagtggctgctaaacggcccggggtttttttttgttttgttttgtttttatactttaagttttagtttattgtggcactgttcacaatagcaaagacttggaaccaacccaaatgtccaacaatgatagactagattaagaaaatgtggcacatatataccatggaatactatgcagccataaaaaatgatgagttcatgtcctttgtagggacgtggatgaagacggcccggggttttactttggagtgacgcaaatgttctgggcccagggagaggtggtgcgtgcacagcccttcgagtgcactaaatgccaataacgcggacacttttttttttttttttttgagacggagtctcgctctgtcacccaggctggaatgtggtggcgtgatcttggctcactgcaacctccgcctctgtgttcaagtgattctcctgcctcagcctccaaagtaactgggattacaggcccctaccaccacacccggctgatttttttgtatttttagtagagattgggtttcaccatgttggccaggctggtttcaaactcctgatctcaagtgatccacccgcctcggcctcttaaagtgctgaggttacaggcgtgagccactgcacctggcctaactcgtacactttaaagtggttaattttaggttctgtgagtctcacctcaatatgttattttttttttttaattaaaaaaagtttttgagacagggtcttgctctgtcacccaggctggagtgcagtggtgccatgatagcttattgcagcctcaacctcctgggcccaggtgatcctcccaccttggtctctctagcagctgggattacaggtgcacaccacctcacccacccaatttttttgttattttttgcagagatggggtctcactttgttgcccaggttggtctcgaactcctgagctcatgcagtcctctcctcaccttggcctcccagagtgctgggattacaggtgtgggccattgcgcctggccacatatgcaactttaaatatttcagtagccacattaaaaaggtaaaaagaaacaggcaaagtgtatattaatactacagcttagttaatccaatatatcaaaaatattattttaacacaacataaaaagtgaatgagtttttttttgttgttttttgttttttgagacagagtctccctctgtcacccaggctggagtgcagtggtgcgatctcagctcactgcaacttccgcctcccgggttcaagcgattctcctgcctcagcctcccgagtagctgggattacaggcacctgccaccacgcccagctaatttttgtatttttagtagagagggggtttcaccatgttggccaggctggtcttgatctcttgacctcgtgatcggcccacctcggcctcccaaagtgctgggattataggcgtaagccaccacgcccggccgtgaatgagatgttttatattctttttgtttgtttgtttttggtactgtgtctttgaaacccaggatgtacagtacactcacagcaccctagattgggcctggccacactttaaaaggtgttcagtatctccaggaggctcacgtccagattcggactcttcagcaggatgccaagggggctccagacagttccacccagcgcaggaaaacaccaagtgtatcttcagcctggtgactcactccacgccgctgccggcgtgaaccccgagtgtggcgctgcgtccctctggatagagcaaaggagggtcccaagagcccggaggcaccaactcatcagggcccacaaatcaggcccccggcaggcagggctgcctccatccaagagggaagcacggtgccgtagcccccgggctgctccagggatcgacaggcctgtgctgccttcatcccaaaagtctcacttgcaaagggtgtccgtggggctcaactgcgtgctcagcggtggactgatttcgttctgtgtggctccttatctcatcgtggacccaaatccacgaaccacacatgaggagctctgctggagggggcagcactgggcagaggcagacaagggggagcgtcacgcggctgtttcccgtggtgagcatccaccagcagcggttcctggtgggacaccgacgtattcgtctgcaaaagtaaaagtgtttcaaaacaaaaccgggtccagcttggtcccggtgcgttgaaagtgctggcgttggccaggcgtggtggctcacgcctgtaatcccagcactttgggaggctgaggcgggtggatcacaaggtcaggagattgagaccatcctggctaacacggtgaaaccccgtctctactaaaaaatacaaaaaattagccgggcgtggtggcaggcgcctgtagtcctagctacttgggaggctgaggcaggagaatggcgtgaacctgggaggcggagcttgcagtgagcagagatcatgcctctgcactccagcctgggcgacagagcaagacactctcacaaaaaaaaaaaaaaaaaaaaagtgctggcgttagtggaggtctctcagagggggcgttgcagggcctcccacgttactcaggctttgcagacgaagacgcagggtccgtgagtgagcgagctttgggaaaggctgttcttcaatctgcatcttgaaggtggctgggtggcgcctcagtcgcctgccccgacgtgactcccgatctggctgcttcgtgtctttgctttccacctggcggctgctgtcctggctgttgctgtacctcagtgtcctcgtgggtcaagtggggacctgggtgctggccctgggcctgcgatggtgagctgctggtgcacgctgggcatggggtgagggctcagaaagggaacagctcttgttatcgttaggaggttttcaatcgcattctttgttctccacctgcatgccgtgttggcacagttaagcctggcggccccttcagcaggtgtcctaaccgtctacattttaagatggacaagtctaggctcatggagattgcaggactgagctgcgaagctttattcatgcccaacacgacaggcgccaggtgcccagggcctcagaggtgggtttccgttgttcttcacacaaccttgaacttgtggcccatccctggaccttacagcacaggacacactctcagtgtttgttaggaatctataattttctgcggagtcacgcgtgatatttgctgtggcttttggtatatcttccactctatcgcacgggattttctggtgaaaatgtgccctgggtccacacaaacgtgcacattctaccacagcctttgtcgttctgtttggcatttttccatttaataaaatgaaccttagaaaagttataactacggccaggcgtggtggctcacacctgtcatcccagcacttcgggaggccgaggcgagaggatcacctgtggtcaggagttccacaccagcctggtcaactggtgaaacccccctctccactaaaaatacaaaaattagctgggcaccatggtgggcacctagaatctcagctacttgggggggctgaggcaggagaattgcttgaattcggaaggaggaggttgcagtgagctgagattgcaccactgcactccagcctgggggatacagtgagactcggtctcaaaaaaaaaaaagaaaagtgtataactttacttttttttctttttgtggagatggaatcttgctatgttgcccaggctggtctcaaacccctaggttcaagtgatcctcccactttggcctcccaaaatgctgagacgacagatgggagcaacctcacctggcaagcgtgcacctgttactttggccgactcagaggcggctctctgcctccccctggtggcactgctctgccagcgccccacaggtcctcccgagtgaccacagggcagaaatggccctcaccccacgcccagggccatcccccgcgacactgctattatcctgttttacacatgaggaagctggggctcaaagaggttaggcgacttagccaagttcgcccattcactgagccagggctatgtgattcccggtccgtgtcaaaccacgaggagtcacctgccctcagaggagcaggaaggcctgtagagttgatgccatccagcctggtgacttttcagacagggagacggctgctcagaggggagaagggggttgttgggccactttgccaggagtcaataccatggccagcctggcatcggatactttgccaggagttaatgccacgactggcctggcatcgaatactggagctcttcccagctccacccgggcccttttctcttccctatctacagtccccaggccaccaagtccatgtccaccacttaaatcatcactcaatgctcaggactgtctcctgcctgctgtgtgtgaaccccgtgctgtgctggggttgtgccctcggggactctcccgggttcttggggactctcctgggttcagcgcctctttctcctaggccacccaaggctgcctcctgggccctggctctccctagcccctagctcgaaccctaacctggagagcctttggggcccaaactggttgcatcgctcctggctgaaaagcctctggaagcttcctatacttccagacaccacctgcgggtctcttagcaagcctacagagtccacactagcctacgcccactggccgctcaccccgcagaagcctcatgtggactgttcacttcagccagaaatgctccttctcctcctgcctgtccccagcagacactgcatggtgccctctgtatgggcacctctgtggccagccagcatccatgttccccggaggcagagtctgggcttgtctgtctcacggccacagcccagctcctagcagtgcctggggtacagcagggactcagcagacatctgtgcatggtttggggatagaggactcgtgggcttaccaagaccctgcctcagctcaaggacagccagcagttcctcctgtggccctgggggcctgcggtcccaggttactgtgacatcgacatcagccttgagctttctgcttcattcctagtgctttttagcaccttacatggtaagtacttggctcaatgattccagaaaaatgttctctgagacctgctatgtgcccaacatgcttgaagatgctggagatgaggagcatgacgctcctgcagtaacgaggctgctggcaatgccgtcaatgtgccctgtgcctccggggaggcctggtgtggaggatacgcttgccaccctgtgaggtcaggtccaggaagtccttgcaggaggccgggaaagggcaaggctgtcaccttcttttacaggggaggaggcagaggcttggaaaggccaggtagcttgcccaaggctgaacacctgggtagtggctgagggtctctgacttctggaagcttgcagtacagctggacacacggtagttagcccaccattgctggagccatcttacctgtgctctgctagccaggtgggcgcccaaaaggagatgcctttgcctgtgctgggaggaggcgctgtgggacccattccccagcagccgagagcaagggcacatgtgccagggcggggatgcaccttcagcctcatgtcagccctgggaaggcctagaaagtggacagtgctgtctcgctgcacacccctggcgagcacaccgggcgagcactccaggttagggtggggctcagaggtgagtagaacacgggaagggggtggcagcgtggtgagcatgtttgcggaccctatgctgtgtgcttggcaggccttgtgcatggaagtgagtgggactgaagctccctccacactgcccaccatggccctgggggtctggccttcccctcacagaggtgacttcctctcctctatgagggtaagaagaggaagcctggcccaccctctggccagcctggtggcatgctgacagggaacccctgcaggggcctgatgaacaaacgccacagaacaaactctacggaccctgcctccagatctgcttcctctcccctgattccagcttcccagccctattccctcctcctccaggaagagctccgtgtcagtgctctccaccttggaggccttcatatgtttttttgcctggaccacccagctaaccgtctcacagagactgccccttcctctctccaggccaagcctccagcttcagcgtccaggactaagggtctgtgtcaggggctgaggacagtgtccggcagggagcaggcctgcccagtaaacctccacaagcacccagacatactcgccactgctattttacaccaggtaggaaagaggagcagaagctcacagtgaggggccgtcctgcgttcactgagactgctgctctgctgggggctccctggaggaccgccactggcccgccagttgtcagcaaagagccaggtccacccatcagcctctggcatttcaggcccctatcataggaggctataagcacaggctaggggtgctgagtgcctgccttctagaccaacactgtccagtggaaatgtaacaccagccccatgtggagttttacatttcccagcagctatgtcaaaaacaaaagaaacaggtgaaataaaattaaatagtattttgtttaatctgatacatccaagatattgtcattttaatatgcaataaaaaatgattgattcgatatttgcatccttcacaacctaccatgtagtttacactcagagcccagctcagtctcacagcaagcaccagcggcccccgtgctggacagcatggctaatgggaggagctgacccgtcggaggcaccaaggtcacgctgtgaccaaggctgtggtgacgcaaaggcagcgggtttcctggcacagcctggaggtgcaccagcctgtcctgtgtgctctgcataatgtggtacagcagtggtcacagagctttgcaccagatgctgattccagcccacctaggggggttcagggaagtggtgacacttgtgtccagcctccaggtgtgagcaggggcagagacttggagaatggagaaaccagcggatgctgcaggcaaaagcagcaaagccccaccaggaatagtgatggccaccaccggcgggacacctcccagcactgggtggaggcctctgctggctcgcagtcagtcacctgatgtccccattcgcccctgccatgcttgttgtcctggcaaccccatttcagccctgaaacgtttaggtgctcatcttgctctatcttagagatgaagacctgatgctcagagactaaggaagttgaaaaagggcacacagcgtctcaggggcaggctgggccttcaacggaagggtctatggcccagaggctggatgggctcgggtgtagggtgcaggaaccctccactccacatcaggctacaaactgctgagagctgtctccgtgcactcaggattagggagaagagggggaagaaagacagccgcgccccctgcaggtgatgtggtgattcacacccctaggagccaacagaagccgctgtctaacatccctgccctgaggtccagagaccttgcattttatgcctagggcagggttggtttctgcagctatggtctctcccatagcttagtgcccaccccggtgggaccacagggtttcggaggaccctagagggtcgagccctgggctcctggctcttgggttctttgaactcgcgagcggcaaaaggcgagccccacgcctgagaggcagcatccacctctgcatccccctctttggaaagggcaaacaatgacacctccttccgcggagggtgcagagcgcctcgaccactgggaagaagcagatgggggcagcggggctggggctgggccctaccacgtgctccctaactctgttcaaacaggtcaggaatctgactcctgaaaggcaaatgttagctgagcagattggccctggtgccacgtcagccggactgaagctctccctgcaccgcctgcggccctgctggcgtggcacggatatcaccccctccctcaccagccgccggcccagctggggacaagggtggctcccacccagggaggacctcagccgctgctgggagctcagcctcccgcgatgccatcgggcgggcacccccaccacggcgcctgccctctggaaggagcagcagaggaaggccgcggctcttccctgcccttgc

SEQ ID NO: 1011 - DNA, 7615 bp, Homo sapiens
  misc_feature (2525)..(2533): "n" at positions 2525 thru 2533 can be any base
aggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacaggggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctgnnnnnnnnnggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccagacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaaggtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagatgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaa

SEQ ID NO: 1012 - DNA, 2460 bp, Homo sapiens
atgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaa

SEQ ID NO: 1013 - DNA, 25032 bp, Mus musculus
  misc_feature (623)..(642): "n" at positions 623 thru 642 can be any base
  misc_feature (1720)..(2727): "n" at positions 1720 thru 2727 can be any base
  misc_feature (9567)..(9586): "n" at positions 9567 thru 9586 can be any base
  misc_feature (13042)..(13295): "n" at positions 13042 thru 13295 can be any base
cttccttctcccttcactgaaactgaactgaccttgggatggggaaacccccacttcatggcacccactctaaaagatggctgttggtcaaacagcctagcaagctctaaaccaggtactctgcacctgccctctgacgccctgggattatatggcagagggtaagaacaggaatgacataattaaaaccagcctcagaagctgctgaaggcattagaactaaagcccagaaaagcaacaaactgttaccatcaaagcgtgaaagaggaaacggttaatcttttcaagggaagtgaagcaactcggaaggccataggaatccacatcacctgaactgcagaccaagccttggaactggggctttcaagctacatctgctactcacacctttgacctctctgggtgaattgttttcttactagtcaccaatgttttcaaacctggattttcacactccctggaatgcctggaagggctgctaccagcggacctatattgcagggccaccaactgccaggttctgagccacagctcttagctaggaccaagcaaatggtccccagtgtgttacagtctcctgtcctccaaagtgagttcctcagatgcactcctttccaatcctnnnnnnnnnnnnnnnnnnnngattttcctgtgggcacatcagcttcctatgctgaaaaaaacagagagtagtagaaagggaaagcctaatcaagcctgcagctgagagattgccctgtgccacaacccccaagtccacccccttataggacagcaccttagtcattcagggaaagccttaatggattgccttgattcgccttgattccataatgtaattgaccatgagtagagcaagctgcaccaactcctatcgtaaatgaagacaggggtgagactggaagggtcagatactggaaaatctgagattctctgccttggtttctcatcttgatcagtttcaaccaaaaaagaaggaagctttaagcaggactccttgtttttgtcaaaagaatatgctaaagtacacattcccattattgctcatgagaccttgttcatatgtcaccaagaatattcagtggtatatgtttgttcataccttcttaaacataatttaagatttctttatttgatgtatgtgttttgcttgcataatgtatatgtaccacgtgtgtgcttgtacctgcacaggtcaggagaaggtttcagtttccctggattgatgactgtgaactatcatgtgtatgctgtgaactgaactaaggtcctctgtggaagcaacaagtgttcttaactgatgatccatctctccagcttccgctcagaaattttcacacttaaagaaataagggctggctggtgagatggctcagcggttaagagcaccgactgctcttccaaaggtcctgcgttcaaatcccagcaaccacaaagaaataagggcaggggctagagagatggctcagcagttaagagcactgactgctcttccagaggtcctgagctcaattcccagcaaccacatggtggttcacaaccatctgtaatgtgatctgatgtccttttctgatatgtctgaagacagctaaattttactcatatacataaaataaagaattctttagaaagagagaaaggaaggagggaagggaggaaggaagggagagagagagagaaagaacggaagggagggagggagggagggagggagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcctcctagctttctgaagccagtcttctccggtttgccttcagaacaagatgtaaaactctcagctcctttagctccatgcccggactggatgctgccacacttcctgccttgatgataatgaactgaacctctgagcctgtaatccagccccaattaaacattgtcctttataagagttgccttggtcatgatgtctcctcacagcaatggaaaccctaactaagacagcaagtttagcagtaaatggggtggcagagacagggtgatagcaggaaatactttgacatagctagtgagacagcaggtaatgacagtagccaaaccagcctgataaacaaacagctagcccagaatgcatagcacagcagcaaaaacattggagaactggctcaatgacaaagtggaaggaggaaaggcaattcctaaatgttgtcatctgatcaccatatctgcacactgaagcacacacacacacaaataaacaacactttaaagaaataaatattacatgatgattgcaacaaccacaggccatcggaaaagaaagaggaaaaaaaatcaatggagcaaagagaccaggctgcacacacaggaggaacatcaggagacccaaattcacccaaatgttctcaatgtcagcatgtttgcatctaggtcccaacactctaaggggattggcaggatccctgaccccgactcactaaataccaataggaagccccaacccccaccacctataacaacctcaaatatctcctcctgttggtcaatgtcccgtggaagcaacattacctctagttgagaggtactgatctctagaatccaaaagtgtgagcatttccagaagctttcccagcaagcaacaaaaaagagatggtctcacggtcaccggttgtggggaagatagcttgagtgcctttagggaggttcattcaatgataaagtccacatacagtagtcaggagggaaatggagaaggtgaaagtgagagcaagcaaggctgagctgcactcaaaattctacctacagaagtcaagagctgtgacccatagtttggggtctgttctagccaataagaggcacaggctactattgcactggcttctaaatgaaagtcaaagattacggacagaaaaaaaggaagaaaaaaaagtaaaaaagaaagcaagacccgtcatgcacctcctccccagtcacctttaccccgactcagcaagggtccatcatggagacagatgccgcccaaaaggaccatcacaaaggccggccagtgaacaaaagtgcaagattgacttgggtttgccatttacagaacaataaacgaagcctttgaagcactgttaaacaaaagagccatttgtctatgctggtggctacaaaggagaacaggattgcagcagaggactaagaaaagaaagagaaaatgccaaactgagatgtgcctggactttaccgggtcctgcccagagaccttatatgccaggacctaagatctaaaagccactgggtaagaaaacaatcaaatatgcttaatgcaatacaggcaatgtaggttcttgggtattgtgttaaaaatatctactaattttttttccttgtcagctgctttaatttatgcagtatgggaagggatcacatcggaaaagacaagggaagaacagaaaagaaacaccgtacattttcaaatgcacaaagatctcatgcactgccttctgtttctgtgcctatgaattagtgatgctaaattttatcttattttcttgcctggtgggggggggggggagggcggggagggtgactgtgttcctctctgtggtggcatagctgccatttacatgcctgtgaggtcctcttttcctttagcatgccatggctagcttggtttttaatctaacagcgcttctttccaaatgatgtttctgcggcagacaggtatttatcattgtctttgctctcgtcacttcccgacaggactcgtgagaactgaagtaattttgaaatcgtagcccgtccttagggtctcctgcttctctcccgagtaggagctaggtttttgatccagtttgtgtggatttagtgactgtttttatacatggaaggttagctcagtggtgatggttgggggggggggctctttgaagcatgcagaaaagagattcaagaacattgggggatgttatctagtggttttctccttgttgttacaagagtgactttggagaagaggggtatactttggctcagagtttgacggaaaaatctgggatggaagaagtcattgtgggagcagctggaagctttgtcacttggggagccttgtcatactctagccaaagttaggaagcaggttggagggtggggagacagattctggagtttggcgcttctgttttataccttctctacccacattgtgaatagacctgacccctgggttgacacagatcacattagtgtgagtaggtcttccttctacacatatacctctctagaaataccctcataggtaacaccagatctgcatctcctaagtgatcaagtcgacaatcagaactaaccatcataggcagggctgcaacacaccttgaatcccgtgacttaagaggcaaagacaggtggctctctgagttcaaggcctgcctggtctacagagtttcaggacagtcagggaaaccctaccttgaaaaacaaaaaacaaaaaacaaaaaacaaaaaaaaagaaaagaaaagaaacacccaaattaagcgtctcaaggatgaccgttcttggtatgttattcacaccacatatttggacctcccctcttgtgtctttgcaaagtaagatgttgggccgacttgttcattctagctgggaatatacagttcagtgactgaatgaatgctgaccacaaatgaggccctgtttcaatactgagcacaccttcctctccttcccataacagccctttctttctggaggtcttcctttttttcttaaaaatgtaagagcatcatgactgttagtatgagacagtgaggttctgggcactgtgattcttagtttttcatactgtaagagggaatgtactctctgccatcgggacacccagtggaactgctcacctggagtcttgcctccacgaagactaggatcttctggaaagctgtgtgctttggacatctaactcacatccagcaatagctcccagaaaaggacctcagagttacaacgttccagaggaacaaaacagtgggacatcttccaccatcttccaaaaggaaacctcagaacagaacaagcaacctttgtccttagtaagcttgtccacagaggcacgcatggctgtcatccgaacactgggaagtccaaggcaagcgaacagcaagttcaaaactagcttgaactggctgcatagtgaggccctatctcaaaacatcacgggctaactatgtagctcagagacaaagcccttgtccagtgtttgaaagactctggatttgattcccaacaataaaaacaacaacatacactcagatactcacacacacacacacacacacacacacacacacacacccaactccttaaacactaaaatttagtgtaggtagagtggcacaggaaactctaattccagcactacaaaccctgaagcagtttttattttagttagaagccatcctaggctaccttctcaacaagaacattccaatcactacactttattgacaagattataaacttgtggctttcctgtcctttttaaagtattttttaaaatttattttacaatgaagtggtaccctttcatttcctaatatgtaaaatggggatgtcccctaccttcctgttacttaaaagcaacaccccgggtgatgtcatcaggctggggtacagtacgggcaagtccccaaaccacaggctattccgctacctgggttcccacacctacactggaccggcatgatttggacgtaagatcttaaaataatccataattacaccttttcaaaaaggaccttttgagggtcagctctacccactgtcatatctgttggtgctgtcctgtgtttagggagaggcagagagaaagcgggtgtgcgcaacctctaagagagtaatagtaaagagacaagcctaggaaatcttccccaagaggccttttggggaaggctatccccccttccgtggatgttgaataccttgcctgttgctcagatgcagtcaagcatctgatgatgcttgaggcatgatgctgagaccactgtgtaggttggtacaaattccctttctattatacccacccttatgcagttatttgggtttaaattttcaacgttttaaaaaaaaaaaaaaaaagtattgccgggcaatagtgacgcaggcctttaatcccagcactcgaaagacagaggcaggcagatctctgagtttgagaccaacctggatggtctaaggccttgaactcaagagatctatccaccagcttgtatcccatttaattgagtgatttgtttgctctctctctctcccgctccccctctctcccccctctccctcccctttttcagttctttatttatatttgaatattatctctctctcagatgtgtacttggtgacggtcttttctacaaaggattatctgtttcatgacacgccatttattaatctgcttgtccctggagcttctgtacagtagcgtgacctgatcctctagcttctccatcccagatgattgggattcaaggcattcatcaccacgcctacctaaaattccaaccttttaataaaatggctctctaaaatattttggcaaaggaatctcactctttctcttcactaatatagttcaaccacccaattcgtaagcagtcgggctgagggtgagcatccttaagaacataaaagcaaaatttggaggctcaagattcagtttagttgctagagggctcacatagcatgccctccccacccgggattccattctcatttatcgaggcataaggccaggtgtggtgggatatgtgctgggatgcataagatcttttataaagaagaggaagaggaaaaacagttatacaaaactaataaaactgtgtgagtttcaggctagcaaagaatagtcgtgagaatctctctcaaaaaaaaaaccccaaaataataataatgataataatgataataataataataataataaaacaaggcaataataagctaatgctcctgccttgcattctgactccttttgcccagtaaaattcaatgctctgctttgacacgtccagcttacaacacgacaaaggtgtgagacatgggtgctaaaacttgttctattgcctttccgtttctgttagatctccttcacttgtatacctgtgactcattcattttccccatccacaactagggctctgttttgggtgactgtcagaaagtagggatgggttcatctactccccctctttgcaactgaatagccacctctgaaccatttttttctctagtaatttctcttcctttgcctcctttgcagcctaaaagagtcatttaaaggatgaccggaagcttgtcttaggcaaggaagcatcttcccagaacctggaaaccctgcagccctgcccccatccgacctccgccctcgttggcttcgcaacgctgtggtctctgtggccagtagagggcacacttactttactttcacaaatccgagagccacaacccgggtggtggggggtgagggggcggggaaagagtctctgcagcaaaacgcagactagggattggtggctcttggtgtttgaggcaaaatcctagaggctgtagtcattttgcaatccttaaagctgaattgtgcaatgagctcgatgaaggaagatactatcattcaacagctgaatcctaaattgcaaactcagtggctaataacaactttgaacaatgagcaccttatacacgctactgtattttcttttctttcttttttttttttttttttttttttaaaccgggtagcagtgagagaggtttctttaagtgccttggggcgaggagtccggaataagaagacttctttgggttttaaagtgtaggataagcaaatcccgagggaatatgcattatataataaatctagaaccaatgcacagagcaaaagactcatgtttctggttggttaataagctagattatcgtgtatatataaagtgtgtatgtatacgtttggggattgtacagaatgcacagcgtagtattcaggaaaaaggaaactgggaaattaatgtataaattaaaatcagcttttaattagcttaacacacacatacgaaggcaaaaatgtaacgttactttgatctgatcagggccgacttttttttttaagtgcataattacgattccagtaataaaaggggaaagcttgggtttgtcctgggaggaaggggttaacggttttctttattctagggtctctgcaggctccccagatctgggttggcaattcactcctccccctttctgggaagtccgggttttccccaaccccccaattcatggcatattctcgcgtctagcgccttgattttccccaccccagctcctaaaccagagtctgctgcaaactggctccacaggggcaaagaggatttgcctcttgtgaaaaccgactgtggccctggaactgtgtggaggtgtatgggggtgtagaccggcagatactcctcccggaggagccgggtagagcgcacccgccgccactttactggactgcgcagggagacctacaggggaaagagccgcctccacaccacccgccgggtggaagtccgaaccggaggtgctggagtgtnnnnnnnnnnnnnnnnnnnntgacgcggtccagggtacatggcgtattgtgtggagcgaggcagctgttccacctgcggtgactgatatacgcagggcaagaacacagttcagccgagcgctgcgcccgaacaaccgtacagaaagggaaaggactagcgcgcgagcaagagaaaatggtcgggcgcgcagttaattcatgctgcgctattactgtttacaccccggagccggagtactgggctgcggggctgaggctcctcctcctctttccccggctccccactagcccccctcccgagttcccaaagcagagggcggggaagcgagaggaggaaaaaaaaatagagagaggtggggaagggagaaagagagattctctggctaatccccgcccacccgccctttatattccgggggtctgcgcggccgaggacccctgggctgcgctgctctcagctgccgggtccgactcgcctcactcagctcccctcctgcctcctgaagggcagggcttcgccgacgcttggcgggaaaaagaagggaggggagggatcctgagtcgcagtataaaagaagcttttcgggcgtttttttctgactcgctgtagtaattccagcgagagacagagggagtgagcggacggttggaagagccgtgtgtgcagagccgcgctccggggcgacctaagaaggcagctctggagtgagaggggctttgcctccgagcctgccgcccactctccccaaccctgcgactgacccaacatcagcggccgcaaccctcgccgccgctgggaaactttgcccattgcagcgggcagacacttctcactggaacttacaatctgcgagccaggacaggactccccaggctccggggagggaatttttgtctatttggggacagtgttctctgcctctgcccgcgatcagctctcctgaaaagagctcctcgagctgtttgaaggctggatttcctttgggcgttggaaaccccggtaagcacagatctggtggtctttccctgtgttctttctgcgtcttgaatgtagcggccggttaggacagtctttcttccattcctgtgcttttgacacttttctcaagagtagttggggtaggctggggtagatctgagtcggggtagagcgacttgtcaagatgacagaggaaaggggaagggaaaaaccgggatgcattttgaagcggggttcccgaggttactatgggctgacgctgacccggccggttggacattcttgctttgctacattaattgatatgtgtcctttgaggggtcaaaccgggaggtcgcttcgtggtggccaaagaaagcccttggaatcctgaggtctttggagaagggattaccttttgcgtttgggagcgagaaggctccgtagcttctgacttaccagtctctgagagggcatttaaatttcagcttggtgcatttctgacagcctgggaccgacacggaggtgcgtcccgcccgccaatccccggcggcgatcgcaacccgtccctgagccttttaagaagttgctattttggctttaaaaatagtgatcgtagtaaaatttaagcctgacccccgcggcactaggacttgatgttgggctagcgcagtgaggagaagcaaaattgggacagggatgtgaccgattcgttgacttgggggaaaccagagggaatcctcacattcctacttgggatccgcgggtatccctcgcgcccctgaattgctaggaagactgcggtgagtcgtgatctgagcggttccgtaacagctgctaccctcggcggggagagggaagacgccctgcacccagtgctgaatcgctgcagggtctctggtgcagtggcgtcgcggtttagagtgtagaagggaggtgtctcttattatttgacaccccctccccttttatttcgagaggcttgtgatagccggagactgagctctctcctccaagtcagcaatcggaaagaaaagccggcaaaggaaggaagggggcgcgctgggggtggagaaagaggagggcggagaggggcggcggcgccggctgggtaggagcgcggcgacggcgcgaatagggactcggacccggtcggcggcgcagagagccggcacacgggagggggccgagcgacgcggcgcctctcgcctttctccttcaggtggcgcaaaactttgcgcctcggctcttagcagactgtattccctacagtcgcctccctcagcctctgaagccaaggccgatggcgattcctgggcgtctgcagggctaagtccctgctcgaaggaggcggggactcggagcagctgctagtccgacgagcgtcactgatagtagggagtaaaagagtgcatgcctcccccccaaccacacacacacacacacacacacacacacacacacacacacacacacttggaagtacagcacgctgaaaggggagtggttcaggattggggtacgcgctgcgccaggtttccgcaccaaccagagctggataactctagacttgcttcccttgctgtgccccctccagcagacagccacgacgatgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctggtaagctaccccattcacagcagggtaggaagcgagaggttggatggacctccttctccaccactcattggcattaattcaattggcctccggggctccccctttctttcccttctgtctaagagctcttcatccctggattcccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggaatttcatttgggtttttaaatcttctggcttatctttcagctccatccactccctttacccctcctaagcattttaattaccctgggaagggtgtgaatgaggataaaggaactgatctggaggggggtgaattacctgcttcttttcttgactgccagaagaatatttgaatttaatggatacgtttgtctaagacccaagagaagcaatgacagaagctgggacagcctttatagccttagagccaggcactagtgaaagttcctaaagaattgaagagctgggctcttttgggtgttttgttttgctttgttttttcgtcctcttttgaacacttcaaagcaaattctgttcaatttggacttctccccccgtcccaacactcccccaacaccaggacgtttggcaaagctgcaagactttttttttttttttttttttttaattgtgcttccagtaaaatagggagttgctaaagtcatagcaagagatttgcagctatccctcacgggacctgaaaggttctcggtaaagtcccttaaaaataggaggtgcttgggaaatgtgctttgctttgggtgtgtctgaagcctcattaaatcttaggtaagaattggcaaggataccatatcctggtacatggtaattttctcacctgtgccctaaccctgttctgcctttctgggagaagggaagatggtgtctggatctgattcttactttcttccctttccaacttggtatttggatagcatcggtcaaatcctatgtatagcgtccgggattcaggaggcgtggctaactgtgatcttccacttcctcccttacagaagaagagcaagaagatgaggaagaaattgatgtggtgtctgtggagaagaggcaaacccctgccaagaggtcggagtcgggctcatctccatcccgaggccacagcaaacctccgcacagcccactggtcctcaagaggtgccacgtctccactcaccagcacaactacgccgcacccccctccacaaggaaggactatccagctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataaactgacctaactcgaggaggagctggaatctctcgtgagagtaaggagaacggttccttctgacagaactgatgcgctggaattaaaatgcatgctcaaagcctaacctcacaaccttggctggggctttgggactgtaagcttcagccataattttaactgcctcaaacttaaatagtataaaagaacttttttttatgcttcccatcttttttctttttccttttaacagatttgtatttaattgtttttttaaaaaaatcttaaaatctatccaattttcccatgtaaatagggccttgaaatgtaaataactttaataaaacgtttataacagttacaaaagattttaagacatgtaccataattttttttatttaaagacattttcatttttaaagttgatttttttctattgtttttagaaaaaaataaaataattggaaaaaatacaattgggccaacttgtgttttctttttcctcttcctcaaacttcctttcctcaattacagattaaaagaatttgaccattttcacagggtaggtttacaaatatgggaaggggttatcattgttaaaatggggctgggggtcctcaggatttctaagttgtctacaggatgctttctgtggatagtaataaaaaccagagctgttagttaggaatgggcaaaaggcaagtgagaaggctagatgcagggaagggaaaagcaagaggttaaagataacagctaaatatacaggaggaagagatggcagaatctcctacagttaaccgaagccattccctggttcacctcaacccaaggactctgccctgccaaagaactggtgaggggagggagagagaaccaccgtttgttccttgcctcttgctcccaggtgatagtcccttcacatcagtatctcctatgcttctgaaaaaaacagaggaagagcattaccactgctaagttgatcctggttttccaaacaaggacatacaaaggttcagagggttgcagagcttaatgggtacgaacacaacaaaaataacccagggcccctgtcttgaaaacaagccttgctgccttgcttagttgggtgtccttccgctggttaggggtctgagaatgagcgctacaggctccattaggagctttgacagagtgccacgaaagaggtactatgatctctttatacctagtacaggtagaaacagacatgaaataacccatccatgcacccaggggattcaaaaccactttatccttagtgcatccaggaggaagatcctagctacgaaggagagggcaggagtcattaaagcttcactactcaagaactggtagacttcagttcccctccttgtttgtggattggggggttggggtggagggtgttgtgtgtactcagaggcacatagctcactcctaccttacccacttagtttttaacatcagatccctgcttgctcctgggaagaagccagtttagaagtgctactggtcagatcataaaataaaaccttgttttacatgagtcattattttagaaattgcaagctcgccttcctcccaagcactttcacacactcatgacacacgctcatcaatggcccatgagaaagccttttggaacaggtatcttattaattataagcctctgaaaagccacaatccaaaccagaaactgaaacatgtaggtaaagtccagggagaaaggtaccctaaatgtcctaaatgaccccattgtctcagagaaggtctctagcatcctggagtgtctttgggactttaattcaccatcattcataaaccaataagtaattactatctttgacaccccccccccatgatctattgaagcgtttaacatttagtttttgatcttatttttggctcttttagactcaccctcagcttcaaactgttacaccctctatcctacattcaaaagaaaacacaaaccccagtagtagtttgaaatactttgagtagttcaaaggattagcaaaaggggggagcagggggtgctcttaaatagttccctctttttcccctttgtgagcctaggctggagtgcagccctggggtgactcacttgagacctgggaaggtgttaggttgaatcactcagtccaggcaagcccaaagaatagaggaaagcattcctcattaggaaaacaactcctgttccaaatgatcaggaaacaagtttagagattcagatttggctgtggggatggaatcgaagtatcacagctccctatctgggcacttctcagctttaccaagccagggaatggtctgaaaacaggacatcggccagcttccttccagaaagtcaggctgatcttgaccataacacaggaaggctctcccagccaatctggagtcccaggggtctgcaacattgtgcaatcaaatttatagataacaatcacgatgaggggtgaagtgggaggagctttcagcttggtctgggatatacaagaattagctagtctcttctgttgttcacccatgacactggaactcagtttccccgagaggatccctgggatggtgctcttcaggataaactgagtgaggaggaagtgtgactttatgctatcattcggggacaacactaaaaagcaatcaattacactttaagttgaacaaaagtttcacaataccaggatagtgcttgagtcatccaaagcttgaacacgtatgtagagtcttctgctgttctttaagatggactttggcactaaccttggaaaagagggccaaaaaacccaccccccaaaaacaaacagaacaaaaaacgtgaggggattttctgtggtttgtttacaataagagatgagtcacaataatgatttttttttttttttttagcatgactgctaaggaaccctgaagcatttcttcccaacaaaaactaatctttaggttataacatgctggaagatgagcttcaagcctgtctataaatacatcactgggtatcttcagggaacaaactcttcacttaaggttagagaccatcctggatcgatttcaagaacagaggtttattttaaacaatgaagcctgggctagagatgtcgttcagtgataagacacttgtctagcatgtataaggacccatgcttgacaccacaggaataaataaaaccaaaaatgaggttcctactcattccccaaactttagcaattttggtggtggtggtggtggtggttcgacgtctttccagagaaatccaacaaactgccaatttagggaaaacatctagctctagcgactttgccaaactggtgtgagttgactcaatgactgagtggatttcctttttgggttttacttcactcaatattggtctacactaagctctttaggaagacagggttgagagaggaacaagtgttaatgggatgtagatcctctgaggctgaaaggaatgtcctttgtctctaaacaatgccgaggggctcaggaacactctcttccagtcttcacccgaccatctcattaaaggctaaactctccagttcgggtctatatggctaggaaagaggagctttggggaaagctctgtcagaatatacctgctttctgcagggggcgggaggacccccacaaacaactcagctggagaacaattgttagatgtgacaatactgaagtttgtacacagacatgtgaaattgctggcctgaagtcacataagcactaactaacgataatagcaattaatgtttactgtgtgctaaaagtttgacatacattatctccttttattcccaaagcaaccccctatacacacacacacctcctttttggttttggttttactttttaaattttactattaaattttaaatatgttttttttttaaatttactgcactagagagggaacctagaacctcctgcatgcaaggtaagtgatcaatgggtgagtcacatctctatagagattgtaggttgtttcaccaaaagtattagggcatttcctacagagtggtggaagttcgagtcctgggaacatggaataaggatggaatccagtaagtcttgagaaagaagctaaaggagaaaatgtcagcagcagatggcagggaagcaaagaagaaggagagctaaaaccaacaagctaaaaccaaaaacgcttgctatttgaactgtgcctaaggtagcaggaagtacagcaaggatccactggcttagtgagggaatgcttctctaggcctctcctatccacttccccttccacccagtatcctcctactccttcatctgctagagacaactgcccataggtagttaattagctgtcccagcacccaactctcctgcagtactttggttctgtttatttgttttggcaataggatctcattaggcaggccatactggcctcaaactctggaatttcttgcctcagcctcttaagtgttgtgttgggattaccagtttgggacacttattctccagctttcatgcagggctttattcaggaatttccactgtgtgattctaggatgcaaatactagttctcattccctgagggtttaattgttgttgttgtttcgttagttggttggttttgggttttgttcattgggttggtttgggttggttttggtttttcaaaacagggtttctctgtgtctgagaaccattgtcttttctaccactgcaaacccaaccatcttttcaaaccactggtaagccaagtcctttctggattaagtctgaagccattctccactcctattcgatacacttactacctaccacaaacacggcagcctggcagcctcaatgccagttttgggcttctccttgtatgcttggagaccagttgtcttcatcatcagatcaaccccttgaagaatggaagttcattggtcttgcttaatcatgcctgacaagaaagtgcaattcactaattctgtaaacatctaagtgaagggctctttgatgggctcaatggtgcatcagacctgagtaaggggtggagtagaagcaaagttgtttcaagttgcatagcgagaaaggtcaaggaaagagatgggggttcatcaggtgaagggaaggattttgattagacttgctttgcttgatttggtttttgagctgaaaagacaggaagcctaattcatttccatgatagtaggctagacttgagagggaaagaactgctgacagaaaaggaggggaattgtactgactggttttgtgtgtgtgtgtgtgtgtgtgtgtgtgtgtgtgtgtgtgtgtgtgtgtgtgtgtgtgaacttgacacaagctggagttatcacagagcctcacttggggaaaagcctccgtgagatccagctgtaaggcattttctcaattagtggtgaaggagggcctatgtgggtggtgccatccctgggctggtagtcttgagttctctaagagagcaagctgagcaagccaggggaagcaagccagtaagtaacatccttccaagacctctgcatcagctcctgcttcctgacctgcttgagttccagtcctgacttcctttggtaatgaacagcagtgtgtaagtggacagtgaataatccttttctttcccaacttgctttttggacatgatgttttgtgcaggaatataaaccctgactaagacaagaatcaaagtgtctagtcaggtgagttactggaccggtaggtagctttgttttgcttgcttgatgtctggagccctctcttagctgggtatggctgaacaaatgaaaaaagaatatgttccccctacttaggtaagtattcttccaggtggtgatgtcactggccaagctgttctcccttggcttcccacagctctcttcctttaccagataccatgtccatctttacacaaatgactctaaacctcttctctccacagacaccttcaatccacatgagataaagcctccacattttgtagctctggctgacctggaactcactatgcagaccagccttgcattgaactttcagagatctgcctatatctttcttaggagtgctaggactaaaggcatgcaccacatttagtcctgctaaacttctttttttgtttttttggttttttcgagacagggtttctctgtgtagccctggctgtcctggaactcactctgtagaccaggctggcctcaaacttagaaatccacctgtctctgcctcccaagtgctgagattaaagatgtgtggtactactgcttagactgacacacaaaatattgttgaagccagtgagataaagctcaccttcaatctcagaggtaggccaggcagacttttgtgagttctgggccagccagagcttcatatgaaaagtaataataatgataataataataataattttaataaacaaatgggtgtatgaaagagtaaatgtgcacatatttctggcatctgttttaagattctacttccttaggctgtcagtcattctcaccccattcaaccctttgctctgcactgtgattgacaaatcttctctccctctggtgactacctaattcatcccagacagcatcagccttggcaacaacttctctatgcagggactgtaagttccagacaacagaaactctgttccaattcacaaaatcaactaggaaaggagaagagacagaggacagaggaaaggaaggaagaagggagaaaaggagggagggagggagggagggagggaaaatgtcaatttatgcaactgtttcatgattcatccaaggatcctctctgattcttttttggttgttgttgtttttgttttttcgagacagggtttctctgtatagccctgactgtcctggaactcactttgtagaccaggctggcctcgaactcagaaacccacctgcctctgcctcccaagtgctgggattaaagatgtgtgccaccacgcccagctaaacctcttccttctagccagaagaacacagcagaaagaactatgatcagtcttctggaaccatgtgcttacccttaaaccagacaattcacttggttcccaggaccacactcctcctgcaaaagttggaaccctgtgattctcagcttctgaggcaaagggaagacctatccaagataaaaaaccaacaacaacaaaaaagtcaatataagaaaagaaaaaaatgttctctagatacattctgggtagtgatggttctcactgttcagagatataagaaaagagcagatgcttaaaaccctgactcttgagaacaacttttggtaagagagactcctttttttaaaattttatttatttatttatttacttacttattatatggtaagtacactggtagctgtcttcagacactccagaagagagtatcagatctcattacagatggttgtgagccaccatgtggttgctgggatttgaactcaggatctttggaagaacagtcagtgctcttaaccactgagctatcttacccagccccccacccacccccccaaccccgttaagagagattcgaatggtccatcttagaggtattgaaattgagtctgaagtgggaggcctaggggctgttttgagccaactcagcccaggtgatttgcagtgaggtgggaattccaagggcaaacaaggatcagcaaaagctatacccctctaccacagatttggagagaattcagatgggaggcctgttccagccattgctcagtaagtaagcaagagtctagctacctcttcatctccctccttctaccacaccattaagtccctccaggccatcagcctcaatgattctttctttttttttttttaattaggtattttcctcatttacatttccaatgctatcccaaaagtcccccataccctccccctccactccaactttttggccctgttgttccccgcctcaatgcttcttggctctatccatgtctccttgcccactttgcttctgccaaccgatattctttacctgggactctctagcagatgccaactgcctgtctctcatctggtttcctcaaaggtagaaaaatggtctcccaaataagcccgatcagtttactccctggcgtaggagaacttgatgattcatgtgctctgcttctaaaatacagatctgtgggcctggtagtgcagatgttaatcccaactactctacttgggaggcctagggaatggactccatgttcaaggtctgcctggacagcaagatgagtgctggggaagccagagaaaatgagtaaaactttctgaaaagtaaagcattataaaaacaaacaaacaaaggtccagagaactggggagatgattggctggttaagagtacttgctcttctgcatgggacccaagttcagttcctagaagccgagtagcttgcaccttcaattatggccccctcttctgttttctcaggaccaggtgcacacagtgcatataacatacatgtaagcaaaatactcacacacataaaattaaaaataaataaatctttcaggcaaaactgacctgggatatagctcaaggatagaggatttgcatgggatgctagcagccctgacttccatctacagtccagaaagacaagtaaatcagaaatgcctttgagggactgaagagatgattcagaggttaagagcactggctgctcttccagaagacctgggttcaattcctagtacctgcatgagagctgactccagttccagggaatctgaccctatcactcagacactgttcttgtcatctgcacacgggatgatcacacacatatcatttcacatgtggggatactgagaatgagagtcagcaggtaactgtctcaacttcaactaagcagggcagtttgttagcagggatggaatctggattcttattgccccccagcttcttcacttcctgctgcctctctacaaccacaccatattgaaattaccttcttccctctcttgcttccgcactgaaactggggctgaatctagctggctacctgacctgattctctcctatcagatggatgacttgctgtcctcctgggtcatctcccgtgtttagcaagacagggtatagagttttaaatgagtgtaggcagagtgcatgaatcatcacacttttaggcagagtgcatgaatcatcagactttcctacgccagggagtaaactgagcacgcatattttggagaccacttctctactcctagggtcagaagagcctgcagatgatctactcaaagcaattttatctgccattctgttgagtagtgaggcaaggatcatgttacctgcaacggggccaatctttgcctctgtttttgaagtctctggagaagtagccgtcttcctgcgctggggatatgattaagcagtagaacatgcacataatttcatgaggctaacatacagctcttcagagatcagcctacttatttatgacacaattgttttaagacatcaggtattctaggagataagattccttctcttgctttcctggtacccagaatgatctcctaaaccacaagtaattggcacagagatggatcttccaaactgacccagatctacacagatcttatcttcatacccaagaactccccagtcaatggatatttggggcatttgctatgcacacagacgtcagtgtggaataaccgtactccagcacttagtagaaaggatgtatactgaacgagtatttacaaataattaaccagattattttcagggcacaaattagtggagcaaggattgcagagttacatgaacatctgatagcattgcggttcagggaaagttcccagccagggtacagaggatggtgatgaagaaagcatgctcaatatcttgaggcgctgctatgagagagaatgaaactctctaggggaactgaaagcatacaaggatgtaaagaataggaagagcaaaaggacttcaacccttggatgagacacagggtgatccaatacccggtgacctgcagggactcaggcccagtggttatgatggcaacctacccacagtcgtgagtatgatgcagtgggaagtcacagtactgaaaaccaacacacttaacttgcctgtgctgctgtgaacgtccattcaatgagggtcaggaagctcaaataagataatcgcaaatactgagtggttctgagaggaatgcaaccatgaaaaaaaaagtgctgacacttgcagaatgtttatgtttctaatgctgggctaagtacttcacctggattatttcaccaattcctcctcctcctctccctgttctcccttctcctcctcttcttcctgttcttcctcctcctcttcctcttcttccaaagattcatgtgtatcaaggtattctcaa

SEQ ID NO: 1014 - DNA, 1799 bp, Mus musculus
gattggggtacgcgctgcgccaggtttccgcaccaaccagagctggataactctagacttgcttcccttgctgtgccccctccagcagacagccacgacgatgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctgaagaagagcaagaagatgaggaagaaattgatgtggtgtctgtggagaagaggcaaacccctgccaagaggtcggagtcgggctcatctccatcccgaggccacagcaaacctccgcacagcccactggtcctcaagaggtgccacgtctccactcaccagcacaactacgccgcacccccctccacaaggaaggactatccagctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataaactgacctaactcgaggaggagctggaatctctcgtgagagtaaggagaacggttccttctgacagaactgatgcgctggaattaaaatgcatgctcaaagcctaacctcacaaccttggctggggctttgggactgtaagcttcagccataattttaactgcctcaaacttaaatagtataaaagaacttttttttatgcttcccatcttttttctttttccttttaacagatttgtatttaattgtttttttaaaaaaatcttaaaatctatccaattttcccatgtaaatagggccttgaaatgtaaataactttaataaaacgtttataacagttaaaaaaaaaaaaaaaaaaaaaaaaaaaaaaaaaaaaaaaa

SEQ ID NO: 1015 - DNA, 1320 bp, Mus musculus
atgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctgaagaagagcaagaagatgaggaagaaattgatgtggtgtctgtggagaagaggcaaacccctgccaagaggtcggagtcgggctcatctccatcccgaggccacagcaaacctccgcacagcccactggtcctcaagaggtgccacgtctccactcaccagcacaactacgccgcacccccctccacaaggaaggactatccagctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataa

SEQ ID NO: 1016 - DNA, 37487 bp, Homo sapiens
actcccaccacacctattcaacatagtattggattccctggccagaacaattaggcatgagagagaaacaacaggcatccaaacaagaagagagaaggtcaaattatccctgtttgcagacaatatgattctgcatctagaaaactccatagcctctgccccgaaactccttgagttgataatcaacttcagcaaagtttcaggatacaagatcaatgtacaaaaattagtagcactcctatacactaacatcacccaagccaagaggcaaatcaggaacacaatcccattcacaattgccacaaaataataaaaagcttaggaatacagttaactagcgaggtgaaagatctctactatgagaattaaaaaacactcttcaaagaaatcagagatgacccaaacaattggaagaacattccatgttcatggaagggaagaatcaatattggtaaactggccatacacctcaaaacaatttacagattcaattttattcctatcaaactaccaatgacattctacacagaaatggaaataactactcaaaaattcatatggagctaataaaagagtctaaatacacaaggcaatcctaggcaaaaagagcaaagctgaaggaatcacattgaccaacttcaaattgtactacaaggatgtagtaatcaaaacagcatggaactgataccaaaacagacacatagaccaatggaacaaaatagtgagcacagaaataaagccacatacctacaaccattggatctttgacaaatctgacagaaacaagcaagagggaaaagactccctattaaattaatggtgctgtgattactggttagccatatgaagaaaactgaaactagacttatgccatatataaaatccatatgccggaaagctgaggcaggagaatcacttgaacccgggaggtggaggttgcagtgagccgagatcacactactgcactgcagcctagcgacagagtgagactccgttgcaaaaataaataaataaataaataaataaataaataaataaatatcaactcaaggtggattaaagaccaaaatgtaaaactctaaaactataaaaaccctggaagataccctaggaaataccattttggacataggagctgacaacgattttttgaaaaaaacaccaaaagcaaaagttgacaaataagacctaattaaactaaagaacttctgcacagcaaaagaaactatcaacagagtaaataggcaacctgcagaatggaggaaaatattgacaaactatatatgtgacaaaggcctaatatacaaaatctacgaggaacttaaacatacaaggaaaaatcaaacaacccacctcactaaaaagtgggaaaaggacataaaccgacacgtttcaaaagaagacatacaagcatatacatacaagccaacaagcatatgaaaaaatgctcatcatgactaatcattagagaaatgcaaatcaaagcagcaataagataccatctcacactagtcagaatagctattattaaaaagttaaaaaatcacagatgctggtgaggttgtggacaaaagggaacgcttatacactgctggtgggagtgtaaattagttcaaccattgtggaaagcagtgtggtgattcctcaagtaattaaaaacagaactaccatttgacccagcaatcccactactggatataaacccaaataaatataaatctttccaccacgaaaacacatgcaagcatgtgttcattgtagctctattcacaatagcaaaggcatgaaatcagcctaaatgctcaactactgcagactggataaagaaaatgtggtacatacacacgatgcaatactaagcatccattaaaaaaaaaaaagaaatcatgtccttttcaggaacatgaatggaatcagaggccattatccttagcaaactaccacaggaacagaaaaccaaacctatgttttcacttataattgggagctaaataatgataacccatgggcagaaagaggcctcacactgtgaggcctgcgtgaaggaggaggatgggaggagaaagaagtccaggggaaaaaaacttcgggtactgtgcttagtacccagacagcaaaataatctgtacacattgatgggacgtatctcaaaataataagagctatctatgacaaacacacagccaatatcatactgaatgggcaaaaactggaagcattccctttgaaaactggcacaagacaaggatgccttctctcaccactcctattcaacatagtgttggaagttctggccagggcaatcaggcaggagaaagaaataaagggtattcaattaggaaaagaggaagtcaaattgtccttgtttgcagatgacatgattgtatatttagaaaaccccatcgtctcagccccaaatatccttaagctgataagcaacttcagcaaagtctcaggatacaaaatcaatgtgcaaaaatcgcaagcattcttatacaacaataacagacagagagccaaatcctgagtgaactcccattcacaattgcttcaaagagaataaaatacctaggaatccaacttacaagggatgtgaaggacctcttcaaggagaactacaaaacactgttcaatgaaataaaagaggacacaaacaaatggaagaacattccatgctcgtgaataggaagaatcaatatcgtgaaaacggccatattgcccaaggtaatttatagattcaatgccatccccatcaagctaccaatgactttcttcacagaattggaaataactactttaaagttcatatggaaccaaaagagagcccgcattgccaagtcaatcctaagccaaaagaacaaagctggaggcatcacgctacctgacttcaaactatactacaaggctacagtaaccaaaacagcatggtactggtaccaaaacagagatatagaccaaaggaagagaacagagccctcagaaataatgctgcatatctacaaccatcttacctttgacaaacctgacaaaaccaagaaatggggaaaggattccctatttaataaatggtgttggaaaactggctagccatatgtacaaagctgaaactgggtcccttccttacaccttatacaaaaattaattcaagatggattaaagacttaaatgttagacctgaaaccataaaaaccctagaagaaaacctaggcaataccactcaggacataggcatgagcaaggacttcatgtcaaaaacaccaaaagcaatggcgacaaaagccaaaattgacaaatgggatctaattaaactaaagagcttctgcacagcaaaagaaactaccatcagagtgaacaggcaacctaaagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcagaagaagatatttatgcagccaaaagacacatgaaaaaatgctcatcatcactggccatcagagaaatgcaaatcaaaaccacaatgagataccatttcacaccagttagaatggtgatcattaaaatgtcaggaaacaacaggtgctggagaggatgtggagaaacaggaacacttttacgctgttggtgggactgcaaacaagttcaaccattgtggaagtcagtgtggcgattcctcagggatctagaactagaaataccatttgacccagccatcccattactgggtatatacccaaaagattgtaagtcatgctgctataaagacatgtgcgcacgtatgtttattgcggcactattcacaatagcaaagacttggaaccaactgaaatgtccatcaatgatagactggattaagaaaatgtggcacatatacaccatggaatactatgcagccataaaaaatgatgacttcatgtcctttgtagggacatggatgaagctggaaaccatcattctcagcacactatctcaaggacaaaaaaccatacaccacatgttctcactcataggtgagaattaaacaatgagaacagatggacacaggaagggaaacatcacacaccggggcctgttgtggggtagggggaggggggatggataggattaggagatatatctaatattaaatgacgaattaatgagtgcggcacaccaacatggcacatgtatacatatgtaacaaacctgcacattgtgcacatataccctaaaacttaaagtataataaaaaaaatctgtacactaaaactccaagtcatgagtttacccatataaaaaacctgaacctaaaataaaagttaaaatattcaaatataaataagtaaataaataaaatgacaaacccatggctaacatcatgttgaataaggaaaagttgaatgcttttttttctaaaatccaggagaagacaaggatgtccattctctcttctactcaacatggtactgggagtcttaggtagaacaattacacaagagaatgaaataaaggtcattcaaattggacaggaggaagtccttttctgcagtaacatgatcttataggtataaaaccctatagactcaaccaaagaaaaataactggtagtattgataaatgaattcagtaaaacttcaagttacaaatttaatgtacaataattagtagtgtttctacacagcaacagcaaactatctgaaaaagaaatcaagaaatctatctcttttacaatagctacaaaaatttcaaaaaatttcaaaaaatacctagaaataaatttaaccaaggaggtgaaagatctctacagtaaaaaataataaaatatggatgaaagaaattgaagaggatactaataaatgtaaagttaacccatgctcatagatttgtagagttaatgttgttaaaatgtccatactacccaaaccaatgtacagatacaatgcaatctctatcaaaatactaaggactttcctcacagaagtaaaatatatatattttttaatatataaaatgtatatataaatataatatataatatgaatattatatatgattataatattatatgattatatactattaatattattaataatatatattattatatatattatatatattattatatattgtatataaatatatattatatactatattattatatattgtatataaatatatattatatatactatatatttatatactatatatatagtgtatatatatatttatatagtatatataatatatacactatatatttatatagtatgtatatatatatactatatataatacataaaatatatatacatatatagtatatatatgaaatatatatatactaaatttgcacagaaccacatgattccaaacagccaaagcaatctggagcacaaagaacaaagctagatgcattacactacctggcttttaaattttctacaaagcaatagtaaacaaaatagcatagtactaacatgaaaacagatccatagactgatggaggagaatagagaccccaaaaatgaatccatacaattatagccaactagtttttgacatatgtaccaagaaaacacattggggaatggaaagtctctgcaataaatggtgctggataaactgaatatccacaagcagaagaaagaaactaggtgcttctctctcccaacatataaaaatcaactcaaaatggattaaagacttgaatataaaacatgaaactaagaagatccttgaagaaaacacaggggaaacaattcatgatattggtctgggaaagaatttttcaaataagacctcaaaagcacaaacaaccaaagctaaaatagatgaatgggataatatcaagccaaaaagcttttacatcttaaaggaaacaacagaatgaagaaatgacctacagaatgaagaaatattcacatactatgcatctgacaagaggttaatatgaaactatgtaatcaatgcaagcaactcaataggaaacacacaaataatccaatcaaaacttgggcaaaggattcgaatagatatttcttaaaaggagtcacacaaatgggcagcaagtatatgaaaaaaggctcaacatcactaagaaccagggaaatgcaaatcaacaccacagtgagctatccactcatcccagttagaatagttattatttaaaaaaataaaataaaaagacaagaaaatggccagtcatggtggctcatgcctgtaatcccagcattttggaggccaaggagggcagatcacttaatgccaggagttcaagaacagcctggccaacgtgacgaaaccccatctctactaaaaatacaaaaaattagctgggcatggtggcacatgcctgtggtcccagctactcaggaggctgaggcacgagaattgcttgaactggggaggcagaggttgcagtgagctgagttcgcaccactgcactccagcctgggtgccagagcaaggatctgccaaaaaaaaaaaaaaaaaaaaaaaaaaaaagacaagaaataacatatgctggtaaggatgtggagaaaagtgaactgttatacaatgctatacacttggtgtactactatattatccagcaatcccactgctggatccccctcccccccaaaaatgaaatcaacatatcaaagagttcagatccccatgtttattgcaacactatttgcaatagccaaaatatggaatcaacttaagtgctcatcaacagatgaaacaggaatgaaaatatggtatatatacacaatggaatgctattcaatctttaaaaaagaatgaaaccctcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggagggactgtaaactagttcaaccattgtggaagtcagtgtggcgattcctcagggatctagaactagaaataccatttgacacagccatcccattactgggtatatacccaaaggactataaatcatgctgctataaagacacatgcacacgtatgtttattgcggcactattcacaatagcaaagacttggaaccaacccaaatgtccaacaatgatagaccggattaagaaaatgtgacacatatacaccatggagtactatgcagccataaaaaatgatgagttcatgtctttggagggacatggatgaaattggaagtcatcattctcagtaaactatcgcaagaacaaaaaaccaaacaccacatgttctcactcataggtgggaattgaacaatgagaacacatggacacaggaaggagaacatcacactctggggactgttgtggggtggggggaggggggagggatagctttaggagatatacctaatgctaaatgacaagttaatgggtgcagcacaccagcatggcacatgtatacatatgtaactaacctgcacattgtgcacatgtaccctaaaactaaaagtataataataataataaaaaagtaaaaatgattaaggactataataggataagaactctaggaagatgataaagtatgcccaaaagaaagcaatgctataataaaaacaaaataaaacaaaacaacaacaacaaaaagaatgaaaccctgtcatttgcaacaatgtggacaaacctagaggactttatgttaagtgaaataaaccaagcacagaacgagaactaccacatgatctcaggcatatgtggcatctaaaaaagttgacctcaaagagagtttagtagtggctatcggaaactgaggagagtagttgcgagggggaggggaacaggttgctcaacagctacaaagttacacttatataggacaaataatttctgataatcgactgcacagtaggttgagtgtagtcaacaataatgtattgtgtactttaaaatagttagacgagaggattttggacgttctcaccaccaagaaatgacaaatgtttcaggtgatagacatatgctaattatgctgatttgatcattacacaatatatatgtatcaaaacatcacactgtatcccattaatatgtacaattatacatcaatttaaaacaaaataaaatgtattttataaaaattttaaaacttcaaccagcaagtttgaatctcctattcccagttttggtcagccctacagtgtataccaaccaggctggcctggggctgctgttagaggaaagaaagaaacatctggacttggaatgaacagatctggaaggaatcctaaattttccaataaagtctctgtattcctttcatcctggtccctacccaggaagcagtctagaggagatgatccttttctaagaacagcaacattcagtaaacaaacttccttactaatgtgtgtggatcaagagatggtgaggaaagtagagtcagtgatatttttgaatcaattatgagaaggccaccatgctattgctcagtaatattagatgcccatggacagtaagattcatcgatggtccgtctttattattaggtcattactgagtggcttttgcaataaaatacaccattggcagaataaaaatattctctaatgcaaaaacatagcatggattgtttttaaggggcacaatagtgtgcttgatcagactggaatagcaacattgtaatctgaaaaaagctcaacagtggtgaggcatattcaaaagccccaagaggagagtcaacagtcagatccatcagagttgagaggttgccacaacttatgtaatgacgtctccacgccatgaaacacatgtgtcagcttttgtcaggagtcacagatctggcatgcagcaggagattctgcattagatatataaagtcaggcccaatcatccccttgattagttagtctcatcagagaatgagcccttgccatgggtctgtatatgaggaatccaggcagttcagtaagtagtcaagatttgtttccacatgcggtcccaaagaagtctttaatctgacagactagttttccaagtggcataccaaaaggctggaccattggtagtgtcccaagaattgggttctgaccattgagcagagaaaccaagtcctctttttatttctgcatagctggttcagaggctgaacagacacaggagccagtgaacaccatcagttttcagcttagccaatccttcactgaggcaagcccagatatttggggaaacctctgtaaacagggtccaattgaactagtagtgttgtttcaagcaggagaataaaaggttaagtttcccccagagagacagttgccactcttacatataaagcagagatgcagaagaaattcgagttgatgccatcgcccacccaccaacccacccccgcatttccgccctgagactaggatcccagcgccagggacccagaccctgggattgatcgcacagagccgtgatccggagagtgcgccggggatgagacggaatctcggggccactcgagagcttggggcaggaaccatgcatccattgtccatcgtgactgcatgtggagcagctatttggcctgggaacagctgtagagagcggggagcgactggctcgccactggcgcgccctgggggaacccgcccaaggtgccctcctccccagactgccctcccagcctcgaagacggcaatccagcgcccactgctccctggactctgggcaaggccaagactcaggcctgctccagatttgagaacccaaacaactcagagggtgaggaaattgaccttgtgacagcaaagaaaaggcagattgggtttacagaagtcgatcaccatcatggttcgagtagaccgtctgaacccctgcatgaaacacttccatacctccatccaccagcaacaacacaactgcgctgcccatatttctccagaaagctgctcccaagaagaggctccagagagaggtctccaagaagaggttctggagggagatgctccaggggaaacggaagatgaggaggatgaggggattgtgagcccctcacctatagaaagcaaggctgcccagtgctgccagttctgacactgaggatgtgaccaagaggaagggccacagcttcctgcagcacaagaggtggaatgacctgcgcgttctcagttcttggccctgagggaccaggtacccaccttggccagctgctctaaggtccccacggtagtgatcctaagcaaggccttgggatacttgcaagacctggcgtgaaccgagaaaaagatgtctatggagaaaacgcagctccaacgccagcaacagcaattgcagaaatgaattgcgtacctcagtggctactaactgaccaaaaagcctgactgttctatcttacaaagacacaagtttattttttgacctccccttcccctttagtaattttcacattttggttatgacgggacagtctttgcagtaggtcccagaatgcattgcagccagtacacacagaataagggcttgcattcttggaaaccttgaaacccagctctttctctcccctgactcatgctgtgtcttctctggcgcctttggcttctcagcagatagctgactgaggagatttggggtctgtttacctcactagctccgaagaaaaggctgacagatactatgcaacaggtggtgtatgttgtcggggactccagcctgcatgaaatctcacactccgcgtgagccttagactaggaaagaatgctccctggtatctctggggtgatgctagaatgctccctggtatgtctggggtcatgcaaggacagctgggcctggacagcactctcgctgtggcttttttttccaggagacacacaagctgtcttgggtgatgacaagcttgaagatttgatcaacatgaccattgcttcactgtcagacactttacagtatctgaggagttggaaacctttaacgtatatattgtgatattagctgacacctctccttccagtttcaatgctgagaccctgagaacatttaaagagcttgcactctaggttcgttgtctcagagctctctgggccttctctgatgaagggacctttctgtcctcatgagagacttttgtttcattttgcctttgttgtgcaatgggctttacagcatcctttcccacaggttagaaatgtttccccaagttacagggaagtggggatcctagcctggggcctgaggaaatcttggagtcctggctcctgaacttgttccctgtccgagtggcacttgaggccacccatcttataatctcttctcaaggcagatgtaagtcacctcagaagggagaactgtaccgcttcctcttttccatgaagctctcatctcaatctttgactgatgagtgtgaaattctaccggaaccatgcaaacacgtccaccttgggcatctccaaggaacttgtggggtctgcagcatacttggctccctaccagcctgccatgagtcatatttcttttccagaaggtggacttgcttcctggtatgttttaaaggagcctgcaggagctctgcttagccaatcatgatggatttttgccccagctggactctgcatgtccaaggagaatccaggtacagcctccattccgggaaagacatccagcccagcagttgtcatgtgggtaacctcaggaacccctaaccctgtcctggaaaaaggacaagcccctccagaactctgcccaaaatagcaggtgcttgatggttctgaatttggaaagggatggggggtgataagtactatctgtggctctggaaaaccagctgctacattcaaatctattttccataatggtttctttctgaggttgcttcgtggcctcagagaatcccagaggatgttttgaaatagcctctctacccttcaggagcatggtagtttacaggaaccaactgacttctggaactgtctatggagggagaacaggccaggtgtaggttactaatgtcctacatgaatagcttggttttataagctgctgttgggtattatgttggggcagtctttttaatatattgtatttttgtacgcattttgcaaagtggagttaactgttttgtaaaagaaaaaaaagaaacccttgggtgcttcttctgtttcaagggtctgatttatttggaaaggcaagtttatctgaaattttgtattattgattgcccaattttaaaatgttgccttctgggacatcttgacaaaaaatatttctcaaacatgaagaaaataaatataataaaaaagaaatgtctgtgggatcagatgactgttcttgattttaccgtttccatttcataagccaagcttattgaccccttcctacctgctagtcattgagtctgagttgaccaactcaaagatggaaatatcgagccagatggtaacaaattctccatgaatcgattgttcagttttgacagaatcccaattgcaagccattagctgcttttcaaaagggatgtaccctgtagccatattagggaggcaacaagtccagttccccaagggatctctctgggtgttgactgcttccccttgccaggtgcccccatcggcaaaatcatcagttacacagatttgtcctgtatgtaatattcaaggagttgattgaggttctgagcctctttttcggtggcaggttgtatgaagagacgtcaattttttcctgttagagggatctaatgttgtgaatttgcctgcttagtcccaagagattacttggcaagcaggcccctgtatttgggagcataaatcagccacccttgctgacagatatgtaataacactgcattgaggacccttgagactgagacttctagccggccagctgacacaattattatgtatatagtgaaaatattgaacattagaaggtagagacactaatgctaaatcctgagccaaccactgctgacaaatctcattggagtttgttccactaacacttccctctacctctgtctctctgtgatggggatgactttatatgagacctgtagaatgagaaattacaagcatatgacccatcaaatcctgccatttataagtagaagcaacaagaacagtttattcaactttcccaaaggcgtccctgtacaaagtcatattggcttccaaaccccactgtgaaccatgcccaaaccccaacaattgcttttctggacttttttcccttaaatgaactcagacctagagttcactacaggaatttcaggggttacagcaagagctgttaggggatttccctatgtccaggccagaatgtagggattgcaggggagtcttgggatgaggcgaggggtggggactgtaagccttttttgtaatccctctggctctttgccccagcttgtatgctaaatcctctcctgtgtacctccatttgtgcagaactgtaagggctcagggattcttccattctgtcccttgatttccccagcagctctgctccacagtcttggtgctttcatctacctcatacctattaccccttccctccactccccagaaaatcagataagatagtgtcatgggagattatatgtaacagttctgtgaacatgtgagtccgtccctttcctgaagtaccctaccatgcatatgccttttagtctgtcttgaggacagagagacttctggctcaccactaatcatctttcttcttatagcacctgaagtgagaaaaggaagagaaccaggagttaggaaatgcagagagagagagagaaaagactctgtctatactagtaagcaaggcatgtttgcatttggtttccagtagccagcagtgtggttcaaccaaacaaacttcagatggttttttttccactgaaaactctatatcttcactgctgacgccacttattcaggtttggcaagtcattgactcagcaccatgacatcatcccttcttcctcccatgcagaggagagtgaacaacaaccaaaccatgattcaaacagcttggtttaattctgcatcctgcccctcagcttcattaataggtaggagagtgagtggggaagggcctttaatgcacttagtgccaatccattcgggaaaaagcatttgctctccaatcccgaggagtcttctcatatcccctaaccaggccagtgaagcacccttgttttatcactttccagaatgctatgtttcatcttcattaccaaaattggcaagaaatgtgaagagtttgagactgtaccctacttgcaagctcacaaactagcatacctcagtttcacagatgttggcagaatatatgagattcttgggtcagagtttgttttggttcatgtttgcattaattccccttgccctctgccccaaatcacacaggagaaatgaggagcagccagtcaaatgttgacatacaagtattcttcaaactatagttagagacaaaagctgttacaataaatgtagaaaggccatggacaattatctcaacaatatctgaccattgtttctccactatcttggcttctgacaaagtttgccattaagtatgtgtgttgattttctggatatcagggctgagcaaggaaaaagtcatgaccattagatggcagtagcacacaacatgctttatttggttggccctttgaaaggtttcaggagagtggaacttccctcacagcaggagaccttccagaggcagcagcaagaggccaccacccagaagaggaagagttcaaggcaacttccaaaggagagaagaattggacaggaggctcatgtgtctatgggatgttactcagcagccaggtgtggagtctctgtgtcagagagttcccatgggcatcagaggcttggggcttttgtccagccccagagtatgtcctatctacggctagcagatggtgtgtctggttttacagagggtgcaatgtgggtgggttctaaagggccaaaaatgtgcttactgggggccatatttaaagcaattgggtgtgtaaacatttgattttagttccaatgagctttgagctaatggtcttagctgtctctgaatatagggaacaagatacaaggcaccatctaaagatattaatccacttatttaacagtccatgccttggccccatgttgttttacaatctaagttgtatgctatttcatggagtctcagttgggagccagcgatgaagcatcctcaagacccagaatgctataaggctacaaattaggattttaaaagccagttctcagccaatctgcccacttgggcagccagtagaataaatttgaaaggagacaattttgttttgaccagtccgtttagtcaatagagtggcatttatatcccctttggtacatgaccccagctatctgtaaaacttggtgttatctacgcacatgcaggaagataattttagcaagcacacagcccctgtgccctgtgacccctccagcagcctgacctagggctatgcagttatctcacaccatggccactaaagtacagtgagattcagcaaagagtttcagtccttgggctgtttatctaatttctgtgggtaattcctgcaacatggctatgtgtttctcttaattgtggtgtgctgttccacacatatgctgttcctactgcctccaaaattagtgatcctagggaagttagtaccatgaggaactatttggaaagctcatttgtgacattggggagtcacatctagtgtggtttggtggcggaaagtacttgagggagggggttccactgttgaataaaattctactggaattttgcaccaatcccaagtgcaggaaatattcttcagggttggatgaggagaagattgtgatagggaagccatctgattcctttacaggacctccaggctccctctgctgcctgtattctctgtgttccactgaagggaagttcacatggctttgtgaagttccagaagttccaggttgtgttaataggagcagaaaatggtatagtcaaacaagcttgtgttatccaccttgcattcagcacctgggttaactaaatttgtcgtgggctcagcccaccattgtctatacatttatgtgagataagcctctggataaggttgttgaatgtcaatggttaggggaatcggctcatctaaataagtgaggtatatgatgcagcgttgccaggaaagaagtattacactatgttttctaaaatcaggttggcagaagcaaaccctgcattaggttagatttaccatcttatatgttgctgtggctaaggctataggcacgtttggtgtagtcggcaattgcatgttcctccttgctgtgactgttgtgtgttgtgcttgagtttcctgttgattgccaataataaatagcattgatgtgttcccatgagtgtgggataggttttgcaggtgttattggcagtccaagaagaacgttgttagtctagccacacaccaaattagattctgaattatgaggcactcgcatatgagtgaacaaaacaggtaaaccaagtattttttaaaaaaatagatatcagctgggcacagtggctcatgcctgaaatcccagcactttgggaggccgaagtgggcagatcacgaggtcaggagttccagaccagcctggccaatatggtgaaaccccgtctctactaaaaatacgaaaaaaaaaaaaagattacccgggtgtggtggcatgctcctgtagtcccagctacttgggggctgaggcaggagaatcacttgaacccaggaggcagaggtttcagtgagccgagatcacgttactgcactccagcctgggcgacagatccagactctgtctcaaaaaaaaaaaaaaaaaaagatatcaattgtatcaaggcataggtcccttttatgttcccttgtattgcaacattattgtgtttcagtgggggaccaaaagctttatggactccattttagcggaaactttcatagggaagaggtttgtatacctttaataacctcaggagtggccccttgggaggtggcagtgtgactacaccaataaatttcctcccaagtactcatggacataaagtgtctactgagacactggagactactagagggggacgggggaggggagcaagggttgaaaaacaaactgttgggtactatgctcaatacctgggtgatgggatcatttgtaccccaaacctcagcatcatgcaatatacccaggtaacaaacctgcacatgtgcccaatgaatctaaaataaaagttgaaaaagaaatgacaaggcataaaaatgttttaatgaagatgaaaacattcctcccaagttagtttcattacatgtcttctcattatcgtttatgtcttctgtaggtttggagtgtgtatggatttttaaggagccctcagaaaagtaacattgggcaacaactgccctcaaatagtttctaagtttttaataactgtggttttggacaaatttcacaatagctataagcaaatagttatcaatgtgggtggagaaactcccatgcaaacagtagttagatttctccctgagatcaaatatgtttcttgtaagaactgtctgtgctgtgacaccacgagctatgagttgttcactgtgggtagccagcattgcaattgctgtagagttcacttccattgagtgttatgtaaaacttgcagttagtatattaagattaggttagggaagaattcccaagctggttgttttgtgtgtgtgtgtgtgtgtgtgattttttttttaagaaatgtcttggcccaggtaatgtcatgtagtatgcattgccttagaagccaataattgtaaaggtatacactgtgggtgtcgattgcacttattataattccagggataagaaaaagctatcattttatctatgcaatcccgtaatggcttgtgggtattgtatctggattatagtattaataacaacaccaatcacaagcatcctggttgtaatatttggtgcatactatctctgggcattccttaaacgaggctcaatagatagtggcccattgctccatttgtttaatggcacatgagttaataatagtgggtatcatctgatgtgaaggaaaaggcggcccacagagcttagaaggcatctatgagtcacaagtgaaattgtacaatctgacttagctggaaggatgttactaagtggtagtagagagaggaggagaagtgctaacctcagtgctgatgtctgtggactgacccagtgaaatgggagcatggttccctttgttcccagtctgacctatgttgggtgtccctgtggtgtgtatgaggcatgctgtttccatacatactctgccagcagtagggtgtggattaccagggatagggtgatccaccaatcgaggtataattgacattggtgaaggtaggaactttctcaggtaaggaaagggcagaacaacagcataggcataaatgttggaggtcatttgcagccagcagtagggaatctgattgtcctctgggagtcacccaaatggtgttaccagatacaagggttgttggttcaatctcctgggtgtccggagcaggtcaaggtttgttccatagtgcccttagtggagcaaagtacatgggcagaaaatgaggatgcttccctctccagatagtggtgggtggtttgctagttttatgctgggtaatgagcagactaagactgagaatgcacccagagtgagtggtccatgccagatccttgtcaggattgagaggggaaaaaaatggccaggctctggattttctatgagggagaaggaagaggtgaaagagccaagttcctttgctgtgggcagtcacttcagggcccccatgttcgtgaatactggtaaatcatgttgtgtccagtgggtacatacattaccagaggttgcagcatctctgttggtggtctcctcatttgctgtgaattaaaatatggtgcatttatgccagagaggtatggatttaatgtaagcatgactatgggcagtatttttggctacggggaatgctattgtcctgcatgttctttcaatatcccttgttttaaaaagcccattgtgtcattctgtgacacctgctactgtaggaccagagaataaatgagaaatccaagcagtgttctttggtaatgcctatggttgaatcttctttgcagagaagtgagagtcttgatctgactggataactttgtgtaacttttgtactcccaaaggccatacaaactattttatcagttcctcaataacattagcagagcttggtgcctttcgtgggtaagccaagagtaagcctgtgtaggaattactacattgttgtggcatatgtaatagttcctgctgcttcagagaggggcccaataaaattgactggatttgccagctctgatatagcccttctcctgtgcagtaggtccaagtctctagatttctggtctatggtacggtccctaacagcttcatgtaaatgtctctctgctgggtctatttctcattaacagttgattttcatggtctcatgatgcccaaatgccctgacctctcctttatagggtgaagggtagctcttaccaaagttctgctgtctcccttcttttcaaaaggattaactactttggtactttagctagtttgtcagtttccaggttgtattgtttgctgtgagctgaggtatggtgtacaaagatgtgcagagtggaggccaatgtgctgatattttcccccacatctccttaccccaaatgtgtcagccttgtatgttccagccctgattttgtccaagtcccaacccaatagcctattagccactgaccaggagttgccaaaaatgtgaaacttagtaaaatgtttgtcgaaggccttctctatttctaggggtgttgcacacagcctggcccattgggcactttggcccatccccatatggaagttggagtatttgaataagggtagtaggctgttgctgtcctttatctgactcccttataccctgtgctcactccattggtaaagaaaaacattaattttcttgttatgaaagtgctggccatactccctccattccccaatgagcaagagccaggggcatttccaggggttttggcaagttaacctcactgacagagtatgtggccatttcctcacacagtagtgacactccaggagggccaggtgtagttcaatcctgtagataccattttcattttaataaagaagcttctgttgctgatccaattttatgggcagctctgtccattacccagggcataacaggaatctcggtccatagggtaattttctctgccccaccagggcttcagttttgataagtgccccatatgctgccagtgggtgtctgtctagtgaatactttaggctgaggctgagagctacttacaccaaaagcccatgggtaggcatttacctgtccatttggtccagaggctccaggaagcaaatttgggagcagtggaaacttataattgcaagtcttgtccttgggagcactagagggagagccaaagtattagcctcctttagctcaaccagtgactgtagatgttcaggtccctactgaaaaaaggaagctttacaggtgtctcgatagacaattcagcaagggtcagcaaatattggaggtgaggaaggcattgtgctataattcctaatgaatgttgggggttctttactgatgtgagcggtttaagcatgaggagcttgtcttttatcagattggaaatagtctgaacactatttctgtcctgtcaaagtgtagagatcttattcctagatttagactgcccttaggaatcggctcagataatgggccagcgtttgtggctgacttggtacagaaaacagcaaaggtattgaggatcacatggaaactgcatgctgcctaccgaccgcaaagttctggaaaggtgaccgagtgtggatcaaagactgaaacatagcccctttgcatgcacggtgggaaggaccccagcccatcatcctgaccactctcactgctgtgaaggtagaaggaatcccggcctggatccacctcagcagtgtaaaacctgcagcgcctgaaacttaggaggcaagaccaagaccggataactcaggccgtgctccgcctgtcagatagtaaatcccaggtgatgtacctgctgtcagcagatctaggctttcttcttggacaccttatacccacagtcctccaggtgccaaagtagggcatccgttcccttggcaaacccgactgctgtggggtgtcctagcagaaggtcctcgacgtactggagcaacacgcaccctgggtctctggcaggaaacttctggaagtcccgaaccaatgtttcctcgaagagatggtgggggagttcttgaacctttggggaaggcgggttcaactgtactgagtggtgacacccgaccccagatcttcccactgaaaggcaaacagtttctggctctcaggggctagtctgatgctaaagaaagagtctttcaggtccaagcaggtgaaccagctgtcctcagctgacagcaaccctaacaacatgtacagttaggcactgttggatgtaaactcactgtagcttgattaaccaagcacaagtcctgtactggcctgtagtccttggtccttggcttgggaacaggcaggaggaaagtgtagtattctgaggtctgaacaggcaggagtggaaaaacacccttccgagttcctagtgtagccttcaaattttacagacttataccttacatggtgtaattgccaatccactctcagtgagaggtggtttactgagggttgtgatcaactgtgaaacagagtcttggtcaggttctgcgaggaggatgtcaccgatataatgccaaagcatagtttctggtgaaattgaggggcaggtgtctatgtcctgttggcaatgactgtgcaattggagggctattaagtatcccccaaaaagctagcatcacaatgaagatgaggggaaacaaataccccaaaagcaagtgggtaaaggcgtactattgactctcaaaggtggaagtgaaatgtgtttgactcaactgtgaaatttttactaaacagaacatgttagccaagtctacaactccagattcaaattctggtggctttagatgccctggattaatataaacttaccactgatgttttgaatgacacccattaaggcaacaatgtcctatacaggtgctctaataaaggaaacagccctgctgaactctctatggtctatagtctccactgattagtagtgtctcttagggcaggccatatggggaattgataggtgaggtagtaggagtcagtgttccttgtttatctatgtcacctgtgacaggccataatccttcagtgtcctgcttcagcttctgctgtggtatatgaaccacctgaaccaggaggggcaggttaactggttccctccgggaagtgcccaccagtagcataaaaaccttagtcttatgtcatgagtttatctgcggcctcaggaggtctcttccaataatggggaaatggataatcttggaggggaggcaagcaggacagaagcatatttttagcaaaactgagccaattttaatagttaagaggggaattatccctttaattaatccctttaattaacccccttccaagcaggtagcctacttgccaggagggggttccttttaaagcatgtgtgtgtgttggcattagggagatttgggcacccctgactgacagagttagccagtgttgtttgtcagtgcccaagccacagttaatatggtgaaagggcaactgtctgtcagaaggggccttccgacactgcaggatccctgtgtgagagaagattcttagccatttggcaagcatcagagacaggtgtggaagataaggttacctccaaagggaaagccagctggggtgggagggggtcgtaatctaaccctagtaagtattgcaattgctccaaacattcaccagagatcatccaatttgggaccttcttgtgccttagggtctaacataacctcttttcgtcatctcgtggttgatgcatacatgggatcctggccacaggtggtttgtttggcccaggaggggcagcctgagtggtgatagtaactttgatttaggccaggtagggtattatagtgttagcaggcagcacctgactctgagtttgtctttcatgagtttctattaaatccagtgcagctatggtctcttgaattgttttagcagtagccaccatgcccagtaaagaagattttcccaggagccccgccccccgaggaacaattgagtggactcaggactcaattcagactcctccagtcttgtcaagtcatcctgccccacctcatttgttgcctccactccaacatgtccaactggtggaggagatgtttggccttggctaaccttttccctggacagtcttcccaggccattatgaggtctaatggtgggcagtcttctaatccacaaaaatacacatcagcaataaagatgtgaacagaggtccaatgtggcttcttcccaaattctgctctaattatacaggttcctttagtggggacacaatttttccatcatgtactatcgctcctaattgtttaatttcattccccattaggtggaatcagttccctgccagatgcattctgtagagccaggcagccccttgtttatttggttcttggcctgggtacttaaggagagactggggctcgggtaagagagaggataggactcctcctctgagcaggaacagacccttccttcttggctctccctttttttcttttccatttttattactttctgggtggctacaggcaaagcagagggtaagttttcccagtccctaccgtggtgacactgtgctgccttttcttctggagagcacctattctcctctccagggacctcttgtccaaactgtctctcccaagagtttgggctcttacctcttctccaggtggcatcctggtgataaattgctgccagcaaggtcagcacatgcctcatggttaggaatccttcttcgacctgacagcaacctcctgtagggttccgggaggggtaggaatataaatttctttgccttcagtcactttaagtaccactctagctagctcagtccaaaggttgagatattaatatccctctggagaggggatagcatgatgacaactgcaacatcataattgagtgtaacaacagtagaggcatgctacctgcttgcaaaggcctttccaccagctgcccttaggagaccagccttggcctgatgtctctgccttattggctcatttacttgcctatctgtctccggggaggaggaaatcctcacatctcagactaccccaaatcctcaacccagccacagggagcacttcccaccatagcctgttatgcagtccagggtggttcacccttattccagaggcatgcactccctctccttttctattcaggtacacaggtgcacaatgtccaatgtcaactgagggggggacccaggtaagtgggctgacctccttcccaagtaccttggcatctaagaccccaaaagtcagttctagtggtgtgggttcactcaactactggtgctacctctgggccaggtcaatgaggtatagaaggagactgcaaaaagtatattgttgcggtacagcaatgagcgatgctaagcaaaactgctacagaggcattctaaatgtagagtctgagcacttaaggctgcctaggactgatttttcaattgattgtcctactgactgggtagacgctatgccaatttcttgttcacgaaaatcccatcctcctcaccacttgtggtgagttccaagatttctgggctgatcaatgaagaagacatgaccacgaggtggcagtagcgcccaaaaacatttttttttttttttgagaagggagaaggagtctcactctgttgtccaagctggaatacagtggcgcaacctctgctcactgcaacctccgcctcccgggctcaagtgattctccagcctcagcctccgaagtagctgcgattacaggctcccgccacaatggcgggctaatttttgtattttttagtagagacgaggtttcaccctattggccaggctggtctcaaacagctgacctcaggtgatccacccgcctcggccttccaaagtgctgagattacaggtgtgagccaccgcgcccagccaagaagctttttatttcggcggtgctttgacaggttgccagaaaggggaggtctctcacatcagaccttccagaggcagcagcagagggccactgagcagaaggggaagaaggcaaggtaactcctggggtagaggagaataggagagggccttatgtgtctgggcgatatgactcagcagcaggagagggagtctctgggtcagagggttctggaggcaagcagtggcatggggtcttttatagcccctgtgttttctttaaatgtggctagcagatgtcagtgcagttttgtggggcatgcaaggcaggcaagccctaagtggctacacatatgcttacttgagctatatttaaagcaattgcatatgtgaaaaattcgagtttggcgttggcaggctttctgcctgctgtgaggaagtataatggcaatataaaggctaatatatggaggtcatctttaacccactgatataataacatgccacttagtcagccactctgattaatccgactagcatggtctgagataaaatccattcaatctgtactgtcaacagtactctaagcagcaaggtgagatcaatctgcaacgttaacccgaacttaaaacgttaagcgcacacgtacaatactactgctcctgagtttttatctaagagaaatgaaagcataggtccacataaagacttgtatgtgaatgtttatagcagcttcaattgtgctagtgaaaaactggaaacaatccaaattaccatacaatgaaatactatactatgacaaatagtaatgaactattgatagaaataacagcatgggtgaatctgaaaataactacgctgattttaagaagacaaaaaagagtatacagtgtataattctatttatataaaattctataaagcacaaactaatctatagtgagagaaagtagatcagtggttgcctagggacagggatgggatggggatgggtagggagggaagcaacataaaggggcatgagaaagccttaggaggtgatgaaaatgatcgtcattttgaatgtggtaagggcttatgattattggtaaggagttatgcttataaaatataaataatttgtattttataaattatataaattacatataatttcatttagttttaaatttaaggaatggcaatatgtcttgcatcaaagaaccctcaaaacaacaccttaagtactgcaaagtctttgacgatgtatttgccagttaacttatctttaaacatcaataataaataaaaatggtcaagacttatttgtttctatgtgtttattttagtgtgctattgctttttcacattctgggtcatattttcaaagtattatttcacattgtgtaaatgtatttttttttcactattagtaaagagcatctcaagtaaggtcctactttctactttgatggtataggagcatgtttgactcagatatgaaccacttgtggacagagttatgggtgagaaatctgatatttaaggaacactctggattagtttccactggtgagaaaataaaaaagtgatgagcactttttccaaataccacgtgatgaatcaagtactcaaacatgctaactgcatttagactattctattaccaaaatattccaatcaatgcctgtggacagtttgtaaactgtcattcccaatgcctcctcattcttcaagttcccactgaaaggtctcatagcttatcagacctttgggggaagtgctttttttttttaattaaaagttaagtcatgtgcagggcagagtgaggcaaaatgcagccagtggttaggacctaaagacctctccttcacctgggccttgagagtttgagagaagctcaggaagaaaagccaaccatctgagtccagtgggctttgaagcagtggtcttgcatctgtacatgtgggataaatgatgtgaaaaccattaactctgctgctgatccagctgcagggaaaagcatttcctctgatcaaggtgaacatctggctggtggacctcattttgcaccaggtcctgatcgatgagctgagcctgagtccacagttcacctgatggagaactcagagtcaaagcccaggcccaagtgaggctgtctgactgctgcttgagggcctagggaccacacccctggagtcaggagggcagaggtgaggatgacagtggaatggccagaaggtaaagatacatgtgaatattctatctccattaggtcacatggatgaaaggcaagagaaaagtagcatatacatttttgagaagttaaagctgataggacacaaagatggttgattgttctacagacgtggaaggcaggggcttaggtcctgtaaagtcccccactgagcaaataactgagacagtacttcctagtgatgcattctgctgtcaaacagtgtgaaattttcctggagaaggctcaggccatcagtccctggtccatcttctggccccacagagatgctgatcgaacaccctccacagggagagcattgcacaagtgattccctttttagaaattcttctaagccagtcagaagaagacaagcttgcagatggaagggaatcagaacctgggcaatatcttgtagtggccgagctatccctgtgtgtggtttggagtgttttcactaagacaaaacagtgggagaaagaaaaaccctacacccatacaaactttgagggaatactggagcttattgtaacagacactggtcatgctatgaaattttattaccttttctggaggggtcgcagggctttgtgtttgggctgctttccgtggtgcagtaattgtcaagcttgccaaaagtgtgacagaatcacggaattacccttggcagaaacgcagaattactcctaacctctactctcatcctccacctggaccagacagagaaacaacttcttgagttttcagaaactaccaaatcttggctctagctccgcatccttggccagagcatggaaggttggggtgagggacacggtgaacaaaaactgcatcctcgagctgctcgcacttcctctttccctctttggtcttgtgtgtggggtcagaggttaccaggcaggggtcactaaggttgtcagtgggaggatgtgagccctagtgggttcctcccaggcagctcaacatgggaggctcccaattcccctttctcctgcaaggaaagataccacagctgtgtcattctccttcagagactgcagattggaggtctgtttttccacaaaacctagttctaagacatttctagcaagtgagagtgactgattggaagtctagtggtgacagctacccatggggcaggcttaaatagcgactcctccttgtagtgaacgaatttcagatttcacacaagaagggcaaaaccatgggctattttctcccatgaatttttgcctattttgggccctaaatcaaattgagaaaagtgtgactaaaacactcaaactgccaatatagttagagatatacactttgtgagactaactcgggaatctactgccctgcttctgcaaggataaggctctgtaaggcatgacttgaaatgaaatccaagcaccttttatctgtttaactctggtgcaggagaacagagcagcatttaaggtataaattaaattagtctattcctgaagagaacatttgctactcacatttatggtggaagatgcaatctcacaacacaacaaagctctccttgtgagtggagcaggccaatactgggtagggctagactatagggctcacaggctctatgccctaagctactgatgcccctttgtgccagaggctgggttttgcaacaaactcagttcaggtctgggaacactgggcccaccgagaatcctaaatagtcaactaaaatccctgaaatacccaggcctgtttctttaatcattagtattgtttgcatacctttaggaggtacaagcgcagttttgttacatggttatattacccactggtgaagtgtaggcttaccaaagcaaaaacagggtggtagataatctcccttgtgcaatcaacaactataaccctggcaggtagggtgcctactattcatactgactacagagagcctggactcctctaacctgataaaggatatgaagccagttatctatttattacctcttagctccaaattcaccagtcaatatatattcttcgataatagagggattctttaagcatctctcctttaaagtagcatcaaagagcacgatgttacacttacttaatagagggctctggagggacagacattgaaaaaggaagggtacttctatgatttctggctctcagaggtgtggaggtaaggacattcaggatgctttgtcccaggcctgggcccagaacaactgtccctcagtaaacctgcagtcctggtgtgccctgatgatcagcttcttgtggccctcttgatagggacatcctgtactccaagtcatctgcccactgcttccctctgctcacttgctccgcagccacacacacacacacacacacacacacacacacacacacacgaccaggttcatgtagtcctttcaatactgcagccctctcaacaccgagcccccaccctgatcctgtgcaaggggcattgtttactccaggcctccaactgagacaggactcccaacccctacttcacaccacatactaggcaccagctatggcttgtccacactaccatgctccaaagggtgccttcttgcttcctctgcgaccgtagaccagttctgcctctgtagaccagcttaggtactggcaaaccagtggaacttctctgccatccagtaggttcttctccaattaggtataaaatccatccttggggagaagctttcattctaagcttgtctttccttgggtactctctcccagccccagaaaaccccacatagagttgtcttgtatcctatacaagatcttttatcatcgcttaatgattctttatattaaattttccccttctagatcactgtgtgctttctatctcctgattggatccatattgctgcagaacacaacatctacagcaagcatcattcttaatggagaatcactgaaagctttctcttcaagagctacatcaagtaaggatatccactatcaccacttctatgcaatagtttactgggggtaggggcggggtcccaggcagagcagtagggcaagaaaaaggaataagatatttggaaaggaagaagaaagactggaactattttcagatgatatgacagtgtatataaaattctacaaagtattacagacaaattattagaatcgatagaagagtttatatgcttataggataaaatcttaacgaacaaaagccaattgtatgctatttagagctataaatttagacaataaaaatttcaaacatatgatttgcaaaatattaaatgcctaggataaaaaagttgccttgtgggaaaaatataaaataatatttgggcaaattaaaggtgatcttattaacagaagagatagaccataaccacgaatcgaacattcaatattgagaagtcaaatctaaaatatcagcacaattcaaattagaaccccaaactagctgttggttgaagtttttacgattagtttataatttaaatggaattgaaatggaccaaaagtagccaagacacttttgaagagcaaggtagaattgatttgcctaatccaaatatcagaattgactatggatctgtagtaattaagacagtgtggtatttcaaacagacaagtgcttaatagagagtatagaactagcccacatatgtgtagatacttgatttatggcactgtaaatcaactggcaaaaggcagacttttcaataagtggttcactgagaaaactggatattcacttacttacatacatatatacataaatggaactctacttaacacaatacacaaacatcaattgcaggtggattaagacctgactatgaaggacaatagcagacatattttagaagaaaatatagagaatgctttcatggtccagggttccttaaaacagaaaagatttcttaaaacaaaaaagcactaaccatcaggaaaagaatgatgaaattgactatattataattaatagcttctgttcacaaaccggagcacaaagcaagtgaatatacaaacagagcaagggagtattttggccgcaggtgtggaagagtatttaaaatatttaacagactcattaagtcagtatcagatgaacaataaaatagaaacgtgggttaaaagaggtaaatttgaataggccttcctcaaaatagaaactccaaaaggctcattaacacaaaaatgtgctaaagcttaatagtaatttggatattgcccaccagtagaccggcaaaatttaaattcgggcaatacttggtgtaggtgaacatgtggatcagtaaggactctctatgctgctggtgggattgacaactctcccaatcactacagagaacaatttggcatcatctagtaaagctgaggatatccattccctatggccctgtgattctattcttggatatataccctagagagatttttacacgtgtcccattagaaatgtgcaagaatgttcacaataatcattgaaaagtagaagcaatcctaatctccatctgctgtagaatggagtggaataatcatacaataatcactttgctataagcatatgctggaaagacagtcgatggagacaaaggatctacttacttatagctattatgaacaacatggacgagtctctcaagtataatacagagtgaaaaaagcaagctataaaaggaagcatgccgtatgattccacttatacaacttcatatcaactctattgtttagggatgcgtacaaaagtgataaagctataaaggaaagcagtgaaatgattattacaaagtcggagcaattactatatctatataggagagtgtggtttgtgactggaaggagtacagcagctgtattctgggaggttggcagtggtctattgcttgaccttggtcctggttaagtaggtgtctgcttttgtaaaataatctaaactatacagatacgttatatgcactcttctaatttcagatttgaaaagtgcttcctccagaaaaagtaatagaaagaaaagtatgtggagtagaaattttgatgaggttcgaatagttatggttgaaaaacttgattttcaagagaccaagtgtccactgttattaaaagagggcgagagagctgggagtatttaaacaacaggttacacccccccacccccaccaccaccaatctgttcatcactctaagccttctcatctcagatatttcaccctatatttgtgtcaattccaaactcattcgtgacagacaaattggaggattgtcgtcatcattaataaggacattaggcaccaaaggcccagcaagactgggccaccacacttaaatgtgagcaggtacaccggggcgagtggacaagatcgtctgtgcacattacttggcagagtccattgagtgactgagggtttaaccttaacacatttaactggaactcctgcccagagaatgtgctggagaatgcagaataaactgagcaatgccctcattgtgctatgagagtggacatgaagtttatcatggtacaaccgatcgtcgaagggcaaagagttggtttaggttgtgcactgtatagggagaagccaggggcgggttgggtttttttccagatttcagtataaattgtttcatcctccagactttgcatttgtaggctgaagagtgctaatctgttttggccgcatctctcactcattctaatctctgttatcagcagacaaaaattgaactatgtggcaaattgtaccgagcactttgctcaagacaattgtgagtatggaagttgtcccgcgcagaggtgggaaggggaagggcaatttccgcagaaatgccagcactatggtggtttaatgctgacacagagacagttttttctctcaggaattgtctttcatccatcaatccagccaggtagccagccaataaacaaattttaacacacaaaaagtatgaagcaacatgtctaacactgggaggggctggcgtgtgtttatttgggtatatacaatgagtcacggattaaaattgcttttaccagatagatacctaggtgttccacagcattattgaacaagatgtcgtcatttccccattacttcagaagacctccttaattacttatattaattgtagaatatatttatgcataccaggctctacctctgggctttctattccgttccagagacccagtaccagaatatttaaatcactgtggcgttgaatacattttaatatctgatagggccagtttctgcgcattgcacatttttttttcccctttcaggaacgtgttcaggcccgcggcagggggcgggatcgcgcctcctcctcggctctggttccagccgagcctctcggacgcagagatggaaatcccgaagctgctcccggctcgcgggacactacagggcggcggcggcggcggtatccccgcgggtggcggccgagtccaccgaggccctgactcgccggctggccaggtccccacgcgccgcctcctgctgccccggggcccccaagatggcgggcccgggcggcggcgcgaggaggccagcacggcatcacggggccctggcccaagcctgttcgcgccgaggccccatcaacctagcggcggcggcgacgacttcttcctggtgctgcttgacccggtgggtggcgacgtggagaccgcgggctccggtcaggccgcagggcctgtgttgagggaggaggccaaggcgggcccggggctccagggggacgagagcggcgcgaaccccgcgggctgctctgcgcagggcccccactgcctgtccgcggttcccactccggccccgatctccgcccccggccccgccgcggccttcgcgggcacagtcactatccacaaccaggacctgctgttgcgctttgagaacggcgtcctcaccctggccacgcccccaccacacgcctgggagccaggggccgctcctgcccagcagcccaggtgtctgatcgccccccaagctgggttcccgcaagccgcgcacccgggtgactgcccagagctgcggtccgacctcctgctagccgagcccgcagaacccgcgcctgctccggcgccccaggaggaggcggagggcctggccgccgccctgggcccccgcggactgctgggctctggtccaggcgtggtgctgtacctgtgccccgaggcgctgtgcgggcaaaccttcgccaagaagcaccagctgaagatgcacctgctgacgcacagcagcagccagggccagaggcccttcaaatgccccctgggtggctgcggctggaccttcaccacctcttacaagctcaagaggcacctgcagtcgcacgataaactgcggcccttcggctgccctgcggagggctgtggcaagagcttcaccaccgtgtacaacctcaaggcgcacatgaagggccatgagcaggagaactcgttcaaatgtgaggtgtgcgaggagagcttccccacgcaggccaaactcggcgcccaccagcgcagccacttcgaacccgagaggccttaccagtgcgcgttttctggctgcaagaagacatttatcacagtgagtgctctgttttcccataaccgcgcccatttcagggaacaggaactgttttcctgctctttccctggctgcagcaagcaatatgacaaggcttgtaggctgaaaattcacctgcggagtcacaccggcgagagacctttcctttgtgactttgatggctgtggctggaacttcaccagcatgtccaaactcttaaggcacaaaaggaagcacgacgatgaccggaggttcatgtgccctgtggaaggctgtgggaaatctttcacgagggccgaacatctgaaaggccacagcattacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctctcacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatactctgactccttcgagcaccctttgtgaaaacagtgtctcagaactactgacaccaaccaaagcggagtggaacgtacatcctaactctgacttctttggacaggagggagaaacccagtttggattccccaatgcagcaggaaaccatggttctcagaaagaaagaaatcttatcactgtgactggcagctcatttttggtatgaagcaactctattcattccttgccatgtggctaacttttattacagtcaattttgaggatattctggactaaatatttaagtgcagtcatttctttttggtttgcaaaaagagcacagccctggactatgagtttggagatctaaattctgatcttgagtctggaactgacaagttgtgtgaccctcagcaagtcacttaacctatctgagccttaatttccttatttataaattgtggtggtttgaacacattgctcataaggtcttttcagttttgttttgttttgttttgtgattttgtgctttttcttgaaaattttcgggcattttgcaattattattgtttgtacttgtaatcagaagcggtttgagccctgtagcactaaataatgaaagattgaggaactggtgttttacattaaaaatttaatggaaattttacacagtacgaaaatctaatgatagagctcaaaaaaaaagagctaaaaataggagttggttcttcttagctgtttatccttctaaccttttttttaaatgatgaaggtatgtttttgttgtggaaaatacaagggcttttgttatcactcagacccagagtgaaatgtttgctttgtggttttgaataagttggcctttaataagttatttagtctctcttagcctcagttttctatctgtaaaatggtcatagcaatgtgaacatatgtgttacatcctagacttatttttctaccccagtaggttgtattgaaaggaaaatgttatatgtgtttcagcatgttttggtgaatcttcattccctttcctgccccttgttttccctcctcaaaggggagaaattagcacaaattagtatcaggattgtgcaggaaataaacatttgtgaaggttaagaaagaggaaaaggaagttatttcttcaacagattaaggatttttctacacacagttcttttgtggcattggccacatgtccattagaccaatttgatagtatcttcggtctgcattcaaagccagctcatgcaatgagtattcagcctattcttccaagacaatctggacatagaccagagggagatttttctcccctctgtgccctagagagctcattgctggcttactcttagagttgaaatgagagggttttg

SEQ ID NO: 1017 - DNA, 2121 bp, Homo sapiens
ctgctcgcggccgccaccgccgggccccggccgtccctggctcccctcctgcctcgagaagggcagggcttctcagaggcttggcgggaaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgcttgatcccccaggccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaa

SEQ ID NO: 1018 - DNA, 1320 bp, Homo sapiens
atgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaa

SEQ ID NO: 1019 - DNA, 96597 bp, Mus musculus
  misc_feature (8196)..(8446): "n" at positions 8196 thru 8446 can be any base
  misc_feature (29221)..(29240): "n" at positions 29221 thru 29240 can be any base
  misc_feature (43067)..(43340): "n" at positions 43067 thru 43340 can be any base
  misc_feature (59328)..(59671): "n" at positions 59328 thru 59671 can be any base
  misc_feature (64349)..(64381): "n" at positions 64349 thru 64381 can be any base
  misc_feature (85457)..(85866): "n" at positions 85457 thru 85866 can be any base
gtgcgctcaagatagagaccagctacacagcaagttccaggtcggtgtgggcatgaaacactgtctccaaagccacaggagacaaagggggggggaacaacaggtaagggtgaccatgtaaaaattaaaaacttctgtgcttttaaagaagaccattaagaaagtaaaaaagacaaaccttattcatgagataaaatatgtgcaacttgcatatctaacaaaggtttagtatctaggctatataagtaatttttgtaattcaacactcttaaagcaaataactcaataacaagcaaagaattaaaacattttccagaaaatatgtacatgaaacgacactcgacatcattaaacattagaaaatatagattacagtcataatgagatgtcaccttacccccagtgagatgaacgtccgaaagactaccacaatgcctgtgggggtgtggagaccctactgatggattgtaaaagagtactatcatgggaagcgttttgagcagttgttcaaaatgttaaagaatcagtgtatatcccagtacactaaccaaggttctccagagaaatagaagggtgtgtgtgtgtgtgtgtgtgtgtgtgtaagaaagactcgagaataaacgagaataaatgtgttttgaggaactggttcacatgtttattgtggagggcaatattatcacttggacaggatctaggatcatttgtgagacaagtctatgggtctacctgtggggattgtatagattaggttagcttctggccaggcatgtgaaggattatcttgataggtttaattgaggtgggaagactcaccccaagtatgggcggacacattccctgggcttggtgtcctggactgcataaagggacagagggggggtggcgggggggcgggggggggagtaatctgcacaccaacagtcaccattctgtttccccacttcaaatgcagtatggccagctcaaacctaccatgacagactggatccttgaactgtgaaccaaaatgaaccctttgagccttaggttgcttaagggctccatgtgtgtgtgtgttaatttttttccaaggaaggagtcatcaggttgtaaaaggacctttgataggagaaatgttaaaacattatttagagtgccaggctaattttctggccgtgtgatacattgcactaagtggtaggaagattttatcacagcaacaggaaaagtgttgagaaaattaagacaatatggaagctaacaagtctaaactctgtttagactctaaaggcagacagtctgctctccctcagaaaggccttcagccgattgaatgaatcccgcttgtattctagacagtaatttgctttacttaaagactacattagtaaatgctaagcccatcttgcttcaagagcagaaaccctagtgtggactgaataaagattgcctcactcagtggtcagagtgagcagatggcatactcccaagaagcaacataggaaagactaaatgattttttttctttttaagagcagaaaatgtaaaacttaaattcagagccgggcgtggtggcgcacgcctttgatcccagcactcgggaggcagagacaagtggatttctgagttcgaggcctggtctacaaagtgagttccaggacagccaggactatacagagaaaccctgtctcgaaaaataaaacaaaaccaaaacaaaagaccaaaaaacccttaaattcaaagggggggagggttgttactattgtttgtttgtttgttgtttgtttttaatttggtttacgtttttcagtgatgtaagtggtggaaagaatcaatgtcagcaaaaaaacaacaacaaaacaacaggaagttaagttggatctaagatgactgtagcgcctacagaacatcagctagaccaacacagcagagactgaccagaggagcgggtgttcccaacactgtcagctaacttggtgcagccatgttaacaataggattgaccagaagccaggtggcgatgtccctaaagccaaaccagtgctgaggcaaacagcaccagaggaaatcaccccgagatgcccggggccttagtgccagtgctggggcctgggaacaacatgaactctagttcttctacagattttaatctggagttcacagatgcatagaggacccctaatagacttgaaaaggtccttgaacctttgattaccacatggagcagttttgtgtgtgttaatttttttccaaggaaggagtcatcaggttgtaaaaggacctttgataggagaaatgttaaaacattatttagagtgccaggctaattttctggccgtgtgatacattgcactaagtggtctggcactcccaagtcttggactaaaaatgaattcttagtgcatgatctcactgcctgcagggcagtttgattctgccctggcatttgatgggacttgttagaggattcggaaaggcaggatgttggtacgtttgaggccattaaaccaagaaggaagaaaaatatattgtggagttgaattaaatgctgaatggctaaggacattttttatggtctttgtcaacactcggaaggaaaccctgcttagaaacaagtgagtgacaaaccagctccgtctagatgcagcatgttgggtaaacaagtcgtctttccaagaaacgccgcttcagtcatgctttgatagtggagaccgggagggctgggatgcttgtgtctgtgattataactagtatatgacctagaaaagcatccaaaggtccttttccatatggagaccagagttcctacagctctggtgtcaaatgtggaaaacaaatgaagggtgtgtcctggaggccctgatctataggagagattctatataaaatgaggcacagccctcaaagtgcctctctctccaggcccttgctttaagtcttatttttggtcttgatcattaattcccattacagtagatggacagtggtgatggttgctcaaccagaaatgtacttaatgaccactaaactgtttatctaaaatgatgaaaatggccaattataaactctggatactttattatgacaaaaacataggataatacagagtggcgacggtccacttatcttatgtgagaagatttctgtgcaggagaactaagcgttcagaatcttgtcagtggccagtctcacccagagagatcctgagggccctgccagccagggaagaagagaaaaaggacaggccaatttctgtgtcagtaggaataatgagccaggtgagaaatcacagatgataaataaagtagagacgaggatgggtagattgatgtgagatgtaaggtgaagatagaactgacagcctgtactgagggcctagccagcagtgaggagcaaagatggttcgtggttttttctgctggagcagttgggtccacggtagcatcttctgttgacatgctgcctcatgcctctcttacctgccgctcgcctcacttgtctttaagggctctcggcatgacttcctgtagcctttccttgctttagctgccatccttgtgtggccccacagggtcagctcagaaacttgtgagtgtgggatccggatgctcaactgtgttgcctggatggcacgaagcaagccagtctgcagatgagactgagaggctgtgtggctctcaagaaagggtcagaactgtgcaggatctctgttggcttctagaagaaagatagcagaggtcttagaagactgcaaatcttaggaggaggcagaaagatctctacaacttgaccaagtactgaagctaggaggaagagttaaggcattgttgatgaccatccaagatccaagaagaaacattcttcatgaagttgacagaagcccctaagaggtatgcctgcttgcagcccacagtgaacttgatgtctggctgtgtgatatagtatccttgaagtcacgtgggcactaataccccgatgccatttgagaaccgactctgcggatgttttctgggtgggcgttgccagggctgatgatcctctctagaggctggatttcaggatgagattgctattatgggttttccctgtgatactcagcaaccatggaccatatgcttacagttactcctcgagggaactctgacaagatgatgatactgctttttcaaaagaaactacaacagaaggggaagtggggggacacacctctaagttgtaatgtgcttcacaacgcatgagcactaacaaactaagcagtcggcttgtgtacaaactgccatggcatctgctgctttgccaccttgctttgctgttttactgagtacacagaaaaagtgaacaccatttttttgaggaggggaacgtactctctgactggtagtgaatatcagtgttgtgtaggaaagaggtggctgcttccttgggtgagcctgggtagtccctttgtccagcggtgtgcccttaggtaaggcactttgagtgtccgagccaaggttcttttatcctccaagtgggctaataacactgaaaatccctagctcagtccctaatagaagttttcagtaaaggaaaatcacggtagtaatacagacgctgtacccacagactggtgtctgttagttacagagtcaatgaaagtctaggaattagttcagattagctagttttcactcatttgtttttggttacttctccttttcttataactcttttttccaaatcgcttggtgacaaatagttcaggttgcaacctcttttaggataggatagataacatctgaattttgctatatctgggaacataaacaccgtccttggttgttagacagagtgaattcaggctcaggaagagaaggaccgatggtctgagcactgtatcccagaaactgcattccagctacagttccacagacagaacaactaggtccctgcacctgaaacatgtaaatggcatctccctagggtatgtgcctgttcgtgtgcacctgtgtgtgtgctggtggttgtctgtgttgtatgtgtctctctctgtctctgtgtgtgtgttcaatcttaattcactttctccatcttattgaagtgcctttatctcttccccctttttgctctgtgatagcacagggcacatttccttgtgttgctttcccagggcagtagaagacacaagagccccaagatttgcaacccaaacatctccaatccacatcataagtggatgtctaaattctgtctgaaagataatttttaaattcatatttatagattccaaaatttaatgccaagtgaacccattacttgttaaagcttttctggccacaaaatcgtgtccacatttagtccttcttggtatgagtaaggactttagaaccactgtcagtaaatctatagctaatattttggcagaacatttgaacttgatcttgcttagtagcaaataatctctaaatgtttttatttttggaattgaactttttgttttccgatcactgtccattctctaggcactcaatccagaagtggggaatgcccctgtgtaaatggggattcgtctcagtattagccctaaaaaccagtaagctggttttggacagaagtggtagcctgaacctagaaaactcaccttgacctctctgtgcagcatctctgctgagaaaactgttgctgatttgtagagagcatccaccacttcaggagataacattgataaaggagagagaaggagaaacttttaatcccacagccaaggggtgccaccgtgcatggttgttagcgtgcattcaggctcagcacagacatggaccgatgctctgaatactttattttctatcctttgtgttaccccacatcctgggaaggtgggaaggagcaattagggaaggaatttaatctcaggaagacaccagagaatcagtgctgggagtgagaggagccctgagctacctctctgtcttgaagaagtgattctgctcgtatgagatctatgtgtgggtgaaaatgcctccacctgccgtctcctgggggaagtagctcatcacatcctcttaagcccactaagaccagctcagctaggagttaagctgtcggggataaagaacgcaatcagccttgcctatacaactttccagaaaacccaatcgtttcgcagctaattggtacaaatgttcccttgcccgctgtttacagctggagaccctcttgaacatttttatgtaattaaacaccatttactcttcctaccttaaaaatgcaggtcctgccgactctttcttttaagtaaatttaagattacgcaagagggaattatagacagataatttcccacatttgcagtacactactttatttggaaatgaatgaatagaaaccactcacacgtctacttctgcagttccccctgcttctcttaacagtaactatgaagaaaggaaaaggcggtgttgtcatgcttggtgtagctgtaccacagcacatcacccactgtttcctgagaactgtccactgagccactctgtgtgtggagtctttggaaatcaatcttgttagaaaatgcagtcgaggcaggaagcgtccagcactcctgtattcaccgttgtttctaagaggccaggagttcagagcgcttactggctgaatgggggtgatatgtgctatcctgtgggccactgggcctggaagacctccaaaagagcagtgtcctatggttgtgttgtccgctatccatgtttagctatttaaatttgacttaacttaaaatcaattgctcattcttagcaggtagactctaggtactgggtcgccacactgaggctgctgtgctgtgctgtgctgtgctgtgaatgctgaggtccccattatcatagaaacctaaattagtggccccaagatttttaagagcatcccttgtgactatagcatatagttaacacaaaaatcctatttaccaacctgcttgagactagtggtcaaatagcaatcagattgctagcaagacaccatgcagcagtatgaatttgtttgactataccagttggtgaaataatgaagcaccagagttaacagaggctcggtgctctaagctcttcactatctgctgaggctatttccctaaggttctcgggcccttcttcagtcatcgtaaagtgaggaagccaatgacctggagggtcacaacactgcaggccagattggtggctggtgctctaggtgtcatggtgccttgactttgagaaggggacactttctaagggtcattctgtaggctcacataccactgtcatggccatgacccaaatgacagaactatcagcttcaacaagacctcagacatcatcatctcatgacccaagagagtcactcagctagtttgtgaccaactgagaaatacaacacttagtctggtatttatttattcactcatctattggctacctctttctgtgtctactgtaaaatggggattattaaccttaatgcctggcaacattgttaataaaaagcaagatgtttctcaaccttaaatgtatgtcttataatttgaaaaatccccccaaaatccccacatattcacatatattcatatacatattttttccacctcatttaatcctaagaagaacctgtgtgaagagttaggctcagaggcagagcacctgtcccacataaggaagccactgtgacacagagggctgtgtctctccggacttaggaacaataatctcttgtaaatgtacggcaatacaagcatgtggcattgctagctttgggcctgtggcattttgcagttcaggagttagcgatgttggaagttatggctttgctcgagtggtgcattttttcttttttacactttgataatctgccagttgcacagactttggttcggcatgggcggctttgaagtatatttttaaaatgagagaatccagatttgtaattagctttgcaaatgctagttgtacagtttcagcatccgaggagctcctgctaatgtccctgttcctagtggcagctctgtgtgattttttttttattccctctccgtcccccaagcaattaggagaaacaaagtctgctctctgaggatcacttcctcacctcttcatttgtataaactatgagcttggtgacctcaccgaattaacgatatacctgattgcaacaaaggacaaacctttataagccactctaccctcttaggctcctaattcaggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtatgtatgtgtgtatgtatatacatacaccatgtacacatggaatagcatttagtgaaaaaagagaccatgaatttgaggattttggaggggtatgcggaaggctttggaggaaggaaaaagaaggaagaaatgtagttataatatccaaaaatctttaaataattttttagagaacaaaagaagaaccgtggttctgcatccaaagtacccaggttcagttcccagcacctacttggaggctcccaactgtctataactccagtctcaggggatctgacaccatcttttggcttacgcaggcactatatacaggagggctgcatgcacatggtgcattgttatacattcaaacaaacactcatacacataaagtaaaaatatataaaatctcaaaaaaaaaaccctaaagaaaaacttgtgaggacatgcttgaagctcacatcaccaacgtggtcgcttgttagctttctagagacccaagaaatggtcagaaactcaggcagcctgacactcaggtgaccctccgtgtgtcgcttgcagtgacaatgaaggaaaacaactgataagtcctcatttgagaaaaacaattgaagtgtttctatgaaatattataatactacagggattcaaaagtgtgttttcattaactgtagcaacattgcgacatgttctctcttatgtaactcatatttaatttcatatttaataattaaataaaaaccctctatgtttgtgtaccaaaagaatactggtccacaatccaattttaaatccaacacctttcagggtgtggagtgtgtgtgcgtgtgcgtgcatgtgcacatgtgttcatgtgcatgcatgtacatgtgtgtatccaaccccagaagttacactgaatgggcagtgagcttcaacaacaaaatatccttagtcatttattggtcaaagttaccactgttcattattttttttcctttactctttacctgtttttatgtgctctacaacaaacattaactcattatcagagaagaggaaataaatatgtctaatcttatgaatgaaaattttatctgaggacttaaggttaggttaaagccaacaagaagcttgtctgacttgaaaataaacactttggaggcatagatgtcagccagaattcacaagttaatctagaacctcttttagttaagaccaccacttcggcctccatactggggcgtttgaatttgatgaagaacgccttctgagatgcagccggagagatcggggtgactggatcatagccacatccaagctgtgggggttcaagtgaacacctgataagggaagcttgtctgcagggaacgcctgcagaggaggtcttctgcccgaatagagcctagatattggtacctaggggggattgtcttactctggccttgtagttcgttgaagagaaacactagaaccactgtggagtactgtgttgttctcaaagttgagtagagtttgtgaggcagcaggcaggagattcacggtgtgcaacactcatccactaacgaacgggctttcccttccggtctaggtggacactcactgatctatcacaagattgcctcactgagtttgggggtccatgtctgaatggattgctgtagccttctcatctcttcctctgcccagttcccagcatcctaagactcgaagccaggacaggacctggggaaattatatgtaagtttttactaagatttcttttctttaacccaacaaggctcagtgtgaggcagtcatgccaataatccaagcacacaaaagttaactttcttttaagaaagtgtcatgagaaatgtaaattaagcaagaaacaagggctggaatcccactgttagtacttccttagctcagtggttcttattgtcagcttgcatcagagtcacactggctgttttgagccaaaagatctggtgtcagccagcaatctgctttactaacattttccaagtgatgctgatgtcagtgccccaaggccctcactttgagaatcaccactttaacataactgtgttagaggagtgaatggcaaaggcgggaatctatatgctttaatattgaatacattaagaggtagaacctgtacttacctcattgacacatacctcagaaaacagctctagggtctgcacggcggcttcagctcagaagtccagtggttaccacgcgccagcattcctcctacactgctggccactctttgccttggactttaggaggtcagagtaacggtgcagctgttagcttgagggagtggccacagtcccttgacaagtgtgcacaccatgtttgatgtcaaaaggagaatccgtggctcctttgcaaagtgaatcttcatagtaccatccctccctggtacactgaaatgtaatttcatttacaaaagacacatcaggggaggtacacctccagtaaacagtcgctgagcaaggctcggtttttatggatttccagagcctcagtcctgccttactttgaggtcagctcattaccatgttagcttccaaaagtctaactacttaacctaagacagtttaccctgcactgattcaaacccatgaagagtttggctaagtaaatcctcacttggataaggtgagcggacatacagatgtacatacatgcttgtgagcatgctctgtttccaagccaatgtagacatttaaagtatttttctttcatttcattaaataaatgcgaatataaaatagtaatggtgatactgtcctgtctaggaaacatccaagaaattgctgggcattttaaatttgtggtaaggcactacagtttataacgtttttcttggatgtggtgaatgttgtcatgcaaagtagcacttgggatttgcaattcttttattatcatcatcgtcgttattattttaattgagaatggccgctgtcgatacagtatttgccacccagctatgttatcctagatgaaataggccagacatacttagtgctgttgctcataggaggtacctggggttgtcagactcacacagtccatagggagaatagtggctgccagcaggagggcagaggagtggggtgtatttttcaatgggtacagtgtgtgagctggaaaggttatattttggtagaaggtggtgatgttggttacacagcaatgtatatgttctaaagtctcttatgttacagtctaacataatttttttaaagcataatagcagaactcagtcttcctttcaagaatgctggtccttggcagcaaagtcacagtttgagaggctgcggtgccatcgtacaccgcactctcattgtgctactttttgttttcaatatttttttttacttattttacatcctgatcacagcccccccttctcttctcccagtcccacccatacaaatccgtccccccatttcccccttccccttatcctcagagaaggagagctcccttgggtgccctatcctgggacatctattcccagcaggacaaggcacatcccctcctaccgaggcccaaccaggcagttcaagtagagggaatgtcccatggcaggggacacagaccgagacagccccctctccacttgttagaggacccatatgaagatcaactaggtccagtccctgatgtttggctatgggtctctgcctctgcttctatccgctgctgggtaaagcctctcaggagacagtcatgctaggtggctgtctgtaagcctagcagaggatcatagtctcaggggctggcatgcccacatgagatggctctcagtcattggttggctgttccctcagtctctgccccatctttatccctgcacatcttataggcaagacagattttgagttgaaggctttgtgggtgacttgatgtccccctcccacctctggaagtcctgcctggctataggaggtgaccagtttagtctctacatcccctgctagtaggaatctcagctagggtgaacccatacactccccatatcctttcccactccaagcttccaaagagtcccagagatgccctcccccatgatttccattctcactcccagccctctactgtcctcctcccttcccacacctgatctccatgccatctccattctctctctcaccccatctcccacccagttccctctctccatccacatttgataactatttagtttccccttctgagtgagattggtgcatcctcccttgggacctccctattactgtgagttgtagcatagttatcctgtactttatagctaatatccacttatacgtgagtgtatgccgtaagtgttttgtcataagtgggtcagggctaccttactcaagatgatattctcaagtttcttccatttgcctgcacaactcatgatgtctttgctcttaatagcagaatagtattccattgtgtgatgtgtaagttgtttccagcttctgactactatgaataaagctgctaaggacgtacttgaacaagtgtctttgtggaatggtggagccccttttgggtatatacgtaggagtggtatacctagatcttatatagagctattcccagttttctgagaaactgccaaattgatttccaaagcgcttgtaaaagtttgcactcccaccagcaatggaggtgtgttctccttgttccacatcctcaccagcacatgctgtggcttggggttttgatcttggccattctgacgggtgtaagatggaatctcagggtcatttcgatttgcgttttcctaatgactaaggaagctgagcatttctttaggtgcttctcagacattaaagattcctctgttgaaaattctctgtctagctctgtaccccatttttaattgggttatttggtttgttggtttctaatttcttgagttctttatgtactttggatattaaccctctgtcagaattagagttggtaaagattcttttctaatctggtgactgccgctttgtcctattggtggtgtttgtagccttacagaagcttttcagtctcatgaggtctcagcaattgttgacttagtgcctgagccattgctgctctgttcaggaagtgtactcctctactaatatgttcaaggctattcccactttctgcattagattcagcatatccagttttatattgaggtctttgatccacttggacttgagttttgtgcagggtaaatatgggtctatttgcagacagccttcctctacatgcagacagccagctagaccagcaccattgttgaagatactttctttttcccaatgtatggttttgccttctttgtcaaaaatcaagtgtccataagtgtgtgggtttatttctgagtcttcaattctattccactgatcaccctgtctatttctataccaataccatgcagtgtttattattatccctttgaaatacagctcgagatcagggatggtggcatgtgtgtttcaggaataatctgtaagctgtgatataactgctcccaggagtgatgtctaaactaactaaccctgtgggcctgtagatttagcctctgcggtcattggagaccatcacacattttggagtcagttctgttgatagtttttagaaaaatgtttgatttgatcatttataatagactcagatcccaattatattctattcatggaaccatcaaattaattttttgtatacatgatagtagttcaggggatgtgatgttggcagcacgggaatatacgttgatatattaatcacaacctccagaggttttcccccaatctccaaataagctgagctggagcgcaccgtaaagttcctaccaagtaataagcttagccgcctaaatgcgttaccagtttactctgagtctccaagcggctgagtgctagagaagtggctttgtggctgcacctgtcactagtgaaatgacacttctcactattacaggggaattcagggttcccttttgtgggttcttggtctcattaataaaaagatgctaaaatggactcggggccagcaaggtggctcagcagttaaagtaacctgacaacttcaatttggtccctagaacctgcatggtggaagggaagaactgagtcctgaaagttgccctctgacctccacacctgtaccatggcacgcgttcatgagcatgtgtatacacacacacacacacacacacacacacacacacacacacacacacttgcacgcacacggattttttttaaagaacagattcagaaggaaactcaatgatcattttattagagtttgagagaaaaacaactgggtaggcaagctatagatctcagaagccgctggcaggaggagatggagaagaagagagaaacccaggccattttaagatgcataaaagcctccatgttgagcattggcattgcgtggcaccagggtgtagggaatagcatagatagtgaaactgtctggaaggtcagtgagcattctccagacagtgagtgaactgggaggaaatgccccaaggtgttggactgcaggcacacagccctttagaggccatttcacagcacacacctcccttgtgtgtactttacacacttttttttatttttaatttttttttttgcacatgttctctttgttagatgaaacccaggtggagaaaggcttccaatctttctgtgccaactggcttcattcatatgttaatcttggtaaagcaattttagcatatattcgcttaccagattgcctcaccctcacattaatggtgaagtggcaacttgcccttctaggaacccccattcatcacaagagggcctggtatctgccacactggtggcatacactgcagagaatggctgtgttgagatgtgtcactgctcttctgccccaggacagcatctgtgacgctctacaaaccagtgggtttatcgaagcccctgtgcgttgtagattagaaactgttgtgtctagatttttcccgtattctacccttagttgacaccaaatcagataattacatgagtcttatgtattaactgttgtaatttctagaaaaaagtcagaatccaaaaataattgtctccttgtggcaaagcagaggtcacttcggcgtataccttcttgaaaaagtaaactcatgcatggttcacttaacaacagctttgctctgagaccgccagtttatcctgtggtcctcagtgtgcactcacacagcccacgcacactgaataatgtcatcttctggaactggtctgaattctcattagatccgtgttatcctacataatcgtcaaagccacataaaagaataaacgcaaatgttccctctaatctagccacaaagatacaactcacctacatcaggtgcttttgtgtgtccttccaaactgtttttatccaagaattctaacttcataagccatgctctgcactgatttgtactgaagatcttgggggcacttggaaatagcagcactaaccagacatcatcttacaggacgaagaactcctctttcacgtcttccctccaggttccattactcagcttttacacaagacacatgtggacctcccagtatccttatctagaggatgcttctgatagccgtcattctcaaccctacattcgatttaaaaaccatattggacggacttgcaaagcctttgcagctcctgggatcataaaagaaagattggctctgtacagatgattttagtgttagctccactggctaggtctggttactttgaaagtcatacttaatgcacaataagccaaattgatgggtatggggaaggctgacttagctcagtattatccacaatctagacaacacaccctccagtaaaactctaattccatccaagtgcctgccttctcttgttctgatccaaagctttccctcagcttttccttctagttcccctcccaacctcaaaagcagtgtctgttcagagcgctgggctctggtgtgcggctctcttactgccctgtgaagtggtttccacttaagggttggggtgacgcctcacacttagacagggttaaggaggttctaaaacacggaaagaaagaccaggtgtgactttaggggttgcttaagcctccagagtagtaccatccacagtccttaccttagaataggtatttagtaagcagctgctggatgcagttggggttacaaaatgggtctttggaaatttttacctttccgtgtataagacaataacttccttgaaagggaagagttatttgcatcccttcaaatcctgtgtccttcgtggaacataaactctatataggttgatgtgaatatttctgtggcaatcaggtggtcagggaacgaatgcttacattccactgggtctttttttactatctgcacccagcaattgatggcacttaagtaaatatcctcaattgtgtttgacatccgattgggtacaggtgtagggacagggcagacagtacctcgatcctccctggtgaaggagttgctaatactgacgagacttggctccttcgttttcgatttggttgcttcacttcactgagtcacagcacctgccacttaggatggccacacggctaagccagaaaccttccttcagattgctggtgacattatatatgaatctctggtgacattctcggctgacatttgtcgcctgatctcaagtgcttgctaaaagtgagttagctttgtcattgacacggagactaactttctctaacccagactagtgaaaactgaattgtgcctcaccacacgaaggttttgctttcactgtgcccagaccctcccatctgtcacagcacagtcattttgtgtctgatttgggggcggtgtggttgtttctcagtggtgtgtgacccactttttcataatacttcattccatgtgtttttacaacacaagtcagaagctgacgagagtggactgaagccccaggagcatcttctgaggctttctcgcaagctctagaaccacattctaagaagaaggtcttagccctgcagggtgtgcgtcccctaccagagagtgatgggccagttcctctagtttctggataatgagccagtgcacaggtaacgatgcctttctcacggttgatttcttttgtgtgccaattattttaccaaattagacctttaaaaatactagccacttacctgcatagcttctctgttgggatggggaggggctcaggagagtagacattttcattgatactttgagaccttagtaacttttccttaagaatctgaaggaatcaaaaagttatctctgttttctgtgtgcccctagcagacgtcctctctgatggttggttgtttcggtttggttctactgcttgttgttgtacttgtctgcgagcgtcagatacctcactccgctgtgacatctgggtgatagttaaaccttgattagcttctgcctggggtatgggcaacctgtggcgagagcagacagaaagcttcaaagaagagaagggctaatgagggtccgatgtgtcttgctagacactggctactgcaggctggaagcagacagaagccaagtgctattggcttatgtttggcaaaaaccattcctcaacacctgtttataactttatgtttctgacatcacagctgttaaccagaggattcttttaaatatcgtcgtttcaaaacaaaatgttgaaggtgtcacctgtcctaatgtcacttatcctgattcacaggacagtttttggtgaacatttatttaccagggtctgtctggcttgtggcagtatcatctgcacactggactgcataccaccttaagatgtggagcatgcccagagataagtcaaccttgttttccatgaaagtcctgagacagaaaaagaatgaaagtacaaacagtgactggaaaaagtgtcacacacttgagccactttgcatcccttgttaggacaaaccctgggctgggtttttacattcgtgaagctgtgcggtaggtggatcagtgtgggaggttcagaaagagtagcggttagaataagattttccatttattgccctttgtgcatggctaaaaataagattcatacaaatcagaatgtgtagtgcaagcaaaatcattctgttaattctgatgactggcctgcccacatctttgcatctgtctgttaagtggtccattaggaaataaatgtctctgtttaaatagcaaaggcaacctaggttttttttgttgttgttttaattctatttgtctacacatgatagtctgtcatttttcctcttctaaaggaagaaagtcataattcacacatacacgaattgtgttggtgactgaagtggtgagatccttggctgtgtctaaaaagtactggcctcgtttgaaaggtcaatttacggtgtccatcttcaaggcttattgctagaaagttatctctcatgagcccatacagtggtgaggagagagggtcacttagctgtattggaaagtggatgagaacatgatccagtgcacacccgtcctgcagcgagctccatcagcacagatgttgggaggagcagttgaccaagtgaaaacttcccttcatctggcttcagagtctcctgcaaccacagtaagtgataatgtctccatttgtggctagacgaaacaccaaagagaagtgtcggcagtgttcacagggaaatttgtacctcagtgatcccagcattgatgctgtcccatcgcaccgactgaagagcggtggcatttccagaggtgtgtctgcaagcgcaccgagcctttcagtttgatgcggtccatgaggtagatgagtcaggatgccctcttcacgatgcatcgttcaaaggcagtcattcagaagccttatcaatgggagcggcaaatcgcactcctctgactgtgacggtccccgtgtgccgcagctgaagcaggagcggtgggagacgacagacccctgcacaaagcttagccgggagacccacgcacctgggcccatccacttctcctcctagacctgagcatccttatctggaaatgagaaaaggtgcagtacctgccccgacgggtgtctgtgggatttgatgaggtaatgatgtaagatacagagccaaagctgtgcgcagtgcgctgtgcgcgtgcggctgctcattcatgttccctcctgcatctcgaaggtgtgctggagcacggcagagcatccgaggttctcccgtatgtgtacagtagaaattttaggatttaatacacaaaggctcagcctctgggtcttcattcctcacttagaaggtgagagcatttatagagcagtttctttttcttttctttttcttttctttttttcatagcctgctaatgctgcctgtcaggtgattttactttgtaatgacatggacatggtgtgcagcccttcctttgtagattagcaccgagcatattaggctatttttatccgcacactatgcttttcatttaaacccgagtatttcagttctaacatctgtgcgtgttaggtgtagtacctgctggtgtacattaggcgagcggctgcgctaatgctgtaatcaagcgagcttttaaatatttcaggtaggaactagcaaaatctcaggagcaattagcttccattgtagtttcgctccctagcgaaaacattgcctacgcagtgctgatccatcatcagggtgaccaacgctaacaggcagaagacagtcagcactgcgttcattagtttttgttaattattttctgtttcatgtatatgtgcccttctctgtctttttcctcccaacaaggttttctattacaagttaaatattattttataatgtaagggcatagctataagcagcacatagctcgtggtcaccctttcgaagccttggggttggacagtgagagttcagactagacgttgcttcagcctcctctgtgaccttctgggatgcggttctcattcatcaaattaagagagaaattgtgacagtaccttgactttgcctcacctggggcgcgatgaaagtgatgaatgggagcaataaacacagaagttacagcacagcccagaagcagcgagggttcactgtgagcagggaacggattttaactgcagagtcccttttcatgttgattctgccatcctaggtaccaaggctgattgtagcatacatattaaggtcagcagattttctgggtttcagtgttaggacctggcagtctgtagtgaagacagacattcctcaggttaaggaccaagatggtttgccttttcttacagccatatctcatcccccacattgtatccaggctgtgctttatatgcgttctctctctctctctctctctctctctctctctcaagaaaatccttttcttaagagattcttcttaagaagaatccttttcctcagagaaaatccttccaggtgactttcagagttcctggcattacagtgcatgcatgcacaggcacacacgcacaggtacacatgcgcacactggcacacagtggcacacacatgcacacactggcacgcacaccattacctttgccagcctcactgcactttgccactgaagcgtctatgagaattatagactggagaaggtgataaattaaactctggctgtgatttcctacctcacctttgggggggatgacaaaggatctgaaattcatccggttgatacactctacttcttcgtatgtaacagtggttttaacctgtccttcatgtgcagtttgagggtagtggccaggctgggcccattattcctttggttgaataatataaagaatttgcaatggagattacactaatgatgtattttaagtgcatgtccgcattggtagtttagtgctctcagtcatgaaatgctttggagtttatttctaatgggtaaatgctcagaaaaactgaaattttcaataagattgacatttggagtaagaaatataaatctaatgagagcatttcaaccaaggcttgtaattagggctgaatagagtaaatttatacatgctcgctgcagaagggcacggcggaaggtgaaattgcatgctcttctgtgaaggagcgaggaaggccaatgtatcagtgtcaggccgtgacaccagagtataaatgacactgtcaccaagtgctgcactgggtaccaagggaattccactcgagtaaattacattacttagacagacctgaaggcaccgtgctggaatgagtgcagaaaaggagaagtctgtcagcacaaagctgagaacgttgccatatagccaactgcaggatgcacagcgctggctgtgtgggacctggaagggacaatgttccggtctgttgttagcttatagacgtgacagatatgtacagttgacctagagaatgggtataagctgatttctgtgatctggtcagcattgggtttcccttattatttacagttgggtggcaatagggggtcagtgtacatttgccattctttctttttctctgttgtgagaatctaacccctgccccctcggtagcactgttcacctcatttccagccccactgtcataaaacacatggtcgccatggtcaggtggaatgtgtctgtaatcccacctactggagagacagaggcaggaggattgcataagaactctttttctcacactgtgtctttctgagagttgatctgtcttagcgtttctgggcaggaactgggagaagagatgaaacatcagtgatgacgccatctcctctcctcacttactgaaacatgcgctggtctccttttgtctggctgggatgccagtcagtccctgaagaagccaatcacagggactctagaatcagtcactcactccttggctaggaagtaaattgtcccagagagagtagtctgaaacatcagggtggctttctcagccatgtgtcacaccttatccttcttgagacacccctaaacagcctcttgggggacacgctgcatggagaacatggactctgcaggttatctccacacgggttacatggcaggtgttccgccatcttcctaacacagggcacattggacatcagaggtggcactcaggcttgagttttagtctttccaaaataatgctgtgtcagaggtggaatttcatctgcgttttgtgcctgtatagactttattcatttaatcatgggatttaggaaagccaccttacttggaaaactaggtttgagggcaggagaagagaaaatgacatattttctaatttatttaagtatacccacctttaaattacttcaagacgctctggtgcagctcagaggtagagtgcttacgcaggacatgcaaggccctaggttccatccccactaatgcataggtatgggtgtcagtctgggattctgaagtgacatctgcgtaaaagcttcacacggtgtccatgtgaagcctgagctcactgagcgcttactcatcagccgtgggaagtcagcctcgcctgcactggcatgtccccgtttccatcgcatttcacttgtgtgctccacaacatcagtaggggaattgtatgtgtgtcttggtgtttactacaaagttactacgtgacgtttttcccctggcttctccatgacagcctgctacccgaactacagctctgagctcctgtgagctgaaccctggtgaaagagctttgacagcatctaaaatgtttggagcctccctccattctgaagagcctcctttgttccaactgccctaccagtgttgttgttgttgttgttgttgttgttgttcttcttcttcttcttcttcttcttcttcctcctcctcctcctcctcctcctcctcttcctcctcctccttcttcttcttgcgtccaaattggaaagggagcagggggctctcctaaggaggaacgggtctgtggaggattgcgagcactcattcagaagctattcttagttcccagaactataacgaggctgggctttttgtcctgctgaagctccattaaggaacgatccctctacctgccacctgattctgttttccccaaggacgcctggtgttttcttccctcatattctgaatggactggcttctgagtcaggcgcatcttgcaaggcagtgagtcctgttgccgtgatggctcacctactcctcagctgtcctctgaagtctgcattagcagcgcttgctgcagacctggattcatcgtcagaagtcagcctgtccacggcagcaacttacccacattgtcacgccagtgttggcagctgaccactgctgccttgcactgctgtgttcctgggctcccactgctgcagatgagaaaaagaatgcaaacaacagagtcccccaccagagcccatagccatgttccagaggacagtgaagtcattgttcagaggtgacctaaggacgaaagcatttaaacaataagccctcttgtgagatgtggtgaactatgcactgcagacattgtgaagtcctctgtctcggggaaggcagtttctgcacgggtttcaataccttcttgacagccatttaggagaggaaagtcacttgtctcacaatagcatccaagcagtttctgtcctaaggaacgctaaagtgtgttcctttatataaaatacacactgtaatttatagaaatcacagtgctccattgaattgcagtcccctccccctcccctccttacctgaagtagaaactccatctgtttggtaaaagccttctttctttgaattttctttttatattttgtgtgtgtgtgtgtgtgtgtgtgtgttgtgcacacacatgcacatgtcactgaacacgtatagcgaggtcagaagacaacttgcaggagtcagttgtgtccttctcctgtatgtcatggggattgaactcacattgttagggctgctaccaggccccatattgagcagctcgcccacccctcttcattctttgaataatatttatttcttccaaatgaaaaaagggatcccttcggttgcttagattcctaatgaggctctgaggcttgataataatcctcggaacaccttgtcactgttgaagcatgggaaaagaggagccctgctttgaatttagtttcgtttggattcatttaatttaatattttttggttttgtttttgcattgagcctttaagggaggcttggtatatagacatatacccttgttagctcacaccagtatctctggcagaaccctggaattgtttccgttttgatgttgaatatatgactttccgtgatggtggagggcgcggtgcatatgttgactggccagaggtgttctgtcacgatataaatgtaggattaaactattaaaattgccaatttgatgtgtttgcagatcactgtatacagcaccattgcagaatcctcctaattgaagaaatgtttcatctctatctctgttgacaggaaggatcgcctcctgataattgctttgcttaagtgtctgataatatgccaggagtgagcgcattctgtgttaggtcatctttaattatgcatgtaccacctgtcagctctaaatcaggatcagatcagatccttgcagagtcactttggggagggtcggagagaagccaaggtgatctctttgagaaacaacagaaatagcagtaaacatttctcatcacctgaaagcgcctcgggggcatggctcatgaggcaccagccactggcacatctgagaaaatccgaaatctcacccaagcaagataaattacctcggagacaaattacggagagcttggaagtgccccctccctccctccctccctcccgcccgccatctgtggcacttcctttttattctttctcatccttgtaaaggagccagggagaagctcagacacatttttataagctacgtgaggacaggaaatatgataatgatgttagatttcatacatttgggggatttttttttcagtagttagttggctttttttagaaggacaaatgtgggttggaagaaatgcttgctaccctctgtcagcttttagtagttttagtctcacttttcagggctgtttgggactttctggagggatgtttagggttctttaccgaaagttctgttccctccactaagaggtgtttttctctgttcacctgtcagaggcttaaaggcagagtgaacacacgttcactctttcatataacaggtgggcttgactgactgcagaggggcaggcagagaaggggcaggcggagaaggggcaggcgcagggaaatgactgaacatgctttatcccattgtgcagctctcagaacacaaaggggaggctccaagcctgacgttctccaagctgggggggtggggggaacgctcctgagatggctttgcctttgacccacttttggaaaatcctgaatttctctatgtcagatccagctgaatagagggacaggaccgccataaaagtggacctccagccccacagagcattgggttatgactctgaatccctcttcaccaccatccagtgcctaaggtgacgtttactgcagtgggcatgcatccaggtagcacagagtaggtctgacactcactctccggtccagcgtttgtcacttagtgtgcaattgcacaagtaaaagttacacaggactgtcagctccacacagcgcagacttctctcagaagtgactgcaacgtgcccatgcccgacagaagaagatcccaaagttaagtccaggagaaccgagagaacgaaccaacaagtaaaagcagtgccaccatattttctcatccccgctcgtctttgccaaaccctttccatctgcctgggaagattgtgtgctctctccacctgcctgactcctattttgaatgttatctcctctaagaagcatctttaaatttattcttttataattttatacatgtatatagtgttctttgctcaactgccctccctccccagttaaccctctcttaatgccttctcccatcaccaaatcccttcttctcctcaggcccccctcctgctttcatgcttttgtgtgcgtgtaagacgcactgcatttaattagaggtgaacatgagtgaggtcatttgcttgcacaagagcagtgtgccaggctcattcacagaggaatatgattgccatctctctgtatcctttagcttattacatctcctttgagagtggcgaggccttatgagcctctctcggatccatgatggagaactaactggtgggcccagctctacgagggcagccactgctgctttgagtccataggtgcgatggccatgtcctgtcccctagacaacacctatagtactcttggcatcttccaactcttactttctttctgcttcctctttcttggcattctctgggcttcagagggattgatacacatctcccacttagctgaacattcaacaatcactcgttctcagcacattgaccagtgatgggtccctgcgttaactgtcacccatgtgaatagaagcttctctgaacaaggcttagagcaacgctaatctgtggatgtaaacataaatgttgggagttcagtttgaacagccaggtgtggtgacacacgcctttaatcccagcactcgggaggcagaggcaggcatatttctgagttcgaggctagcctggtctacaaagtgagttccaggactgccagggctatacagagaaatcctgtctcgaaaaacaaaaacaaaaacaaacaaacaaacaaacaaaaccatgcagtttgacactgtgctcagttagcaaagaaagttcccctactgggtctatgactgccataatcatggagtttgatgaggtttgtagaactaagtatgaattcctcctacagggaggcactcaaacccaatcagaaagtagctggctatccctaaaacaattacaccactgttgcaatggtgggcatatcttgcctagcatgttggtaatatagttcagaggttcacagttaggtaagaccagtggtgactttcttcccctggcagcactctactagccagcaggaaggaagcttccagttcagttccagctggatttctctctgtttttgcaatcaaaatgtgtgatgtcctcagcaatagggtcgaaccatctgcttctggtgggcacccaagaggaatgacaagggccccagggatccctctgatcaacaactaaggaagtaccctatacctcccactggggttttgtctaataaccaatgtcttaatcaacatattgttttcttcctcctgcccatcaccaagtccctagcagactgcttgtctggctttatcagagttggtcatagtattctacaaagtatcctttatggagttttctctggggaaaagaagatagcatcttaactgtgaccaggaagctccagagaccaagcagtaatatgtggtccacagtcctcaggttacactaaggatattatgaccatacattagagagggacatacacacatgtgagcgctacatgcagtgcacagtgcagggatgaaggactgcgcctggggaagagggagaggacggaagccacagtggctgtgtttagataaatgacagacttgcttaagagatgggcatgatacagaggagattttgggttagaacatgattggtttgcttgtaaagctagcctactctggaaccgatgactttctttggtaacagtggctctcgtttctagaaagagagtttatgttttagggtttctatggggtttgagaatataaatttctgggctgtgggggagacacaaatcagataacctaacactgctaagatggagtgtccctgttccatgcagcctcccagccgggatggaacacactcctgacttccatgttgtatcagtttgtctaaaacatatccatccacaagctgcaggctagaggttgggatgtgatggaagacttcctttcccgatgagggtactgtgagacagatcagcactcaatccagccacagtgcgcatgcctcctggctccttgctcgatgggactgagagcagctcctcaacacttgaaccctccattctgtccaggaaaatacacacactattgttcacctcctgggagttgccatgagggttaatgaactccgtgaaggggccacctcagaacccatctgtcaccagtacagtggacagaagaactcctgtgtgtagggattgcggtgatgaaacagtgtcatgtagaaaagtccccagcttggagatggataaggccctcctggttcagtcctcagccctacagaggaagaacaagagactcccagctgcatacccgctgcagagtaggttcctgggagtgttggcttctgggaacagaggtgttcccagcattccctgggacctgccagtgacctgcagtgtgcggcctctctgctgctacctgttatctcagcccagcactggccacatctctcctccttcactccttccctctctacttccatctcatcccaatccttctttctttatttctctgacttctctcttggccgcgtcttctttccgtgtaagattgttctgatgaccccagcatgtcaaatgactctcggtaactcttttattctattgtattaattttttaattgaatgtataatcaaacctgggtcctctagaggggcagcaagtgctcttaaccactgagccatggctccaccccctacatatttgtcttattttgcatggttatgtgtgtgtgtgtcctttctctctctctctctctctctctctctctctctctctgtgtgtgtgtgtgtctctgtctctctctccctctctccctccctccctccctccctccctccctccttcnnnnnnnnnnnnnnnnnnnncctccctccctccctccctccctccttcccttcgtcccttcctccctccttctaactcccctcacccctctctccatgggggtggggtgttgtaggtgtgcatgcggaggtcagaggagaactcagcggaacctggagctagaactaaggtcgccaggctcagcagcaggcatctttgtacactgaaccatcttcaagccaacgtttttagtctaagcaagaggttttttgtagctttggaaggagggaagaagatgaatcttttcatgttcctctagactgccttcagttcttttttccccctgtgttgacattttccccttctctcatcccctcagcctgtagtcattaacttgccagacactcagccatggattgtctttatgacgttgctgaagttaggagcgtgtcattcacagagaacctaacccatatattaactcaggcacagcaaattgctaaatacatgcctgtaagtcaagagcttcaggatgacaatccaaccactcctattggaagggggtgactgaaacagactggcagtgggcaagggagggtgagtttctgccacagaactgagctggggcagaacactgccctctggacacatacaggggccccagcagagcatttcccaggacgtgatggcgaggccccagtctaacaggaagtcagtgggctcctgccagcctccacttgttcagtccttgtccacaacttgagcatccacaccacggctcattcctcctcctagtcccactggaatccctcttactcctcccagggcctagttcagtaaatgtcagagtagctacaaaagatgagcgctgcattagatacagtgcccaatggatacgtgagaccagatccacacatgccgtacaagtgttgaagagcatcagtacatgtggaaatgggagcagcatctagtgggaatcatgaagtaccctgatccacgtgtctgtgcatggatcaggaatggtgcaagagaagccacacagagtctggggacacagagtctggggacatgcagctcttcaaagcttttgttactagtctatgctacattttatttaagaatgttactttaaatttacaatcatttttaaactctgaatcagaaggtggtattggttctcagaaaggaagacagcgatctattttcccaactcttggaacatgatgttcctttgggagccagtggcctgatgagaagcccagggctctaggtgctgaggtcattacccacaccttatgactcagtgtcccccacaccccagtctgaacacctctgtgagtggtgaaggaaagagtcctgccttctgtatagccctgggctttgccagcaacctcgtgagaagagatgtctaggaaaacacacagaaagcagggttgctgcatgtatgtagaatctcactacagaatgtaaagcttcgtgcttctcagaacattcacgtgtttgtaaaagcttcatgcaacacttgaggtcagttgctgtgtgcagtctagtcagccaccaaatccatgtagaagaggcttttgtttggcctctttaaaagagaagtaactgctgatttttctcaaaatgttctgacctttgtcttgttcacagatattcattttgttgtttggtgtttttgtttgtttgttcttcctaagctggtgcaaaggcacccaagctttcagttgtcactcttcttccatttgctgctctggcctgaaagagtcaccacaatgcttataaagggctttcagagttcagtccccaccttcaagcagaggactcagacagattcagatagctgtgccgtgcgtgcaggtggtaggttccaatgtacttggggctatgggcatacttggtagcgataacaacattttataaagaacaataagatgccccaggtgttgtcttagtgtgtatatctttgtatctgccttgtgctcctattctatgccaggtcccttgagagcaggggcttcctggttccgcgctgtgttctgtggtgccttagcaaatcgatgcttaaacaaatatgttctgtaccaagcttaacttttatcttaaaaatagcataacagttttttaatgtatttcatttcatagaaaagcagagcctggatactttgcagtatttttttaagtcttggcaggggaaatgctaagtcatgaaaagttctcaatcattgtagaaaaagtgattttgtttatgctttgacacaacaggaatggagaatttttcaaagaaccttggcgatcacttgcttagattctctcgtgtagccgtagtaccgagaactatgcctgacatttaaaggaggcctaatagatatttgttgggtgttggagagatggctcagagggcaaaggcatctctcaccaagcctgacaatctgagctcagccccagtccacagctactagaaggaaagaatcgactccctcaagttgccctctgacctccagacacttaccaagacacgcatgtataaaatgtaatgataatttttttttataaaatacatttgttggatgactgagtaaacagctagtgagctgctcctgtgtgctaagtaccacatgttaaattctggagactgaaataataaataatggatttgcatacataccccagtactttctccctacccaagaatcaatgtaggagactagtgacccctctagccatcctcattcagtgtgagaaggcaatgaagataatgcagaaattttatttttgttgtgtgagtgttgttaaccagatatcatggttatcacttctaatcccataagaaagtagaaggctgaggtagaagggttacacgttcaagaccagccttggctacttagcaagactatgttttaaaggtccagtggctgtggacctcagtataagaggacttttatctcagtataagaggacttgcttcccgaatacaaaaccctgaatttgatcctcagcactgcccaaagaaaggagaaaatgttatatcgtgtccctgaaacaaggagaaacaaagagtcggcttatgtcactctcctcttacgcctgtcttactaacctttgtcccaagttgtttcattttctgggcaaaaggggatcaggattgccccaagatacaaatggtgctaaaggtagcatggaaaagctacacctcagacttccaggcctaggaactcccaggtaagttagtcaggctctctagatgaacagagttaatagatcttacggggcatctatcagatcagcttccacaatgtggactgaacggtccaaagttgacgctaagcattctgggaaggcacttgtacaggaaactaatgagatggggctgaggtgggacaaagacgtggtcaagaggagggaactacagtcagatagtttagccttgggagtaaacgtataattgagccctccctctttctctctcagcctttcccttactaatgttttggggtttctctctgcagcctgtggtttgacagcttcgttccctagctgttctcacacactatgtctttacccttgccgctcaaccaactggcacccttggcaggctgcctctccctcctgaaagatcttccctaacctgcccccttgcagacagactttctaaaatgtgatcatttagcccctaaccctgagcttacgctcattcttagtgggttgcacaggctcccttaatacagatgtgttcttattctctggtgctctcgccaggggcaccgctgcatccatctctcatctctcccagtctgttagaagggtgtgtgtgtgtgtgtgtgtgtgtgtgtgtgtgatctctctcctgaacactggtgtgcatagtgtgtacctgtcacataagtggcatagaacagagtaaataagttcagtgtagttaaacacaggagctggccatggctccaggctgtcccctgcctcccttgcattgtcccgcacagcagccagtgctgtcaccatcctgacaccgtaggcattacctcattcctgtcctcctggcatcaacctcccctgcctccacatactccacatgccaccaccgtgtgatcggtagaaatgtcatcctgatcacatcatagctgtcattagtgactccttgccctagtgtggaggacactcgagtctccctcactgtctctcatcaggcatgtgcagacacattaaactccacagatggctctgccctccatccgtgatgcccatccatgagcaccccctttctggagtggcctgatcttctttccacacttgtcagactcctcctagatgctttgtcacagcctaacactgttctcacccccgccccacccactacatccaccgtgactgtccaccctgggccgggaatgcgtgcacacaaagcagaggtgttttggagagattgacataaacctcttctttggaacctaccttagtctggtttaatttctcaagaaaacacttggcttgtaaagttctgtttattctacctcatgcattctgacatataaccatatattgccttctgttgttatgtgagtgtctcccatgcctgtggcctgctttcactgtcgatccctgggtgtctgataccagcgtcatcagctgctctttgctgcctagcaagatacccccagactccgtggcttaggacagaggctatttattattttttatggtttctgtggtccactggacagttctggtttgcacaaccttcagctgcactgaatcacccgggatagatgtgggtgaacagtgacccacagctgccaccgcttcggtgtttacaaacaaaagaaaacaaacaaaaacgtactggaactcagccacaccatactgccagcactgcctttaccttgtgacagcagaggcaagtcagtgtagtggagatcaccacatggcctacatgtgtgctgtttgctccctcaaggagacatttactaaactagaaaaccttgccgagccctgctctgggatggccaggtggaaagggccttacctggggcagcttgtctttctctgtggtctctcagcgccaggggactggcctggtggtttgtatatagcatagcaggagagggcaaggacctgatatacctccataagcctctgcctcccaagtgctggggttaaaggcatgcgccaccattgtgtgcagaaaatgtccttgacgttggcctccccagatatttctaggcctgaagactgcttccctacaaagacgggtcctacccagattatctaaacctgtttgctagatccagctgtatagtataaaccctgcctccttgcttatccgtgtgtaataatttccacctctctgctgagctgtatgcaataattaggaatctctgtccaacttaaaagaccgacatggtgagcttccagggtgttttcatttctccatcagagggcccagaccacctgagggcggaagaaacaacttttctcagtgtccatgtgtcaggtgcctgtcttttgctcatttcctcaccttcccagtcagggccatccctggaactgtgatagcatggcatggctctttggggagaagaaattcaggaatagtattgtgtaactactatgtgccaggaacagcctgtagatgcggtgatgggcagggtacacctacagcctgactcggctttgtgtcgttgtcatccagttgggaaatgagagttctctaaaatcctttcaaggaatccttcaggaaggagctatagcatagctatataactccatggcgatatgtgatggctggttgtcaacttgattagattagtaagcacatgagagactagtaaagtgaacctctttctgcctagatctttggagatgtttgcagacatggaccatgaggtctctgacctagtcagtggtttagtccattgatacattctaagtctgaagagattaatggaggttcttggcacttcctggctggtgagaggaagcaggccatgtaggaaatgctctatgggactgtcttgccctggtccctttctgaattcctcctctgttttctgaatgctgtgatataagctgtaccgccatggccctctcctccatgatgagttagaacttctgaactcgggagctaaaatgaacctttcctgctttaagtcgtttctgtcaggcattttggtttagctacaagtagctaacccagtctgccatattcaccctccccgacctcacacaattatctgagcttttcagatgctgtgtcttgaggctctttcttgctggtcgcctgacacattttcaaccagatgacggtttcatcaggacaccagtaactcggaagtctgattcactagattgagtccctcaggtttctcctgtggttgtaacgctctactccatgcattcagattaatccatgcctgccttattcgccctgtggatacacaatattccccttctccacatgtctggtgagatgctacccctctgatgaagcaggctcaagtaccactcacccgtgctggttccctggttgttcctccagcgagctctttcttcctctgctgtcacaggcctcggagtttggagtgtgatgcaaatggggtgtagcacacactgctgttgtcttagggtttagactgcaggccaggtcatgattcactttaacgtccttctgaattcctttaacaggggagacgtctagaaaagtcttggcttcgttgctgaggctggagctcaggttgcgggaagcaatcatgatctgctgatctgtaccccagttccactttatgaataatggacaactgattggcatgactgccatttccaaaccttggtcttatttccaagagttcattgggttaaatgtatttcatactcattaataaagaaaaaattgctgcatataagccatcaattatatagtgtatctgaaactatgtttcctagcactagaatatagattattaagtctaattcagatggatataggtgactcaatatattttgaaaacattgaaatatacctgtcattagaatctcaaaacagctgtggtagaaaggttggtacatggtagtatcctcatcttacaaagaaaaaaagtttaacttaaaagaaactataatacttgtacagaattaagtaaatatatttttgtttatattaaattaataaatatatatattatatacgatatatactcaaagtgtaggcgtctagccttatgattgagacaaagcttcctttctaaaatcacctgtggatatcaaaacctcagctctaagattggtatcaaaactgatcttatttataaattgctatgcacatcaactggaccttcagtttgtcttcctggctactcatcccggtattacttgtataacataatgtgatgtggtattacatgcagctcaggagagattagaatgattattgggtacatatgttttccgggggatgtaattaggcagattctcacaccctcatcaagagatttccccaccatcattaatctcaaaataatagaaggctttctacatccaacattacttgaagatttgtagacgcatcctctagagtggacatttagggggaaaaaaaggctttgtgtgaagtttgggtatttgttatactttaaaaacgaacatgcacactttggcatatgtaactattagactgatgttctgaggatagatctgcataccattagttgtatttttgttttacatagtttgctaggtggaaggaaggggctttcaagttgaggaggctctccaaactgcagcatctcgaatgtgttgatatctagaagaagcaatgtaaagaagaaaagatttgagttagcatatggatgtggcaagttttcctacatagtcccagatttcactgatgcaggaaccatggtgatgcagggcatcatggcaatgcagcagcctgtaacagaaacttcctacttcatggtagtcaggaagtgggagtggagatgggatgcaggagtaagagacagcacctaagagcacacctacagtgattcttcttcttgcaggccctatcttctacagtcccccaacctcccaaaatagtgccaccttatggttatagttacttttgtgtctctgtgctgtgataccatgaccagggcaactgacagaagaaacagtttattgagggattttattttcagatagtgagcccatggccattatggaggggagcatggcaacaggcaggcaagcatagtgctggggcaatagctgagagcttatatcctgttctgtgaggcagcatgggggcagagagggagagagagagagaaggaggaaggggaagagggagagagggagggaaggaggggaggaggggaggagggagggagggaaccaactggaaatggtgttctgaaacctcaaagtctgtgcctctggtgacacatctcctctaacaaagccacaacttccagtctttccaaaacaggcccaacagcctgagcccaagcattcaaatgtatgagcctacgagggtccttctcattcaaaccactacactaaccttcttctaaaacaaaacaaaacaaaaatcccagacttttgggccacattcacatatattctatggctttaccactgtttgctgtgatacaggtagtttgaagctaagttatattagacctcatgagatttaactaaccggtccttgtataatatacgtgtcctggcctttctgtcttgtagatcatacggatgacagattctgtgttactgtctttttacaataattttttttcatttattctttgataacttcatacatgtttacagtgtatcttccttataaccaatcaaaatcctccttcccactcacttcagaatccccaaatacttcttctcccttttaccttcatgttctcttttttattttttttttttttattttttttttatttttttttttaggattttatacattgagttgtgattatcttcaccttccctaccccaacttttcctggatccagccccggtctcttcccactgactttgtttctttttttctccaccaaggccaatttgtgctgctcaaatattcatgtatatatggccttccactggagcatgattaacttatcaggggctgcactcttagagaaaactgaccctgttgttttgttgatttttttcaataatgtttttctttcttattactctcctgtttaactattattctagcatggttacttggtcctgtgatctcagggataaatttttttttttctatttagtttgaaggattccttcacatgtctactgtggagctgacaatggttatacatttctttcatctgttttcactatggaaagtttatattttctatcatattttcctcctgatagacagctttgctgggtataataatctaggttatatctttcagggctcaaaaaacaccatcccacgcctttctgaattttagagtcttggttgaatggcaggctgtaattctgatggcctgagttcatgtaagacttagcatttcttgtcactttcaatatacttcctttgttctacatacttactgtcttaattaaaataagactaagaaggttcttttctgattttctctgtttggtcctaaatgcctcccatatcaggttgacatcttttcctaaaaaggggaaattttcaattatgattctgttgaaaacatttttatgtctttagaacaagattattcttctatgcctatgactgtaggctcagtattttcagagtgctgcacataccgtgaaactctttgacgtctgttcttatctaattgtgccatccctccactttgttttccagctcagaaaatctgtgattttccttgacccattttattagtgagactttccacagaactttttattggttatgtttttaatttccatcatttcaagaagttttccatcactgtctttgttttcatagttcctcttccgtatcttgcactgtggtctttattgcacacagttggtcatttgtgtgcttagtcaggagcttatttcctttcatttcttgaacaataattcttaaccctgtctagggtttcatctgaatcactctcactagacgctgttactgaaaagttagttgttctggagaagttatagtgacatgatttttgtgttttttcttattactattttgggagtcacatatctgggattatcttgttgcttggggttttttcttgcattggatatattctttcatttgaagtgtttgcagaactcaatgggtgcttgaattggtaacgtggggtatgttgtttagaaattagttaagtccgggaactaggggctggtacaacttatatgtcatctctgtgtagactattaactgcaagaacaaccacggattctgggtattgcctctagatgtaaatgttgtattatccaaataacaaaagcaattcctttaactttaataacttttggaaaatgaacaaccaaagataatatgaagtatagtttgattttagttgataaggttggaattgagagggaaggagagtgggtgaggctcaagacaagatcaaaggacagtggcagaaatgtcgaggtgatgcagtagctgagaagggacggttgaaacagtaccagggtccacagatattagagattgataaagctaggaaagggccagcctgagctacagaacaagtcctacaacagtcaggactacacagagaaaccctgtctcaaaaaaccaacataaaagaaccatggaagtctttaattaagtggtacaaagaggagaacaaatgacagaaagaaggaaagttgtcaaaataaaaggaataaaatgagatacaagtgaaaggcatggtagtgtctcatgttagcctgagtaaagaaacacatagcaatcttaaagtctaactgagcaatataccacaaatccaaaaccatcataagatgtatatgcaagggtataaagggtaataaataatataaaatgagctgggcagtggtggcacacacctttaatcccagcactcgggaggcagaggcaggtggatttctgagtttgaggccagcctggtctacaaagtgagttccaggacagccagggctacacagagaaaccctgtctcaaaaaaaccaagagagaggggggtggagagagacagagaagcaggggatagggtgctggagcagtggttaagagcactggctgttcttccaaaagacgcggcttcaagtcaagcacccacatggcagctcacaaccatctataacaccagtaccaggagatccagtgagttcttctggcctgtatgggcaccaggcacatgcaaggtgcatagacatgcatggagccaaatcatccatgcacataaactaaaaataaattgtaaggtccaaaggggtcaaggatgctgggagaaaacagctcgcagaatcaactaagcagggcttataggagctcacagagactgaagggccaatcacggtgcctgcatgggtctgtgctaagtcctctgcagatgttatgattgtttgcttggtgttttgtggagtaacactgggagggggtgtctctgagtattttgcctgctctccaaacccttctccttctactgagttgcctcatccagccttactatgagggtttgcgcctagttttattggaacttgttatgctgcattcggttgatatccctgggaggcctggttggttggttggttggttggttggttggttttaaagaaagtggataagaagtggatgttgtggggggagtagagaggagagggagatgagaggagtggagggggaggaaactgcagttgagatgtattatatgagagaatgaataaatgaatgaatgatctttgggggggggggttcgagacagggtttctctgtgtagctctggctgccctggagcttactctgtagaccaggctggcctcgaactcagaaatccgcctgcctctgcctccccaaagtgaaaagtaaaactaaaagtaaaagaatacgtatggggtgagttgcaggtacacctgtgctgagttcagaggtgaagttcttagtcaaagtagctctggcaagttgcaaatggtgcagtgtggggagaggaacctgtgagccattaatctctgtgacttctgtgttctctgtggttctgttattggggaaggggaggctgtaagtccttgcctggtcgcttggcactcctctgtgggctctgttggtcctacaggctgatgtgtgtgaggagcagaattttccctccagtttctcccgctctctctaagcagctgaattcagcagtgttgtgccaatcaagagggctcgaagatgggtctccatggggcacttcttaagggctcgaatgtgtggcactttcaagaatgttggcactgaaaatacccggtgtctcttctacatagtcactttttctctttgttaagtctttcccattttcataaaaaatctctttttttttcttgatattatactatattacaacattcctccattcctttttctccctctgaatcgtcccatatacctcttccaaatctttctttaaattcatgatctcttcttcactaatttattattgcatatatgtatacatatacatatatttctaaatatacacattactaaatgtaacctgtgtggtctatctaatgttacttgtatgtgtattttcaggcctgactttagtctcccactcctaatgttctcagttccccatagtttgttctgtagggctgaggcttgtgggcttttcccggtccatcttagcatgtccattggtactacccttgttcggttcatggttaggcagacgtgttggggagacgagatgagtatagcttctgacattgctaggagacataacttctgccaccttctctcgccaccatgatactctaccttactcagactagaaatggtagttctcaaaattatggactgaaaccatatgccaaaatatctatctctttaaattattcctcccaggagtattccacagtctgattatcacactaatttatttttatttatatcctgaagtgctgccttccccctccttggccctgtgttttcatccttttctcccagattcactctgtgtacagccactaatacgagtttttcctaagtagtgatgaagtgtcactcccatgagtgctcagtgtcctaaactggctgtaccctacggttccaactgatgcaaagaaaatgtcatcttctaggatacttcactggttagaacctttacactcttaaagatcaccaagtatggaaacaaaatgccataaatcaaaaccagcaaaaacaacaaatgatatatatgttgattatcccctacctaccaaggatgctatatgcttgaattaacaaattaagaaataagaatagttctgcatttaaaatttaagtttaagatggaatattaaaaaaataaacaggaagcaatgagctatcagatcaccaggcatctttcaatatcaaagagaaatgttctaatactgaaaacagtaattatcgataactactgtggatgccctcacttgtaatgagtaaattagtaaaatggaagattaaactacaacagatttatacagtgacacacaaacagacaaatgaagctaaagaaaaaagctcctagatatatcaggcatcgtctaaagcctggttgagcccacccatctcccagatacaacgtgaagcagagtgctctcagtggtggtccatactgctgctggagagttccctaaggtgagaaatgtttattgcctttacactcagcctgaagaccctcaaatgctacatttcagaaagactaggggagagtagagaaatggctgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaagaataataccttaaacttccaaaagcattgttttagatttattttaagtgtaagagtgttttgtctgtcctgtctggtgtatgtatgtgcactacatgcatgcctctgacctggtgctggcagaggccagaagtgggcactggatcctgtgaaactagagttgcagatggtgtgagtccagtcctctgcaaagtcaacactgctgttaaccacagttgtctcgccagctccttgagacatacttttaaagttaacaatggaagaagatgtaaaatcattttttaaaaaatcagaggaaataaaaagcagaagtacatttgtagaaaacaaatgtgattatattaacaatcccaaaatatataaatgacatgcataaatcacaacatacataaattataaaagaaatgaatagatttctaactaagacaaatggattgagattagcgggttttggttttttgtttgctttgtgtttttttttttttcctcagaaaatttcgttgactgtagtgtcaggtggtgatgagctgaacaagaagtagtcagaatttcttagctagcagtagtatcttagctgtgtgtcttggggacaggtttttctaacatggactgagaaaagtcataagtaaaggggtgcaaatcattccagcaaagactaatcaaaaagaatctagaattgtgttattttttaagtcatcaaaataatttataatagttaaatgcctcttaaatacacatgatatcttctgaagctaaaagtaatatgcactcaaccagtttcttaaatctatttggaaacattaaacatgataaaagtaaaaaaaaaaaatctcttatgaagtcctctatgaaaggaaattgtgacaggttcctgattagacagaaaccattccatctccaagggagaatactcagtgtaactgtggcttcctagaatgaattgggtagtgttcattctgtttctattttgtggaatagtttgaagagtattggtagtaggtcttctttgaaggcctgttagaattctacactaaacccatttggtcctgggctttgtgtggttgggaaacttaatgactgcttgtatttctttaaggattatgggacagtttagatggcttatctgatcctgatttaactttgttatttggtatctgtctagaaaattgtccatttcatccagatttttcagttttattgagtataagcttttgtagtaggatctgaggattttttgaatttcctagtttctgttgttacatctcccttttcatttctaaatgtattaatttggatactgtctctgtggcctctggttagtctgagtaagggttcatctagcttgttgatttttctcaaagaaccagctcctggttttgttgattctttatatagttcttttcatttctatttggttgacttcagcccccagtatgattattttctgctgtcttgggtgtatttgcttctttttgttctagagctttcaggtgtgctgtcaggctgctagtgtgtactctctccagttttttttttttttttttttttttttggaggcactcagtgctgagttttcctcttaccactgctttcattgtttcccataagtttgggtatgttgtgccttcattttcattaaattctacgaagtctttaatttctttatttcttccttgtccaagttaacattaagtagagtgttgttcagctttcatgtgtatgtgggttttctgttgtttttcttgttatcgaagactggctttactccgtggtgatctgacaggatgcatgggattatttcagtcttcttgtatctgttgaggcctgttttgtgaccagtaatatggtcagttttggagaaggtaccatgaggtgctgagaagaaggtatatccttttttttttttaggataaaatgttctatagatatctgttaaatccattttgtccataacttatgttagtttcactgtgtctttgtttagtttctgtttccatgatctgttcattgctgagggtgggtgttgaagtctccaattgttattactgtgtgaggtacaatgtgtgctttgagcttcagtaaagttccttttatgaatgtgtgtgcccttgcatttggagcacagatgttcagaattgagagttctccttggtagatttctccattgatgagtatgaagtgtccttccttacctttttgataacttttggttgaaagttgcttttattcgatattagaatagctgctccagcttgtttcttcagaccgtttgcttggaaaattgttgtccaatgttttattctgaggtaatgcctgtttttgtcactgaggtgcatttcctgtatgaagcaaaatgttgggtcctgtttatgtatccagtctgttattctatttctttttattggagaattaaatccactgatattaagaaatattaaagaatagttattgttgcttcctgttatttgtgatgttatttttatatttctgtggttatcttcttttgggtttgttaaaagaagattactttctaagtttttctagggtgtagtttccctccttgtgttcgtgttttccctttattatcctttgtagggttggatttctggaaagatattgtgtgcatttgtttttgtcatggaatatcttagtttctccatctatggtaattgagagttttgctgggtatagtagcctgggctgacatttgtgttctcttagggtttgtatgacatcttcccaggatcttctagctttcatagtctctggtgagaagtctgataggactgcctttatatgttacttgacctttttcccttactgcttttaatattctttctttgttttgtgcatttggtgttttgattattatgtgtcaggaggaatttcttttctggtccactctatttggaattctgtaggcctcttatatgtttatgggtatctctttctttaggttagagaagttttcttctataattttgctgaagatatttactggccctttaagttaggaatcttcactctattctatacctattatccttaggtttagtcttctcattttgtcctggattttctggatgttttgggttaggagctttttgcattttgcattttctttgactgttgtgtcaatgttttctatggtatcttctggacctgagattctctcttctatctcttatattctgttggtgatgtttgcatcaatgactcctgatctctttcctaggttttctaactccagggttgtctccctttgtgatagttttgttcaattccttcacctgtttggttgttttcctgcaattttttaagatatttttgtgtttcctctttaagggcttcaagctgtttatctgtattctcctatacttctttaaaggagttatttatgtctttgttaaagtcctctctcatcatcatgagatatgattttaaatcagagtcctgcttttctgaggtatccagggctcactgtggtgggagaactgggttctgataatgccaagtagccttggtttctgttgcttatgttattgcccttgcctttagacatctggttatctctggtgttagctggtcttgctgtctctgactgtggcttgtccttcctgcaagcctgtctatcagaactcctgggagaccagttctctctgggaggaatttgggtatggacagctgtggtacaaggtcagctctggggtgcagacagaaactggaaggatcctgtccccagctgctccttgcttcctatgtcctgaaggctctgggcaggtcccaggaatttgagcagaagtggtggtcttacctgtgctcacaggcatgtccgaactcctgggagactagctctttcccaagggtatatagatatggagtgccatggcacatgatctagaattgctttattgatacgagtcaaaatacactcaaagacaaaaggcgttgtaaggctagaactcttacatatggcttgaaatatataaaatgttaaaactacacatgacattggaaatgtatactatttctaaaatggcctcaatatatgtaaaacaaaaattaataaaactttagtgaaatttcacatatttctttaaggtatcacttgatggcgcaacaagaagtaataaacatggaatttaaaatggtaggagaagacatttttttttcatagacacaggaaactgcaccaagcacctagaatatgcagatccactctgcatggaggaattattaaaaaaaaaaaaaaaaagttgacctcacactaaatgcaaaactggtctcaacagatttccaggaatcacaattaagataatcatatattttttaaagatttatttatttacatatatgagtacactgtagctgtacagatggttgtgagccttcatgtggttgttgggctccagtcaaccccaattgctctgatcagccccgcttgctccaacccaaagatttatttattattataaataagtacactgtagttgtcttcagatgcaccagaagagggcatcaagtctcattacggatggttgtgagccaccatatagtgctgggatttgaactcaggaccttcagacgagtagtcagtgctcttacctgctgagccatctatattttatgacaattaagttaccattcaataaccatacagtcagccccctcccaagttccccttaaatgtggaaattttcaaacatttctgagtaaatcactaaaacggaaatttttaaatacttagaactgaatggtgatgaaaatagtacatttcagaacttgaaggatgcagcagaagttagatgtgataagctgtggggcagtagagggcaggatgaggcgaaaacagtaggcaggagtgacattggcagtaaagatgctgtctagtgaatctacagatcccagaagatgcttctgtggataggctcatggtacagggatcaaccagacttttttttttttgtaacaagatcatatgtctggctttgtaggtgacactgtcaccactgctcagccttgccaccacagtatgaaagcagccatgtgatgtataaatgactgagtatggttctggtctaatagttccatatataaactagcaatggaccatacttactattcagactatgatttcccagttgttgaactagttatatgtctaaaactgaccgtaaatgatgggaaatttgaataagattgctggatataagatcagtatacaaaaacaattgccttttcatttgtcagtatcatggaaaagtaactttttaagaagtggtcactgagccagtggtacttggctataattttaccactgcagaggcaagatggtcatgtgatttaaaaactagcctagactacataaaaagaatctaccttaaaaaatgcttagggttgatagtcacaacaaaaataagtaataagtgtactaatgttcagagtctaaagaaactaaaacaattaattgatctgcttcaaaccagtagttctcaaaagtttgatttccagatccttctatgctctaaaaacagctgagaagtcataagatctcttacttaattgggctttatcaatccgtagtcataagacatttaagtcagctactaatttttaaaaataatgaatctgctatacactaaatgtttgacacatctttatgaagtaaattgcactttcaatttaattgatgaaaatgtttttatattttttccagctctctttaatgacagcataaataaaggcactggagtcctgatagctctttcaatgttgaatctgctgtgctctgtagttttacttttattatatgaaaaacctatgtgttgacctgcagctagagaaagggaccacactttaatagctccccagtttccaaacaatggaaggtatctcttctttgatactttatcagtctttggcaggtcataactaagaaggtagttgcaatatgggacctaaaactgtatcgctgagcttgtcatgttccatcatattaaaattcattgttctgcctgacacccttggatgcatcttttatccaaggatggttgtgtgaaggcagttgactatttggaaaaggctgggttgccgagttaagtagctcttcaaaatgatgatactgttttatgtcaaatttttcacttattaacatgatcttcagggggaaaaaagctttcaagttccgagaaactgtcaagctaacagtagcaaatgtacacttaccaaaactctgaatttcatttgaaagcttaaattttatcattggcagcaaatactgtcacctgtttttcctgaagtgacaaatctcactcaccttgttcactgtcaagaaagtatctgccaaatccccacgtctggataacctcagtttgtcagccgttcttcctagtaaaaaaaaaaaaaaaaaaaaaatcacattatgtgggagaaaatgtgtcctaagcatgttaaacttacaatttgcctgagcacagtggcatcctcctttaagccctttaattctagcagaggcaatgggaacttgtgagttcaacccagcctggtctacatagtttcaggctacccaagttacatagtgagaccttgtctcaaaattaattaattaataattaattattagtaaaaatattaagataaacttacagttcaaaccaccccacaaatgctcttccatgagctaacagtcatatttcaatgtgcagtgatactgtacattgcacagaacattaagatgttaagtactcgagtgtcttcagagaaataacagtttcatggatgaacacggacattttttattaaactaataaaatttatttaaaaatacacaacttagcattaacatttttaagtcatcaaaataatttataatagttaaatgcctcttaaatgcatgtgacatcttctgaaactaaaagtaatatgcactcaaccagtttttagaatctgtttgtaacattaaacatgatcgaggtagaaaaaaaaatctcttatgaagtcctctaagaaaggaaattgtgacaggttcctgattagacagaaatcattccatctccaagggaaaatatgcagtgtaactgtggcttcatagactatattgggtagtgttcattctgtttctattttgtggaatagtttgaagagtattggtagtaggtcttttttgaaggtctgatagaattctgcaccaaatccatctgatcctgggctctttttgattgggagacttttaatgactgcttctatttctttagtggttatgggactgtttagatagtttctctgatcctgttttaactttggcacatggtatctgtctagaaaattgtcaatttcatccagattttccagttttgttgagtataagctttagtaggatatgaggatttttttaatttcctcagtttctgttgttgtgtctcccttttcatttctaattttgttaattgggataatgtctctgtgtcctctagttcgtctggctaagggtttatctatcttgttgatttttctcaaagaaccagctcctagttttgttaattctttgtatagttctttttgtttctgtttggttgatttcagccctgagtttgattatttccttccatctactccttgagtgtatttacttctttttttttttctagagctttcaggtgtgctgtcaacctgcttgagcatgctctctccgagacactcggagctatgggttttcctcttaggactgctctcattgtgtcccataagttttggtataatgtgttttcgttttcattaaattctaaaagtttttaatttctttatttcttcattgagcaagttatcattgagtagagcgttgttcagcttccatgtgtatgtgtgctttcccttgttttcttggtattgaagaccggctttactccatggtgatctgataggatgcatgggattatttcaatcttcttgtatctgttgaggcctgttttgtaaccaataatatggtcagttttgcagaaggtaccatgaggtgctgcgaagaaggtacattcattttgctttaggatgaaatgttctataaataatctgctaaaccctttaggttcttaacttctattagtttcactgtgtctctgtttagtttctgttttcataatctgtccattgctgagagtggggtgttgaagtctcctactattattgtgtggggtgcaatgtgtgctttgagcttaagtttctcttatgcatgtgtgtttccttgcatttggagcacagatcttcagaattgagagttcattttggtagatttttcctttgactagtatgaagtgtccttccttatcttttttgataacttttggttgaaagttgtttttattagatactagaatggctactccagcttgtttcttgggaccatttgcttggaaaactgttgtccaatgttttactctgaggtagtgtctgcctttgtcactgaggtgcatttcctatatgaagcaaagtgctggatccagtttacatatccagttggttagtctatgtcttttgtgggggaattgagcccattgatattaagagatattagagaaaagtaattgttactgcctgttatttttgttgttagaggtggaattatgtttgtgtggctttcttcttttgggtttgttgaaagattactttcttgctttttctaaagtgtagtttccctccttgtgttggtgttttacaactttgtagggctgggtttatggaaagagattgtgtaaatttggttttgtcatggaatatcttggtttctccatctatggtaattgagagttgtgctgggtatagtagcctgggctggcatttgtgttctcttagggtctgtataatctgcccaggatcttctagcttttatagtctctggtgatgagtgtagtgtaattctgagaggattgcctttatattgaccttttccccttactgtttttaatattctttctttgttttgtgcatttggtgttttgattattatgtgtccggaggaatttcttttcaggtttagtctatttggaattctgtaggcgtcttgtatgttcatgggcatctctttctttaggttagagaggttttcttctataattttgctgaagatatttaccggccctttaagttgggaatgtttgctctcttctataccttttaaccttaggtttcattttctcattgtgtcatggatttcctggatgtttttgggttaggagagttttgctttttgtgttttgactgttgtgtcaatgttttctatggtatcttctgcacctgagattctctcttctatttcttgtattctgttggtgatgcttgcatctatggctcctgatctctttcctaggttctctatctccagggttgtctccctttgtgatttctttattgtttctatttccatttttagatgctgaatggttttgttccattctttcacctgtttggttatgttttcctgcaattctctaagagatttttgtgtttcccctttaagggcttcaagctgttttacctatgctctcctgtatttctttaagggagttatttatgtccttcttaaagacctatatcatcatcataagaaatgatttttagatccagatcttgcttttccagtgtgatgttgttccaggacttcctatggtggaagaattggattctgataatgccaggtaaccttggtttctgttgattgtgtcctcatgcttacctcctgccatctgcttgttgctagtgctaccttccctcattatatctgactggagcctgtccttcctgtgatcctggttgtgtcagaactcctcagagtccagctttctctggcatcctgtgattctgggatcctgggatcctgggatcctgggatcctgagatcctgggtatgtcagagctcccattagtcaaactacctctgggaccctgatatcctggtgtggccaagctcctgggatcatgtgatcctgcgatcttggtcatgttagaggccctgagagtggagcttcctctgggtgttgtaggagtggctatggagtttgcgaccaatgtctgaacaagtacattttaaagtaaaactcatgtctttatgttttgctgatgagtgtgtggtggtaaagaactcacacagtttggtgccataccagcttcctgctgaggcaccagagttttaccaaccattgtgtttgcagccttggtggaaatgccaatgctgtggaatagtcattaagcttctttgtattgcaaggtgagcatcagtactgtgaaaaataaactacaaaattcaaaccctttgagacactgacatgataacacaagaacaaaagtccataccaagtgcaaagtcccagtcacagtgtagaagcacaggggatattgtacggaatgaagccaggtgtcaggagccatggctgggcggttatgagcactagctgctcttccagaggttcctggtttaattcccagcacccaaatgttgatcacaactgcccataactctagttccaggggatatgatgcccatgtctcacctcctcgagcacctgaaacacacatggtgcacatacatacatgcatacagtccaaatactcatacatgtaaaaataatttaccttcaggttatatatgcatgaggtatatatgagacataaattatctttcttcagacttaggtcctgtcccaagacagctcattatgtacttgcaagtattccaaactctgaagcagtctaaaatctcaaattctcttggtccctaggattttgcataagtgatacttgacatgtagtatgaaaatagtattggtttaactggcattctgaacaagcaaacaatcctagagatacacatagatcctttgtcagagagtcctgtgtttcttcctatgtgtcacttggttctacacgaatgtttagacaggcgtcatctgtagtcctccgctgactttcttttgtgtcaccctattctgtctttatggtagaacttgggactattgagtagtttactgttcatttgcttgggtgtttattgtctgtctcaagacctgacatatgagtctgtcctagtcagcacagtaactgtttctgaaacctaaagcactcggtaagtgtccatgggttagttaagtcaggttgaagtgacacataaggatcagctcttcagcatttcactttcggagaggttcatggctagaaatagctagttttactcattctggcttctctagataacaacagagggaacctttgatctcagtgccttccagcattgactctgtcccaccaggatcctcgagttggatattatttaacgggggttacagaaaaagcacctgagggacaagctctgtttccagtatgaagagctagtgagtgttctgttctagaactgaattcacacccttcagcttcctcccaggcgaaatagggaagagatggatgcataccgagccactaccaatgacagctctcggtgccaaagttgcaggagctgcctgccaaatgatcaggcagtagtcattcagaaagtgtttgttagagggatttttttttcagaattaaaattgaaactgaagttgcaacaaatgagcagcagatttttcagaattaattttttgtacattttagaaacgtttgcttcagtcttcaattcccgagaaaccattgtatctattcagtctttcgcacagaagttctcaggatctttcctaagaactggcaatgagattcatagttcattcgccccaaaaaatgtatgtttatgcttgagaacttgtgactgattatcgtgtcggtttaaagacagtggaccaaaccctcgtctcagcttttctccccttaactttatagcatagaaaatctgtagtgggatgcctgggagtcaggtggaagccaacagtagaatgtgggatgtgcatccaaccactcactgcctaggggaagctgtgtttgtttctggtgttcagtatttgaaatctttaacagcaagaatagatgtagacagccactctaggattctgtgttcaccctgagttctctaactcaaactgaaggtcagtgcccagccaagtttgacttctgagggcatttctagggaaactcagagctagcttacctacaagagataacggtgtgatttctgaaagttacactgctgtctatttccacacgtatcatttagcttaacttggctttagttacactgtaaacttgcctgggaatgtcaaaagtggtgagtgttggagccagacccaagttttaaaaaaatgaatggagcactctaaggttctccactctatcaaggaagccatacaagtgggagcagggggaagaagtgatattgaaaactaaagttcaaaggatggggttccagctgcagaatagcactggcgctgagtcctgggtggggagggagcaatgcctttggactggtgtttacagcctcggcttcccaagaatgagctgtacacgggccagagtagttgaagctcgggttagactcttaacagcttggagaaaggaagtgcctatgctgcacagaggagactcacacacaggacacccacacacaagcagctctctctgattaactttctcgacacaacctaagtctgtggaaatgaagcgctcattggttaaggtccaagctaggcctctgccaatacctgctcaggcttccatttcattgttgttatagtgtgaaaacatcacagtctccccttccacatgggaagtgaggtatttgaggtatgtaaaggaaccatctaatgtgctggtctttacaaccctttgtggtccctgttccctagagggcatctttgcactgtggacatcccccatcagtaagacaaggcccatagctggtgatatgcatgtaatagacatgtgggaatgtcctgaggctcactgtctcccattcctcccccaaccctagagaacactcaccatggagagtcatctctgtagcccctcaggctcttactggcagctaatgctcattctaagtcaacattttacctccttgaggtatggatagaacactttggaaggctccagataatcaaacttcatcatcgggtcgtcggtggtcattttgagaactacacagggatgcagtagggtttctgtgatggtggggagcagaaatgagccaagtcaccatgcctttagagaaaagaggcctagaagactacagaaatggagatcggagaaatcaaaagcggctcgagccattaaacataaggcaattctaacgcctgtgattagaacaaaaaatagtggtgtgcgaaactatatgtttttgagagaaatactaattgcaaaatgtgtggggaagaaaacttcacagaggcggttctgtcaatgtcatcttctcattgtgcctttaatgcggttatatgggcctatgggcctgagaagctagtgtttgggtgatacagtatttgaaatgatttaagaaaacatggcaaaaccctgcttttgatttctaagaaatccagcttggacgtctcggcttccacaaaacaggagtgtatagcaagtcctactattttggtggaaggatgtgtgcctgtttcctcaggagaaaggatgacacactacagataaaatgcccaagatgttgaaattgtactctacccccttcttgatttcaaacacgttgtgcacatggttcatctcatttcttcccgagactcactctggtgatctctgcctccccctacacacttacaagatgttcactgggagaagtgcttagctacaaagctgcctaaagtaagctggggtaccccacaggtacagggcagctgctccagacacctcctgtgggcagttctgaggccaaaggggaaaaaaatctaaatggaccatctctgcaggaagaaaataaaattctttgtattctccttcctgaacgtgtttctcttatgtccaatttctgatagactccaattatatcaacttgtcgacctcctccttcctgcctacatacttgcttattcattcacccaggccacgtgagctcgctcccaggatgatctcatccagttgtgtgggttttaaatcatctctagactcaaggctcccactttacctctctagaattaaccctgtcccctggtccttttgatcccttcctagggccatccatgggatgttgagtctgagcacacctcctctcactcccaaacccgagcctctccctggggtttcccgttcaccaaagccaccccgggccatctggtcacttacttggaacttctcagagccatcattaactctattcctttacttcctccacctactcattagcacatcttaccagtcgcactttctaagcacttgtggaacccggccactttgccatcttttttgctgtttcctccctcttctgatccatcagctagaccgtttgctaatactacccaggagcttccaccatgcctccctgccagcccattccacttaaacatcaaagtgatcattttgaagcataaatgaaatcctatacaactcacccactattgttatacatagacttcagactactcgcaaacctccacgtaccctgccagcgcttcacctttgtaaccctctctgtccatgacctccagccactctggaaggttagcatagtgtcaagcctgctcattctataaagttgttgaacaagccacttattttgctctctgaaatctacatggtctgctcactcgagtcacacagaatctgctcaagggacttactgtgaccaagatgccaaatgcaagaccccatcccgagttcatccactctcttgtcatgcctacacttttctctctatcacattctgctgggaaactgtctgtatattgatgtttctcctgagggtaagtgctccctgagacatgttccctcgctttgttcctgctgcatgcccaggtacctagaggaaagtatgacataagacatggaatgttggagacagccagtattcactgaatgcccatctttgttgtaggtgttctgatacagtaaaagaaaccagaaggaaaatgggattctgccctagggaactcaccccttgggtggcagagacagacaagtacgcatctctgtggttctgtggctgggtagtgtagctccagcttgaaacccccaactgtgcccgcaggaatcggaaaggtagccagaaagagctgacatttgagattattcctgacagatgagcaagtgttttcaaggtagaggagagtgggaaggacacttcaggtgtggaagtggcaggtgcagcagcgtggcactgggatagataacattcaatggaccgcgaatgtgaccagcttatgagagagctcaaagatgtgagtgcttgagtcagctaccagaaagcaacaacttagtttattcttggcgctgaacgtgctccttggaattttcccttttagtaagcagtgcccgttcagatgattactcatgccgcagttctcagagtcatccttgtattttcattctcttacactccacgtctagtctgccagctacacaccatcagccctgccttccaaataggtgccacgcccagcctctgctcgccaagcttatatgaatgtctgaccccaagctgcaccgtagctaacacttccaggcaagcctccctgcttctcttatgaccttcatggccccattccagtcaaaagccagcactgtcattgtcaactgctcttaacttaaaactggaggagcaacgggcatggatcaactacgtgggtgcctagaaaagagtctgtgtgtgtgttgggggtgcacttgagagagagacaaaaagagagactctgcatatcaaagtctgtgtcttgtatatctatatgtcttctttccttcccctcccctccttccatttcttctccttctcctccccctcctcttcaaccctctcccacaccaccattctcctcctcaccttcctcctcttcaccttctcacccttaccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccttccttcccctcctcccacttttccctactctccccactggccaccatcagataggaatccttgtttcacttccaacacgtgtccactggccgtgatgtcacacctcacacagagacaatggagctaagtgattgtagactgaatctcttgaaaatgtcagccaaaatatatcttccctcctttgggttgttttatcttaagtattttcttcacagtgacagagatacaactaatattataaatgcaaagagcatgtggtttttaaaaaaaaaatcaaaataagcagaaaagtttagcttacttgatcaataaaaatcagggaagtgcattttgatatataatgtggttgcttaaaaggaatcatgaagtccatttcactcagatttctataaataaaattttaaaacataatgaaatacattcttttatgagaatatgtaattcagccctctgaagtttaaagagaaagtctataagattgaccactgtgggaaaacatggtttgttctttttctcacctccgagacaaaaagcctcatagaggcagcttacaggaataagagttgtgtcagcttgtggcttctgaggacactggtccgtcacagtgggagccttggaggatgggaagttgccactgccagtgtgggacacgcacgcttctgtctgtagcaggagttgaagcacagcttatccacatctggaagatgagaaaccagagtgttagaaggttagaaccttcgaagctgaccctaagcatctcgtgtctaccagctagttcacagtccctcccaaatgctgcacagcctccaaaacaaagccttcaatgaggcaccgcgagttcacatgcaaacccagcaacctcccaaaacacagcaccagctgtgggccatgcgttcacatggaagacttaaaatcaccaatggaacttcaagcttgtaccagagttataagaacagtgtcatgggcagatggattttatttcaggagtaaaggatgttacaatagaaaagttttaatataatctatcacactaaaatctaccttataatttactaagtttatcttttataccaaacactatactgcttttatcaattctttaaaggtacagatataatccagtgtccacttttcatcaaaatgtctttaaaattaaaagtgatccttccttaacacaacaatgtggcataggggtaggatctcactatgtacctcaggctggccttgaacttggaatgctccccctttgactactgaggctgggcttaaagacttgtgccatcacagcccgctggtgtaagttcagcattattctgaataattttgtccacacagggcaaaagaaggaaattagaaagaaggaaaaagaatccaaaggcaggggttaagctgacatgttttatttgtatagggtatgagttgcttcaatttcatgctcatttctatgaagcaactaaaatgtagtataacaaaactcaagcaatgagtttatagaatgagtatcctttgtgtgtgtgattaattgttgatttgaagatttaatgaaataaaagcatcctatttacaacagcaggaagttcaaatgtcagttataaatctgaatatgctatgtgtataagaattgaatttaagaatctttaaagctgggtgtggtggcgcatgcctttaatcccagcagttgggaggcagaggcaggcggatttctgagtttgaggccagcctggtctacatagtgagttccaggacagcgagggctatatagataatccctgtctccaaaaaccaaaaaccaaaaaccaaaaaaaaaaaaaaaaaaagaatctttaatacatatgtgtatgtatgtatgaatgtatgtgaataaaaattttaaactctctaagatacagaagtaaaaacaaaaatgtaaataaatggaaaggcaatccctatttttaaatagggaatttcattagtataagtttaaaacaatcctagtaaaaatacaagtaaaaagacttttataaacaaacaaaatggtgcctaatcaatgtgggaagaaatttaatcaagaatactccaggaaaggtgaaaattatgatttagatattaaaatgtattatatttgaataagggcactaatagacaaattagtggtgtagaaatagcctcaattttattttaaattttaatctacattgggaggttctcatgtcagtaatataaacctgagatgatcaataatttgtgctgggacaaccaaatagctgtcaaggggaaatccgcttgacagtttcattttattgcaaaataaaatctaactaaattcaagaatttaggaggaaattgttaatatctacaggtgcaggggaccttccaaagtacaatagaaaatccaaaagctgtaaagaaaagaatcataaaatgaattcagttccataaaaattagacacttgagaggcagataaatacaacttgcaaaggcaagtgacaaagtagagagaacatttctgcaactaatctatataaaattttttaaaaagctaactccccaaccaataaagaacctttataaggaactaagaaaaaaaatggctgtgcaatagaaaaaaatgtaaggttatgccgggcggtggaggcacacttttaatcctagtacttgggaggcagaggcaggcagatcttcaagttcaaagccagtctagtcagcctagtctatggagtgagttctagggcagccagagctacactgagtcaccctgtcagttttaaacaacagaagaacacagccacagagtcaactaatcagggctcccagggcccacagagactgaactgacagtcacggagcctgcatggggactgcgtccgagctggggttgtttagcttgggcttttgtgggagtgaggggagtctttgactctgtggcctgctcttgggacccttttcctcctgggttgcctcagccagccttgaaatgagggtttgagtctagtcttactgcatgttgttattccaagtttggttatcactaggaggcctgctcttcctgaaggaaaaaggaagaacagtggatctgggaaagaggacagggggacctggaaggagtggaaggaggaaggctgcggttgggatgtgtcttaaagagtaagtcttaaaagcagaaggttattttcagtttacaggaaatataaacaacggcttaggagcatacaaaatataatcagctcacttatgaaaaatgaatgcaaatcaaatctataacacacaattttaacaggaagatgttttcatagtttaacaatatgatctattagcaagactatggataaaggagtactgataaataccactactgctgcctcaagtataattgttattctctcaaagaacagtttggcagtatcagaactctaaaagcagtctccaaagtatatcccaagatgtcacatacacctgagacaggaaatagcgacagaccttgcacgccagtgtctttcccccctaagtcaccgtctcactgagtagctcagtctggcctagactcaccagcctcctgtatcgggctcccaagcacacaccggctcacctgtctctgtttccatcttaaacatttatcacacactgtggcctgaacttgtgtcctgaggtgtgatagtaaaggtgatacgcatgtcttcatccttcccaggttcattgacagaatattccttttttaccatggatcttagcaacctcagtatatgagttctttatctcaccaagaattcccactttttcacttaaacacttgaagtttctttatactattctgaaaagctatcagttttaaaaaaaagtcgggtacatagttatatagtggaattacataaaacaggaaggaaccttcattcattcattcattcattcattcatttttgcttactcacttcacatcccgctcactgcctgcctctcagtcaccacctcccacaattctcgccccgccccttccccttctcatctgagcaggtgggcccccgggtgtacccccactctggtacttcaagtctctctgaggcttaggtacatcctctcccactgaaaccagacaaagcaactcagctagaagaacatattccacatacaggcaacagcttttgagataccctcccctgctcccattgttccagaacctcatgaaaaccaagctgcacatctgctatgtatgtgaggggaggcctacgtccagcccatgtatgttctttgattggtggctcagtctctgagagccccaagggtccaggttagttaactctgttggtcttcctgtggagttcctatccctataggagtccgaaatcctggaaggactcttttacccatggaatgatactcaaattttatatatataataaattttataaatttatacatatttatacatatgtgtgtgtgtacgtgtttgaatatgtgtacatatgtatacagacacacatacgtgcatatgagtgtgaaggccagaggataacttggatggcttcctcaatcatcaccatattatttttttttgaggcagggtttttcgctgacctagaacttgctgactttgctactctagccaggcagcagtccccagggactcttgtgtttctgcctcctcagccctgggattgcaggcatacatcactacagctggcttctttacatggnnnnnnnnnnnnnnnnnnnnnnnnnnnnnnnnncaaggtggaaatatatatgaatgaatgaatgtgaatgagaattaaagtgcatatccaggtgcacatctctatgcatatatatggagaccaaacaacagcattggttatcctttctcagcagtatccctggccaccttcctcctgtacccagcagggtccctcactggcctagaacttgccatgtaggtctgtctagcaagccccaagcttctgcctgtctgcctctccagtcctgggattctaaacacacaccaccatacctgaactcaggtcctcacacacttcaccagatgatctgtctctccagctcacaggtagggagattttagagctcctttttttttttttaatgttactgtacatttataattgtacatagtaatgggtttcattgtgatgtttccatgaaagcctttaacacaatttgatcatgtcgagtccttcataatccttcgttggccttccttctcctaatccccttttctcttcctggaaagccacctcctcctttcatgtcttttcctctaaattccataatgaaagaaaacgtgatatttatctttatgagcctggctttatattacttaatatgatattatctagtactgtctgtttcccaaagcacttcattgtggatgggtggttgggtcaatggctgggtagatggatggatggatagatggatggatggatggatggatggatggatggatggatgtcacaattctgtatacctttggagactacatagtctgattctcagttgagggcaaatgtgaatagtgccacaataagagttgctatgcaaagtattctgacttcgacttctttcactgtatatccagcaatggcatagctagattggtaatcttggtgtgttttaaatgaatgtctattctgatttccatggtatctatcctggcttctattccaactagcagtggacacgggcttcttttcctgtgctgttatttgtcgttctctgttatcttggtggcagccattctcactcggggagatgaaatctcagtgaagtttgatttatatattttctgtggttaaagatgctggacatatctattgcttattagtatttcttctttaaaaatgtatctgttcagctgacttgaccacgtattggttgcatcacatgttctttgtattttctggataccaatccgctgttagatgaatacttggaggttttctccatttgttgtaaggtatggcttcactccgctaatggtttcctttgttgtgcagaagcttttcaatatcatacaatcccagttgccagttcttgcccttatttcctgagctacaggcggcctattttaaaaaacaataatcactacctgtgcctgtgagctcgagtgtatttccctgttttcctataaaagttgtaaaatctcaggtctctagctaggactgttttgagctgatttccgttgcttcagtcttctacctgctcacgtccacacgttgaggaagatgctcattcttcaggatgctgtgttgtcaccttgttgggaacgagatggctgtgtccacgtgggtttgtttctgtgttctttctcatggtttccattctgttgctgcagtaaaatatcctgaacaaaagcaattcaggggagggaagctgtctgtcattgaggttttgaagggaaggtgcactgaagggggtttcttacctgggcagtaattcagctggcggaaaacatgagcctaatgtgttaataccatggctgaattcaaaggggggaaaatgagtttctcctctccttggggagcctccatcatgatttatggttctgtaaagtagggggtgcttcacagaaactgtttctcttcattgtagagaagcagtgttgtgaagatgggcttttaaaagcctccttgtttctccggctaatgctgaggaacttacatggccccatctctccctgggcagcagtgtgcatttgtttttgattgacaggtcagcaggtttaaaaacatgtgcagggtgtggtgtgtggcttcccattggttatgcatccatgtcacccatgaggtataattaatctcatagttctcaccaccatcggcgttgtttttctaatttaatgaaataattatcatgttgtccccagcttactctgtgtgtggcatgttgtgggtgctcaaggagtatatctcaacggacagaattgaaaaaggagttagctactgtagccatgttgaaattcaacccttacagtcacattaatctctgttaggctaagagcagtggctgacattggtggtggaataactgggatgggacacagagaatccttgaggagtggtggtcatattctgtgatttggtaaggtgtggatttcacacatatattcatttatcaaaactcaatggctttttccactcaagattcataaaatgtgctatatgtgttgttgtctcaagaaaaaaaatccatcaatcagtcttaatttctagtacatattatgcctcctgaaatatttatggaagagtgtggtcatttctgcaatcagctttgctctgcagtgaaaaaataatggatgaggacatgggatgctagagatgtgtaaagaaatgtgtgttaactgcagattctaaacagagagtatgtatggattggatgttccttatccaaaattctagagaccagagtatttcagactttatttttaattttggagtatttgcatatgcttagtgagctgttagatatgagattccactgtaacaattcatttgtttcctgcatggttcaggatatttgatcatactgtgaaccccaagattgtgttgtttaatgaaaaaaatctgtttctagttgtggtatgtctcagcacttagcacacacctttaattcaaaacaataaggtacagttagtttgtagaaggaactgcccatgtttgaaagtgatgtctaattgagcggcagacaaagtgactaatcagagaaagatttgacagaataagtcagaggtagtatatacccaagtctcaagagaaaagagaggaaggggaagctactttaagtggcagcatggaaagagtaggacagggggcagtttaccagcagagttttacagagatggttgcagggagagaacaagctaggcacaggtgaagacagaaggagtcagaagatgagaacatattgccatagtttgaggccagtcagaacaattcggtgagaagtgaaagaagccagtttgaatcagtcaacttggagacgagttttgagccagaacagctgagttgaaccagccagccaaagttcagaaagaactaggaagtgtgagcttattcagcagtgactctcataggctgaaattattctaagcctagataagattttatggatgctagaagcttccaggactaggcctacgttagcagacagaggcagtaagcctcggagacatttactacaaggaaataaatgttactttcgcacatgcgtagtttacatatatagacaaaagtcacttcatcataattattattttatacatgaaacgaagtgtcatggtatccagttttctttttgtggtgacatatcagcactaaatatgttttagagtttgaggatttcattttttcagattagggaacaacttgtagttgttagctttaatattatgtgagtgtttttataaacttgaaaccttttttttaaggggagcagggggagaggagagggaataggggatttttcagagggaaaactaggaaagggaataacatttgaaatgtaaataaagaaaattactaataaaaaatatttgtttatttatttatttatttattatatgtaaatacattgtagctgtcctcagacaccccagaagaggacatcagatctccttacagatggttgtgagccaccatgtggtcgctgggaattgaactcaggacctttgcaagagcagtcagtgctcttaaccactgagccatctctccagccccgtacacttgaaatcttaaataatttttctaaaaatcaaagggcaaaaccactcatgaccttgcaaatatgacaccaaagtccacttgacattttttacccacattcttcaggttttcacatctgctccttgaaacagaaacatcatcatttgctagagacaccctggtgaacccagcagtagatctttatgatctatagagggccccttttactgggggtgaggatttgaaagacaattttaaaaggacagaggaactttatacttagcgtggcgacatacaggatagtcttctgcatcaccactaaaaacagttctccgtcttataatcatgtgcatgccagagagtaaccatttttattgtcacctaaggaagacctgaagaactaccattctgtgatattgtcagaaaatggctacctctacctacacccggttgtgtacataactcccttatagaaatgacgtggaagttaccaagctcaagtgcagggcagaactgtctccacgtgcttattcgtacctttcctcttggtgtatttttccctcgtgcaatatagtagaaagctaaagccagacacatgtgcacccctcttgtagttaccaaatggctctgtgatcttgtgggcattgcttactacctttgggtataactttccacaatctttaagcaagttgattgagtcagatcatctgcagtcccttctaccattgggctgcacctgctgtagtgaaatcttgaacccatacccttggcataagatgaggagcccctggtcccatccagatgagatacagatctacaagagactcatttacatactgcttaaatactcacttttagtcaaagtgagtcttccttctgcttttccttactatctgaacagccagaaagcaagatgtattctaaacctctactaagagtatcaagaaaaaagaacaaagaagaaagggagttgaagaagtgaaactgtacatttggttctcttacacaaatccatgtgacaattctcttacgctgctgtgaatttacacggcattacgctgctctgtcaatttacagccagagtctttgccttctcagtgtggaatggaactcaaaggcatgagtggtttggtctatcacagtgttcaaaccactcagagccattagctgggtaaactttgacctcttcgtgtaccatttgctcaactgtgctgcaaaaatcagagtttcaacttctagtgaatatgtccttggcttactgtaattacccaaggctggttacatgacacacatatatttggattcatagtcacacagtgtacattatagtccagatgtggttgtatccacgagtctttattgtagtgtacatgcatgtttgcatattcgggtatggactcctatgtattgtgtccatttgattagctgtaaactggatgtcagtagtggagctgcttaactaaagagagaagctaattaccaaggacttgactttactaatgtactcaggctgaagatgtgttaggtgttaggtgagatcatggacaagccatctgatttggtccattattatattttcaattatctttcatattcaaagagagacattaatatagctgaggatgacatagcaaattaccacagctctctaaccctttaaattgctaatactgttgtaatctgtaattatagaaatcagtgtgagaattgtggcagtgcataattatcttcctgatactttattgctgaatgaattattaatcagaatcagtcttgtatagtatttgcagcaacgcagaagaataatgtataattaaatttcattattctgatttttgtgttaatgttttatgatgttgtaattgataattaattggccaaaactcatacagtacttggaagtttcaggtggctgggaaatgttcagtgtgctgagttcattaactaagcagtaatcattctgcaaagaccaagggatcttgtccaagctatgtgagagagtgcttaaaagtggtgtcttaagcttgagcttttcacatttcctttaaaaaaaaaaaaagcaataactgtgagcatgtacaaatgatgaagacatcttgatagctttcagattgggtcaattttaagtaatcaaacataggttgagaatgtcagactaatacagtcggtaatttggtatgcctctctatatgtcaatttccatcctattctaattaaaccatccttctccacattactatagtgtgaggaaaagtgccacggccatagacctaagagctctttcctcctggtcttggtgagtataacacatcacatagcacatccttgtaaggaaagtctggtttcatctttccctattgttcaaaacactatatggccccctcctcacagacacatagatttagactctgaaaggattatgaacttctccttgactggcattctaagcaggaattcctggagtgagtttcttttagaatcctttgcagcctaggtaaccaggaaaagcgcagaatctaagaatgcctttcacccagcctgattcctattgaaaagatgcattgttgggcattttgtggactgtgctctttgattcgatttttaagaggccaaggaatctttttggttttcaaagtatctgctttagaaacatacaatttttctcttaagcaggtgagcctgtttttacattctgaggaattctgaaacattgtattagacaatgttgacagtgcatgcttatttacgtatttatttatttattgtctttttctgagcagattagaaaaccatggcggggaggaacaaaggggttaggggactgtttctgagattcctgaacaaatttgcctcgacattcccaagaagctctcaactggcttatttttgtgagttgcacttggttctgatgccttccactcccatttagtcaagaggaatctgtcatcggaccacaggaaaaacgcacttgctagatggtcttcattgatcttattgatcttgcaataaagatcagcagcaatcctcaaatcatctcctctccactccaggtactccacagccatgttgatcccagggtacccacaattccaaggcatcaccccactaagcttgctcacactaaccgccttctgaactctcagctgaggacctgtgccgctgtcaccttctaaaagccagtgctgttgagtttgaggtgtaagtctgtgtttataaacaggcggggtcagagtcatctttcatatgcagaaataaggaaggtattgacaaaatagaacagctaaaccatattctacaaggatccaccttgtgtgcaaacagcggatagaaaaggctctttggttcatgagtagttgagtccttccctttatgtgactttgtatgactttaaaataggaagaaatctggagtatgcaagccagagactggagacactggggacaactcactgagcaggcagtatatgaacaaagacctgaagttgattagagactaagcaatcactttcatcccgaggcagcctctcaggagacaacacgttctcttcatctcacatatgaggagactcggagaatgtacacaagctgctcagaccacccagccctaggaattcccagtaggtttggaggggaggggaggagggcagccacttcagatcaactgttaatgggggtaaaatgcagatttctaaccacagtagttacactaaatgcacatatgcaacttgagaactattatcattcaaagagataggaaattaactacagagtctgaggtgggcaggaggcactgcctcaattaagaactacaggttacaaaaatataagccactgtcaatctgggaatgaagggtggattttaaaagttgggatgatagaaaaactaactttattgattacttactaggtattgaatgagtcaactcatgaactaatgagcaaatgtgcaatgccttaatcctcagaaccctagctctttattacaccagttttaaagagttggggggaaggaggcagagaaggctaaaagacatgtctgaggttcagcaataagtgagaaacaggactgaaatccaagcagtctggctccagcctgcgcccatcaccattgcgttcctctacggcatgtgcaagctgtacttagtgagcgctgcattcctgctcaggtccatgtccaggcgccgtgcatgcttgtgtgttaagtccttccctctgaatggcatctgaatgcagatgagacacccttacccagagtttccatggttttctgagatgacagcctgatcagcattcagattcaggcaggcaggccccagagaaagcacacacatctctactcatgaaagaagagtcagatgtatataaatgcagtggagggaaagcaggggaagtctgtcccagagaggaatatgcaaggcacgtgcgtgtaacaaataggaaggggtgaatgtcttaggaaacgttattagataaccatctgcgagagttccccaactaccaggcactccctttaacatcagagagaagtagatcaggagttacatgtccataagagaagactttcttggtctaattgtgtagatttagccaatccgtgatgagtgtggttcctgagtggttcattcagagtgctcactcttagatccattgccttctgtgaccttcatggtcccagggggacgctgtggaaggcaggctatagtgatgtcatggccacagctgccaagaagcatgggagcccacactttgtgccatccttgcagccttaagcaaattggcttttacccacgttaaagcgaaaaatgcaagcaaatgaaacaaatgccttttgttcttcatatgatctccatcgacctccatatgagaagtcctccgtgtgtacagaattacaaacgtatgcactgtgcaaataattgtttctcatgatgatagtttgggacggaagatgtagctcagtgatggggcagttgcctagcatcggatcccagtaccacaaagaaaaaattagtgtttatttgagcacttactacaaaagtaagtagcatcctaaatactctattgttagagagaacaagtgttacagaagccaattaatgtgccagcatctgtcatctaagaattagacaagcaggaatcaaatggtaaccgtctgtgtagggaaggaaggagaaccggcaagtgggtgctgtgtggactcaggaaactaagccgcctcttactgccagcccacccaaacagttttgagttactcattcctgaccgttcaggaaaaagagtattttctacccctggaacagagcaaattttgactttttgtaaagggtaagagaatagggctaggaagatggctcactggctaagagcagtcactgctctcgcagaggatcttgggtttgattcccaggacccacctcaggtgctcataactggttgtaactgcagttccaggggcatcaaacgttacccccgtgagcaaggtgcacataaattcatgtaagcaaacacacgtaaacataaatatttctaaagggtcctttctttgatacagtttgcgttacccagaagacactctgtaaggcagaaacgtgtgagttctgcggcacggcagctttattccaatagcatgctctgggtggtgaagcatctgtgtcacatttggtaatccctactcgaagatgctgccacggaacgctccacgcccacggtttccccacccccgctttgctgacctctgcttttcccgtgctctttggagagactttcgcctctgctaatctcctccctcctcggttggcctccagtacggcggcagatggtccaagtccttgtattactgaatgtgagattaacaaactgctggcccatcctcaccttgggagtttaatcacttttaagtagaacagagaaaggaagtaagggaggcagacatctgtagaaatccacaagcctttctcagaatacctgagctttgattcgctgctgcctggtttggtatgctgtgcttttatttccttagttaccaggggagtcaggtgcagtctgagcctcttccatcctgcttgcattcctgcagagaagatgtttcagaacaacacggatccacaggacccaatgggttgggggtggggggtgggggtggggacaagttctcatttgttcagaacctcctcgtgggccaaaggggtggttcagcaggaaatgaacttgccttgcaaacctgaggacccattaaactcgtgatcccacaaaggaaagagggaactgattctcgaaggttgtccattggcttccacatgctcacacgcatgctcacatgaaggttgtccattgactcccacatgcttacacgcatgctcacacgccatacacactaatagtatttatcagttacatcagaacaaagatgtgaagaacctgtatttctgcagcctttgcaactgtgactctgctttgtttcgccctgtaagctatgtgccctcttgggagcctgggagagcatcagcagcaatcataagagtgaagagtcacctagccgcagatgctctttgtgtaaggcagacctttcccctgactgtgtgtctggaggtggacctgcacacaaagcagggcttagcttcagtgatgcagtctcgggcatcctaatcatagccagtcggatctccctttgggaagtttcacgtagtagcacatgtaggcgatactaacctgtgctagccacagtgacattgctaatactgcctctgaaatccgcatgcaaacttcagtctagtattgtcacttgcctgatgcctaaacttttgttaattaccatagcaaatcacttgaaacagactcaataaaaacaaaattatttttaattatagcatatgagtgttctgctctcgacgctgtcctggtccctcccctttattttctctcctcttctccaatatctggctccccgacacatctaaagccctcttagaactgagtttagtttctctcttctatcttagggctgacaatcatgatgaagctaaaattaggcagaattagaattacagtgccccttttccacatttgactctctgttgtcttttcttaatctttgattctgttgtgagttttttttgactcggttctttttttgagacagaataatttctgccagattctgggaactcccctcccacccgatggggtcggtctggggaggagaagtgagccccagttgagcccagcgctcagtacaggtctgcagcgccttctattaaaatgtaaagtgatccgttgagtcagcctccctctggtttgactcagacgctttatggtgcactttgcatgtcatttctctgtaatgatttccccatggagaagggtgtctgatagaatccaggcaagactgaagattgctctgagtcaaatggatcttttattcttttagtattaacccttatctctcagtttcccatcctcgaattttccctgaaggaaccttaatgaagtaaacaggcctcagcaccctcatttagcttcctaaccactgttctcagattcttctcacgttaacagtgggaagctccgggggaatagtctgtggtagaaggggacattgagagagaatattcacacagatgccctgataaagaaaaatgtagaaaagagatgacatttctctgtcctctaagaggcagctgctaatgggaagcagaaaatgagctatgagaaatgaatataaatggagatggaagaagtgacaccagagacaaaccgaatgtgacaatttggaaaagaaaggtgaccaatagcagaaaatggcctgacccagaagaatagacagtgtcacctgtgccctcagattggtggggtgggggggagggaggcagctttgccacaaaagaacaacagaggaggagggagggaaagagagatggagagagagagagagagagagagagagagagaaggcacgccatcagaacagaagaacaaggtagacagccgcttgccctgttgtgtcccttcccagttccacagtcctctccctccattgtcctctgttgccccagccatcactgactgcgaccactcatgttggactgcctggcataaagactctttcacatgacaatttctttctctctctttcttcctttctttgtttctttctttctttttttgtttttgtttttgttttttcgagacaaggtttctctgtgtagccctggctgtcctggaactcactctgtagaccaggctggccttgaactcagaaatccgcctgcctctgcctcccgagtgctgggattaaaagcgtgcgccaccattcccggccacaggccaatttcaatgctgcattcatttgagagtggtagtttacgccccatcttactgttcagttcaagctgtggccttctccctgcctcctaagcagcatcacttcacctggggtaactacagaaggaagagagaagcagcacctcttaggtgaagcactgagtccagcctgcctcccagagcggattgaggtgggaagacgtgttcctccgtcctactgagctttgtgctttgctagatgtgaaattggcttctgagtcaccttttctttggactgacttgtttatagacggggagggtcacagcgttactgagaatctttctctcttcagctcgctccagatacatagtagcattttccatccaaccagttacattgttgttgatacatcaacctttcttttaagaactgtggttagaaatgcttgcttcgagccggggcgtggtgcttttaatcccagcactcaggaggcagaggcaggtggatttctgagtttgaggccagcctggtttacaaagtgagttccagaacagccaggcctatacagagaaaccctgtctagaaaaaaaccaaaaaaaaacgagaaaaaaaaaaataaaaaagcttgttaaaagacttttccaaaagtaatactttcatagaaacacagatattctaactaggaatactttgagttcacctgtttcttcttgctacaaataagaaaatggagatgcagaaactgattggcttttgtgagagaggaaagcatgggatctctgaaaataacttacagtgggacagatgctggggtcctggtgatcctagggcttcaatatgtgaatcagttgggaatacagataactttactcagtaatactgtgtatcataggtgtttatgatttgttcatttttagtacaataatagaattgtggtatcatgttttatgtctattataattatatatatattatattgcaatttttacattgcttctgtggactgacattcagtgttaggtttgtgacgtcaatctgcatgctacatatggctctaattcgctgttattccatgtataaataaataaatactgtatacctcagtgctactgacaggcattgcattgtttctactagagggttattataaataatgctgccgtgaatatccttattcagtgttccactttggaacctgggagaatctctactgtaacctaagaatggaattgcaggggataacccatgcatgccttcaacctcgctagataatgcaagttgtttctagagatactaagacaagtctcatcaacaagcaagaactcctgttgcttcagcaacaatattaaatttaatattgtcagattttctacttctttccaagctggtggttatggactgtctttaatactttattatctttagccagattcattacagtttgccctagcatcatattatattttccagatcagtgtctttgtcagcttctgcttcttcactcagattattttaaatatgaaaagttagaatgagtcgccattttctcattggatactttggagtttagatcttttttttttttttaattttcatctgtgcaaatgaataaatgaaacaaccaccacagatgcagagcttctcgtgactgctctgtgttcaaatctgggtgtacttctcaactgtgaaagtaaaaaaaaccattgtcgcaaaggtgctagtgaatccaagttcctcctgaaaggtcaaggaaaatggacttttatactgaactagggaacctttgagaactctgaaggacttgatgatacaattgcaatagctccagtcttagcagtgcccttaaatttcagttcccttggcgctaagcaggaggcagacagatgggggctttgaggaagtaaatcagagaaaccttttagctgatccacgccaggccctccctctagctctctaaggcactagggacattaagcactcaatgtttgcattaggaaagactgaagctttctactttcagtgagaagtttgatgtgcttagaaagagtttgcagaccacactaacaccgactctgactccgtttgaatagctctctgcactcacgagtctctatagacatgctaacttcctcctctaaaaactaactcttacgaatttatagtaaataactttttaaatgcttgataagagcagaaattcactcggcaattactaaataatttagcatctgattcacagaagtgtttacttaatgcactgtttctgggagcggtgtggggcgcaccgagtgaagtggtttataatttactccttttcttcacccgcaaggcatattaattttttttcatcccaagcattctagacatgacaggttgtctgtaaaatttaacattctactttttttgtgaattgccgcttttctgattccccactgtggattttttaactttgtgaattatacttttaacagaggaactgttagacacttcactatctgaatatgattcagtaatgaatgaagagcgggtaagctcacaagtgagtctgcattcattaatacggcatgcttgactgagaagagtgtggcctccgtagctgcttttgaggggatgagcatgctatgataatatagtagtaattagcttctcctgccgaaccatatgaggaaatgattggggtgtgtgtgttgtgcacatgtgcagctggggtttttggcatgcaagaagaatgagatcagccaaaacccaaaccagagcctttggaaagctccctcacaatctgacttcagctaatgtctacatactttaacacattgtctactgcttagggtaaagcctggctgtcagactcctgcgtgctattctgggatccctgctccgcgcgcgcactgtgaagtgtttcattcttagatcctgtgatccctgctgctttgttgcattaggtggcaagcgttgcttaattaacattaggaacgaacgaaggagaaatagaaagcagggtgctcgctcctgcaagggaggaagagccgaaggcagatgagagttcacagaacacacgtgatgaggccggatgaaagggctgcaggaatagggtgccattgtgcttgaagagacccggggaggggtggatacagtcagacatgtaaagaacaagagaaagccaattggacaactacagcagaaagaactatccaagaatcaggtaacagcatccagaaaagtcactaaataaaggtctagcaatcgtttcctgataatggatttcagggtttgccttgtgtgcgggttagcttttatgtcagcctgacacaggctacagtccttttggaagaaaatacctcaattgagaaaatgtccccatcagactgccctgtgagcgagcctgtgaggcattttcttcattgatgagatgtggataggcccatccttcatgggtagagagacccctgaatgggtgatcccaggtgctataataaagcaggctgagcaagccataaggaccaagccagtaagtaccacccctccatggcctctgcatcagctcctgcttctaggttcctgtcctgaccttttctcagtgataaactgatgtggaaatacaattgagataagccctttcttccttgagctgctttcttctcggtgttttatcgcagcaatgactaagacacctaccatgtggaagaccctgggttcattccccagcaccacccaaaatagatttcagtttctactgtttgctgaacagaattaatattgtttaaatgtcttcaaatcttaattgatggcttagccagaagagcagatatccttgcgaatgtgacttttataacattcttggccaactgagactccatatatggccctatcctctcttttcaaaagccagttctcttaggaaaaggctgggtcctcgagactctcccttattccccagctgtctgggagctctgcagccttgcctgaatcctggaatatggtaatccagtctctgccttgttttgccaactattaacttcctcgtgggacatgattcttgtcctcctctccaaagtggttaggacctcagtcaggtctcagtggaatctcagctgaatttccctggtgacatatctgcagttcatatttgcttgctcaggcgatgttcccagaacggaccctccaggttaaggtgaagccaccaacagcgtgacttctccatgttgctcccagaagcccttcacacttgggtccccatgtcctacaaggaacttagttcaagaaagttactgccctatcaaggaatatcggggtgcatcctgacaggagttcctaatttgggctctgcagagcaggagactggaatcctgctttctcccccaaccctagagaaacctttgtacattgtctacttcatttcttagaaccacctcttcagagacaactttttatttgatgcaacttctgcgacaattaaactgcactcataaattgtcttcaaagggcctaattaagataatttctgtcaactagaaggtaacaacccaccctctaaatcacttgggtcaatttccctcacagcctcctgagggttttagagctgtgagatcccagctggacttgtggtccttgcttcacattttgtgatcctggattcagatacaaagtgaagcagcagtttgtccacatccacagagcgggtcagtgccacagccgaagcagaggccactgctctctccgccgcacctcagtttcattgctctctgggctatcaacccttccatatttcacttcatttatggccttgtgttcttcaaagcaaaactctgtctcagtacagttacaatgataatagattgcccataagaatatttgaaaaatggcacactttattaatcccttcttctgatgacgttagtgtgtcagccatctatttttttagaacattagttgctcaaccaggttttcagtgttgcctggtacatatgaactgttacatttttttaactcaatacattgtgtagactaatagaaaaatcaaatgtgataggaccagaggtaataatttgagagtggagaagtcaggattgagactgtatggtagacacaaaaattctggaaacattccaaggaagtggaggctaattagaagacaatagagaggctcagcagctaagaacacttgctgctcttaagagaggacctgagtttgattcccagcacccatgacagtggtgcataactgcatgttactctaactccaggagttccaatgcccctttcctgttctctgtgggtacctgcatttgtgtgcaaatgtcttagttagggtttcaattgatgcaacaaaaccaccaagaccaaaaagcaagttggggaggaaaaggatcatttagtttacactttcacgctgtagtccatcttcaaaggaagttaggatatgaactcaaacaggacaggtacctggagacaggaccatggaggggtgctgcttactggctggctggctgtggcttgctcggcctgctttcttacagaacccagagtcaccagcacagggatggcaccaccacaataggctggaccctcccccatcaattactaaaggaaatgccctacatctggatcttatggaggcattttctcaattgaccttccctcctttcagataactctagcttgtatcaagttgacataaaagtagccaggataccatatgcaggaatacacacatatacataatttaaaataaaataaatctttttcaaagaaaggcagtttaaaaaaaaaaaagaacttgcgttctttaactcagtaataaagaatttactagcaattttctagagctagacaccaagagaccttgactttattccatgtcttaggactgttttgtatgaattgtgtcagttataatgttattcttcggatttcacagattgtagataaacaactttacaaatacttcgtttttatttgaatgccaaagaactaatgtgttttcctcacaaaaactttttgtaattagattctgaaaaaaacaccacttatagcagagcatagtttacactgtactgttagcagtgtggtacgttttgcttgtaaagtactagagaaatcataactaataaattgagtgccgctgagatgactggagtggggaggtcagggtgcttcccttggccaccctggagaggactggcacctgttagttgtcctctgacctccactgtaagcaatggcacattctctcgcacacatgcacacacacaataaacaaatgtttaaaacctctcttaaaaaataaattcagatattttgcttctagccaaacttgagcaatgagtatttttttttgcatgtaaaatatgttttattgttcttcaaaagggttcagggtttggttgtaaatcaggctgcacaccttccgtcagtctaacctctctcacaagtcaaactggcttcagttagcaatacttcattaaatccaaaagaaaaagagttttaattttgaggggaggaaaaaaaaagtccagttctgagaacaattaacattattagggttgctttattctccttcacacacccttctccccagaaccaagaatgacactatctcaggcaggctgatgctggtggacacctgcatgtgcagaccccatgggagctattgtgctcatgaacaaatacacacacacacaccaaaattctagcatgtcaagtggaaaaggtttaagtggtattgatcaaaacccttgaggagtcaacagttaacctaacttttaggtaagaagtttgatcttgagtctttgtgaaagaagcatctattgccatgctctgaagtaaaaatttctggattatatcatcatcatcatttttcaactttaacattctaggaacagtgtcaaaagcattatttttcattttctgggatgaggcaggaaggtatttgcatttagttaaaaatcaaaacaatagcatcaacagtaagcaggcaactcagaaagccaccaacatctgggtattattaatgagatgtcatccatcctactggcttgacaacacccagcagtgagtattttatttacacttccacctgaataactactaagataaagtatgaagtaaggcttttgaataccttcgaggcctgagcacatagctcagttggcaagtaaatggcatgtgggtgataagacctgagcttgatctgcggaacctgtgttaaacgctctgtgatggctgcagatgcggttcagctgggaaacagctctgctgaccagcacgtacagaacattaggcttggttcctgcgctacgtaaaattaggtgtggcatcgagtgcctgtaatccaagcacttggcaggccagggcagaaggagcaaaagcctgttatatatacataagagaattaaccaaaaaaggcaaccaaggtggtccatgcttgtcttctcagtgctgggtatacagaaacaagcaaaccctggggcccactggccagacaaatcagtgctctctaggacagtgggcagggcggggaagaggagacagacagacacacgcacatgtttgactccttatgaacaacacttgaggttgtcttctggcctctataagcatgaacacacacattaatgacatttcacattagatattaggtggcaacgaataggagtcccccaaagacagtaaaggctctagccccagaacactgctttgcgagtttccagaccatggagcaaaagaaaacaaggcattttgacgctgtcaagtggacagagctcagtatttggatacatggttgtggccagacagaaaataggagggggggggggcagagaacagagagccccagaggttgcagaaaatctcccttcagtgttcttcagagaactgatgagcacaagtgtgcaaagaggcatctcaaacatctcaaagtcttctgtggagatagaacttagtgcttggaaagtctggggtcagtgcctgttcctcatcgccccagatttaagcagacatgaagtacagtgctcacagatgtcattgatacatagtgaggaataaggctcccgagactacatgttcttcttcatacaatctcgaatgcacaatctgaaagggtcaagctgcttcccagaaccttatccctgtcttgcaacaaagcttagaactgtgtgtcataacccaaaatatccatcataaaaattgagtccaaaatgtaactgacagtgtctggcatctggccaagtatgtccaataattaaaagaaaggagggttgtagtggggggatctgagccagaacccatacacataccgaataccatgcagtagtgattgtgattttcatgtcaagtcggaaggttaaaatttttaagcagagacatagaagacactgtaaaacacccatgttggacttctttatcaatccctgaggtcacaatgagataaaaactgcattgcctttgaaaaagatgaatggcagagtagacattgctgaaatggagaccgtccaggctggaaaaagcagagccatgtttgaatgagcagggtggtttagaactgtagacaatttcttatcagcaagtcttgggctgtcctaaggaaaagagtagatgagacagcaaaaatatttggcagaaacagttgagaaaatgatggctggagtgtcatcaggtgtgaaagctcccacagacccagacacaggaaggagaggacatcagtgctcaccataatcacactgcttggaagagggaggggtacacttggaagtaaaggaaggcttaagcaaaggggaaaggaggaacagaactaaaggtgccaggccacgccctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaggcaaccgaatgttttaatttacagacagcataatcttcaccgtagaaaacaaaaggctataagaacttataagcaagttaggcagggttgcaggacacggagttgtttcttggtgctaggtaactcagtgatagaacacgtgcctagaattccagcaagaggccctgacttagatctccagcactcaaaaagaaagtatttatatattaacaatgaataaacaacagttgatgctgtaaaatatttgaacacttaggtataaacctgagaaaataaaatatattaatactcatacagcactaaaattttattttagtggagtttatcaagtgaaaactttgaaaataactattaggagaagaagacaagcaatggacactggagaaaatactaacccgtattaaacataaagggctgttgagaatatccatcagtagatgtgaatggcttaaaactcgaactatatccatatggtaaatataattcagcaataatataacaaacttttctttttattattttttaaattagcaaacaaatggtatttattttttaatatttttattatttaagaaattgatacaatgtatttttatcatactcactcccactcttttgttttattggttagtttatttctttacatttcatatactatccccctttcgtttcccctccataaacaccctatcccttcccctctccccctgcctctatgagggtgctcacccacccacccacccacccattcctgtctccctgccctggcattctcctcactggggcatcaagccttcatagggcctcttctctcagtaatgcctgacaaggccatcctctgctacatgtgcagctggagccatgggtccctccatgtatactctttggttggtggtttagtccctgggagctctgggtggctctggttggtcgatattatcgttcttcctatggggttgaaaacccctccgcttcttcagtcctttccctaactcctccactggggactccatgctcagtccagtggttggctgcaagcatccccatctgtattggtcaggctctgacagaacctctcaggggacatctataccaggctcctgtcagcaagcacttcttggcatcagcagtagtgtcttggtttggtgtctgcagatgggatggatcactaggtagggcagactctggatggcctttccttcagtctctgctgcactctttgttcctgaatttcctttcgacaggaggaattctggattaatatttttgaggtggatgggtaaccccatccctcaaccaggggtcatgcctatctactggatatggtctctacaggttctctctcccctttgttgagtgttttggctaatgtcctccctgttggatcctgggaacctcttgggtctctggcatctgggactttctagtggctacccatccccccactgctaacctcctttcaaaattctccccatctctaaactgccccccttttccttccccctgctctctctctcccaggtccctctctccctctacttcccaatattattttcttcccttctgagtaggactgtagcatccacactttgatgtgatcttctttcttcttggatttcatatgatctgtgagttgtagtgtgggtaatcagagcttcttttgggttaatatacacttatcagtgagtgcataccatgtgtgttcttttgtgactgggttaacctcactgtcctggctagttttgtgtcaacttggcacagctggagttatcacagagaaaggagcttcagttgaggaaatgcctccacaagatccagctgcaaggcattttctcaattagtgatcaagggtggaggtccccttgtgggtggtgccatctctgggctggtagtcttggttctataagagagcaggctgagcaagccaggggaagcaagcaagccagtaacattcctccatggcctctgcatcagctcctgcttgagttccagtcctgacttccttagtgatgaacagcagtatggaagtgtaagctgaataaactctttcctccccaacctgcttcttggtcatgatgtttgtgcaggaatagaaaccctgactaagacactcactcaggatgatactttctagttccatccatttgcctatgaatttcatgaagtcattgtttttagtagctgagtagtagtccattgtgtaaatggaccacattttctgtatgtattcttctgtcgagggacatctgggttgtccagcttctggctattataaataaggctgctgtgaacatagtgggacatgtggcccttgttatatgttgggacatcttttgggtatatgcccagctcactctcactcttacccctaactcctctcagatagactcttcctccatccctctcaaactatgtgccctcctctttcttttctttcattcttttttaatgagcccaccaaattcaatttctgctgcccatttacccatgctgtgtggccgtgtggccatctaccggaacttgcagtagacttgccagagaatacacccttaaagaaaactgactttttcccttcctaggaagtgaccaactgtccatagctcctcatttatgggtggagaccccttctctctctctatgctagaattttgactagcttgatcttgtacagacaaccacaactgctgagttcatgaggataccagtcctgccatgtccagaagatactgttttgctctgattctctgcaacttctgtcacttagaatctttctgtcccccttccaccactttctcgggcctttcagggatgtaacatagctgtctcacttgttccgagcaccctaggactcttagtctctgtacttccaccagttgtaagttcttgcatttggccaccatttgctgcacaaagaaacttttctgatgatgtctgagagctgccctattctatgggtagagagatcaagacatagaaagcagtccagccaaatggatgtatctggaggatatcatccttagtgaggtaacccaaccacaaaagaagtcattagatatgcactcactgataaatggatattagcccagaaacatagaacacccaaaatacaatttgcaaaacaagggaagaccaacgggtggatacttcgttcctccttagaatagggaacaaaatacccatgaaaggagttacagagacaaagtttggagctaagacgaaaagatggactatccagagactaccccactggggatccatcccataatcagccaccaaagggaccctgctagagctgtcttgtatgaggctatgccagtgcctggcaaatacagaagtggatgctcacagtcatctataagatggaacacagggcccccaatggagaagctagagaaagcacccaaggagctgaagggatctgcaaccctataggtggaacaacaatataaactaatcagtacccccagagctcgtgtctctagctgcatatgtagcagaagatggcctagtaggccatcactgggaagagaggccccttggtattgcaaactttatatgccccagtacaggggaatgccagggccaagaatcgggaatgggtgggtaggggagcagggcggggggagggtataggaaaccttcaggatagcatttgaaatttgaaatgtatataaagaaaatatctaatagaaagaaagaaagaaagaaagaaagaaagaaagaaagaaagaaagaaggaaggaagcagtccagctagcactgtaatagtagtaggctcactctgaggcctaggagttctttaaccatgggttcttggtcagatttagagtaccagtcatttgtttcctcctggacaaaaggactttaagtccatcagaagtggttggctacccccataacctttgtgccactgttgcacccatgggtgtgccttgccgtgccggttatcattgtaactgatagggttcacagattgtggatggcattttcttccagcacctaccatagcaccttccagtactgcgaaggctgaccagataggagaaaaacccctgctcagtaccaatctgatttcttcatgccctgtgacaaaatctctgtggtatcttcacaataaggctctaccatcaagttctggtgagcagtcaagaccaacaacaatgccatgtgctgttggaagggtatctgggacatctctgttcaacatcatgaggagaagaatcccacgggtgatcctgggcttttcatttggcatcttatggcttctgaggggagcatagtctcctatgtggggtgcttccagttaagcatctttatatgtttatgtgcttcggaagcttataaagcagtcgatttccggatggccttttcaaacatccttagggttagttatccttgcctcttctaccctactctcctgtctctctgctcaccttaacctccctcccttatacagtgtattttcttacatatatgtcataaacattgctcacgtttgatcccactgtactcctgcccttccttcccctaccttcttccctccaaatagctccccttatgttttcatagtatgtatgtatatatgtattatgtatgtattatggtatatgtatatgtgtgtgtatatttaattctaggtcctgcatatgaaaggaaatgagatgctttatatttctcttctattatttttacttgttctcttttaatataaacaccttctaatttcatacttaaatctatattctgcatataagagaacatgtgcaacatttgtctttccaagtctgaccaatttcactttccagtcccacacatttccctgctaataatatgacattcttctttaatcttgaatgacactctactgtgtattgtgcaacaggttttctttattagtctgtattgttgtctgtatattggcatctaggctcttcctgcttcctggccatttcaaaagttctgtggtaagcacagatgtgcatgccaagatagactccttcagggtatgcccaagagttgtacatctggatcataagcgtagcctagtttgagctttttgacacactctgtgctggttcccataatggctgtactagattacatttcatcttaatgtaactctagaagtggaaaagagatgttgtcagaaagcagagcgtagatttggggctactgcgaggtgtaagggctgcagcagactttgggtggtgatgggatgttcatgttgattgcactgatggcttcccatcaaaatggcaattgcatattccaaatattgcactgtcatgtactaacgctgttttcagaagctagaaggaagaaggacttgctactggagtttgtgctggtagtaagcatgactggaacccagcctttggattcagttatggacagtgcattgtaaaattactcccagggctccttttaaagcaaagaagtctttgtaaaaaataatattactttgaatatctcttttctcatggttcctattgcaatattgtttccttaaagatacatcacagtttgatattggagaccagagtgaccactgcactgtattgctcatattccgccatgaggggcagaaggcagattgagtagcagactacacacagtttagtgcattcattaaatcatatctcatggttaaatatttagtctacttaacatctctgccaaatttcagcttaggaacttgcatgtgctttgtcaaaacagcatttcaaatacttcaaaaatgatttgttcctttttaacaccaatctcaggttgtaattagactgtacacacaagctccattttagcctcctaacgaaatcaaaactatgtagtgttaaggtgcttcgtgaaaagatgcagggtcaagagatgcagtgagcggaaaggaagcaataggttgcacctcccagccatccctggccttgttatgccaacacaaaatgactgtggtgttgctgtaaatctccttccaaatatgccccggcaatgaaaacacgacacagttaatgctgtgcacctagattgggcagatctacggctacactaccatcttctacaacttatgagaccccttagaacttgcagtttctccaggccatgtgctaatgctccacttttctttgtcttcttctacctcctcctctgcatcctctccctcttccattttctccttcttatctcccactcaccttctgctccaccttctcttttatctgcccaatcatcaggtctccattattttacaaattaaggtgggaagcaggtttacaggaaatcacctgagtgctgactcattccttgttctcagcccctcacaggagaatggaattaacaccaaatataattagccccagggctatgcacaacatttccccctttctgtccaattaaaagactattttatctcagatataattgaacataagtattattattttgtaatttataaagtacaagagacctaacccagtccatcatccttgttaattaaacagaacctctgtcatctattcttacttaaaagacttataattctacatctggctatgtcttggctttagattgaatgccatctgaacaccatcctctcaaaactgttcctctccaaataaaaagcctgagttggctaggagactatgtagtttttcaacctcatcagaaatctaagaacgactgatattaactggaaatatatagaaagcctaaaacggcttccaaaacgtagccaatccatagagactgctgatcacctggacagtcccttacttcaacacgctggagcatcggtcttcagcctactggccagggtcatctgatggacttagaaaaacaggaatattaaggactagcctactctgtctcggcagaatcaagctgtcctaacctgcaattgcatcctttctttggacagtattatgtctgtagatgaaatgaggcaattcttgcctagtggctgtttcaccacaactggagtaactctaaggtgctcagtttcttctttgaatccaagaccgggaaagctgtcaggagcagaatggtctcaataacaagtgaataaataacattaaatgtcacattctgtggacttctgatgtttcggaaaaccaactatctatttaaagtaatgtagacagttctctgttaactgctctcagccatttctaattaaaataactgagaacaccctaacaataaactcagagccatgaatttcctatttggcccttaactcacaggcttagacatctcagatctgtttataacagcaatagaaggactgggttcaagccttgtacttcaaaatttttagaatcaaggaccacctataataaccacccccagccccaaaacctaggaaactgggatgacgactcttcataacttcctcaagctgattatgggcattgagatattttaaagggagggggaagggtaacgaaaatgcgggagttggttggccttaagaagaccccaccaatgattgtattagtctctgatatctgtgtccttactggattcggatgagaagccaagaaatcaggagttagtcaggtcagttcagcatgtctgacgatgaaattcaccaaggctgaatattctgtcatatataaatctccaaacaaaattttagtatcatcaagataacctttttggggtctcccgctatcaaatctgatccatataactctgggaggtgtaaatacattattcaccttttccccaaatcagcatatccttcagccggtaaccaggaaaacctgtagcttgccctctgtcccagaggaacaataatacagccacattactcaaaatcacacacattttagcctatttaggcctttctaatttgtcatatcaggatattagcccaaaattcccgtggatcccactgtgtacagagtatgagtctcctgcagactttattataccatcttttaaaccattgatttaaaaccacacttctattttccttcctttttccttttccttttcctttccttttctttcctcttcctttcttttctttcctttccttcccacttttaaggtgggaagcaggtttacaggaaatcacctgagtgctgactcattccttgttcgcagcccctcacaggagaatgtaattaacatcaatataattagccccagggctatccacaacactacggatgcttagtagtcctgctccctctgccagggctcatggggacctgggagctttggtggtcttttttcctcctttgtgactgagccagcctctctttattccagggtttgaacggcatgtctgtggatgagaagcctggctcccccatgtatgtatatgagtccacagtccactgtgccaacatcctcctgggcctcaatgaccaacggaagaaggacattctctgtgacgtgacgctgatcgtggagaggaaggagttccgagcccaccgggctgtgctggccgcatgcagtgaatacttctggcaagcactggttggacagacgaaagatgacttggtggtcagcttgcctgaggaggtacagtgatttggtgtggttgtggggttgtggtggaagttagacgtgcactgtgccacgtggatggccacgtcacccatgtccacatcacgtcacccacatgtgggcttgtagcataatcagtttctgtttgatgcacttgaagcctcagaggcatgaatacaaagtgagcgtgcttctttaagggaactgagcctcacctggggccctggccctcatagtttctagttcacttaaacttcgggttttgaatagttcaacctcattctgatgcagtcctctgtgtaggatttgaatcactactatttcttctctttcaaatggatcattagatttcccctgagaataaaacagcgaaagaattcacaggaccttccttgcttaggagaaaaacaaagcgaccagcaattctcaccattaatgcagtgagattctaagaagtgtaaatttgcttttctcatcaggattgaaaatatcccctactcaggtttcttaactgcttcagtgagaacagtcattttggtactttggggacatgaatagcaaggcttgttctgtgcagagatgacagtcaagtggtttgagaggcaaggacccaaaagatgggtgtcacaatggtgaaccattaaactggtcactcttcagactgcttatgattcttcagtcattcgtagcctccttatcttcagaagaccggggttaatgtgtgaatccttgagctttgtgtgcaatgcagagtattctctgcacaacaccaatatatgatacaactgcagagcctctggcagccgtttgcaagctgtgtacagcacagcatgcaggagcacagctcacgttcacgtccttgcgaatgagacccagggtcacctctgcagcttcctcacagcagtcttctatgataagtcaaagaccaaaaatgtaaggagttaaagattacacttaccactccatcccgccatcaccaactcagatgccttcagagacatagcggtgacattaacaactcaatagtgctttgtaaagagtagggcgtgatggagtgagcagctagaccaccaaaaacacgttcaagcctaacacgagagaaacacaaagggggctggagatgcagcttggataaattgcctagagcgtggtccccagcaataaaaacaagacgcatgggatggaagagacaccagatttcagtcccttgctacacagcatttgtgactacccccgcagagagcagaagaatggccagctgatgaaccgctgacgtttgaaacatcttcacataggcaccctgtcatagtcacaaccaactgctccattcccatttcctacacagccgtgagagaaggaaaagaataagtcatttcaagattaggtagccaagatcaagtcttggatctagtaagaagagaaggagagcgagcaatggcagctgggtccttagcaggatgggcggttcccatctgcactggatggaggcatggcggtctgtaaactgctcctgggcttcgcagctgaggtagtgatgtaatgctgcaaacccagcccatcctgcagcaagtgctgctcagacacatgtccttcttctccaatgggaacaaagacgacatcctcctcactcagtccaactctagaattctctggaaatagtttcatgacatctagttatacaaagtagtcttagaggaggtgacacatgttgcctacttatttctgttgtgtcttggagagccatttcatatgtgtatatgtattactaatttccaaaacttagatattaaagcagatacacaaacgaagtcatactttatgtatcgagtcttccctcaatgactgtgttagccctacctcatacttcctagaaaagaagacctaagcccaagcctgttctcaattctaacctggatcctgatctactaatctctccgagcctatgtgtgagtgtgtgcatgtgtgtgtgtttggattttgggtttttttccccacaccagatttctctttgtagccttagctgtgctagaccaggctggtctcaaactctcagaaatctgcctcctaagtgctgagccatgatcttaatttcaagaagccctaaaattctgaagcccttaacctataatcaaaatacagtacccatccagtaaaatgtgaaggaaaccagggtataaataaatgttactaagcctgaagtttcttctcaagtcaa

SEQ ID NO: 1020 - DNA, 4991 bp, Mus musculus
cgagctgccatgtgatgcgcatcccctccgcctgctctcagtgaccccaggaccgcccaccacgccggcggccgggagggggctgcgggctgggaaaacacgggcaggaccggcgcagggggacaaaagttcccgggaagctgtctgcttcgagaagtgagggttctgaaacaagaaggaccttcaggagctgctccacactgtgacatgtctgatcccttgtgcccgtccctgcagcatgaacaaggtggacactcactgatctatcacaagattgcctcactgagtttgggggtccatgtctgaatggattgctgtagccttctcatctcttcctctgcccagttcccagcatcctaagactcgaagccaggacaggacctggggaaattatatggtttgaacggcatgtctgtggatgagaagcctggctcccccatgtatgtatatgagtccacagtccactgtgccaacatcctcctgggcctcaatgaccaacggaagaaggacattctctgtgacgtgacgctgatcgtggagaggaaggagttccgagcccaccgggctgtgctggccgcatgcagtgaatacttctggcaagcactggttggacagacgaaagatgacttggtggtcagcttgcctgaggaggtcacggccaggggctttgggccactgctacagtttgcctacactgccaagctgttactcagcagagagaacatccgggaggtcatccgctgtgctgagttcctgcgcatgcacaatctggaggactcctgcttcagcttcctgcagacccagctcctgaacagggaggatggcctgtttgtttgcagaaaggacagtgcgtgccagcgcccccaagaggaccatgggaattctgcaggagaagaggaggaagaagaggaaacaatggactcagagacagctaggatggcttgcgccacagaccagatgctcccagaccccatcagctttgaggccactgccatcccagtagcagagaaagaagaagccctgctccctgagtctgaggtacccacagacaccaaggaaaactcagaaaagggtgcattgacccagtaccctagatataagaagtaccagctcgcgtgtaccaagaatgtctacagtgcaccctcacacggtacctcagggtttgcgagcacattcagtgaagacagtcctggcaatagcctcaagccggggctccccatgggacagattaaaagtgagccacccagtgaggagaccgaggaggagagcatcaccctctgcttgtccggagatgagaccgacatcaaagacagaccaggagatgtcgagatggaccgaaaacaacccagccctgcccgtacccccagtacccgtactggagccgcctgcctggacaggtccaggagtgtgtcctcgccttcctgcctgcggtctctgttcggtataacgaaaggtgtggagtccactggcctgcccagtacatctcagcaacccttagtcaggagctcagcgtgccctttcaacaaggggatctctcagggtgaccttaaaactgattacacccctttggcagggaattacggacagccccacgtgggccagaaggatgtgtccaacttcgcaatggggtcgccactcagggggcccgggccggaaactctctgtgagttctcctcttcgccctgttcccagggagccagattccttgccacggaacatcaggaaccagggctgatgggagatggaatgtacaaccaagtccgaccccagattaaatgtgagcagtcttacggaaccaattccagtgacgagtctggatcattctcggaagcagacagtgagtcgtgtcctgtgcaggacaggggccaggaggttaaacttccttttcctgtcgatcagatcacagaccttcccaggaacgacttccagatgatgatcaaaatgcacaagctaacctcagaacagttggagttcatccacgacatccggaggcggagtaagaaccgcattgcagcccagcgctgtcgaaagaggaagctggactgtattcagaacttggaatgtgaaatacggaaactggtgtgcgagaaggaaaaactgttgtcggagaggaatcacctgaaggcgtgcatgggagagctcctggacaacttttcctgcctctcccaggaggtctgtcgagacatccagagtccagagcagatccaggccctgcaccgctactgccctgtcctcatacccatggatctccctggagccagtgttaaccctcctcctgtgggtgttgagcagagccttgcaccctccccgtgtgcagtaggaggaagtgtaccctgctgcctggagccaggggcggctccccccgggctcccctgggtgcccagcaacacctctgagaattgtacctctgggaggaggttggaaggcagtgaccctggaacattctcagaacgaggacctcccctagaagccaggagccagtctgtgacggtggacttctgccaggaaatgactgagaagtgtacaacggacgaacagcccaggaaagattatgcctagccggtgtgatcagctctgccgtacccaccaccctacccccgggtcttcacacctctctcatctgggtgttcttctgccagccagtggcgctgttcatctgtgtcttgaagaaccaagagcgaatttggtgcacactacagcagtcttagcagcaatactgtttcgaagtattccctcctctctctaagcaggagtgctagttaccttcataatggtgctaccccttgccctggcaaggaagacaacagtgtcgacactgtctgtctgtgggttcattgcaaacttcacagggatagactacacctctaggacccaaccacggattttttttttctcagtggcccatgtcacaaaccctatctcaggaatttcttctgaatgttcaatttttttcattgaagacagcttctatacacatcaaagttttatagctatactgtgtacatagtatatataatatatatgaaatatatatccatatgcaaaaagtcctgcatgcctcaattttctcatccctgaaactggaagcttcacttatcatttacaaacaggttccaacattcctctttttgtgtctggtgccagaactggtttggaagctgttaacatggctgttttgcttgctgcacaattcggtttccatctgtgcttatttacagacaaaattcaatgttgggagatgcttctcaaggttcaatctcagaccttttactttcgttggtttggttttggtgccgccgaacggtgtcaggtgagcaccgtgagtccgctcttctccccttgtgttttcccctcgtctctgcggatactgtacagcaatggtcaactttgccacttgcactgagttttgagtcaaacctattttcttaaatgaagttgtaacttcggtataactcaagtatattttttttttcgtttctttttctttttggagacagggtctcactatgtagccctaggtggcctgaaacttgctaggtagaccgggctagccttgaacttaaagagatccatctgcctctgcctctgcctctggagtgctgggataaagagtatgcaccaccatgcctggcagtccgggaatgcctacccgttggccaccatgacattaggtaggaaagcagccggaatcgctcctctctggcggctgagggtctcactgaggaactgaaccagcagatgttctacaccttctgtgctgtaggaagagaactcagagctgcttccaaggctttgacactgtgtgcagggctagaggccaatggtataggagcggccggtagggttgtgaatagaagaacagacgggggccgtcaccgcccactcgtaccacactttcttggaattgctgcatcgccagaaacgcacacagatgttctggccttcgtgcaccgtgatgggctgcttaatggggaagaagatggggaaccatgagaacattccaggagagtgagtctctgggcggatactcagagtgatgtcccggtaaagcacagtctcaaagtagcctgcgaagccatgaagcaccgtgttcacctccacaggaaactccagggtacagtagcggttgttgtcaatcataggatctcggttgggatggctgaaggtaaagcagggcttaggagcagagagctggtggaagttgtgcaaccgaaccacataaggcatctcaaactgtgcctcaggatcgcggtccttttcccgacaggcacggacctcgttgtacagcttagaggaagaaatgggagccaggaaggaggtgtattctccagggatgctcacgccatcatctttcaggaagtgctgtgctccatccagacactcaggtgacagctcgttgtcggcaaaggaacccagaagctcactgacaataatgtcagctttctccggagccacccattcccgcatgtctgatgagacaactgtcacctggctcccccattcttcaaactgccagttctctagcgtcaccacagcattggggttcttctccacagcatacagcctgatccgccgctcggcctgtttggctgcccgaaaagacgcattcacaagaggaccccggcctgcacccagcaccataagtacctggacattggtctccttttcttcttctggtactcggtctagcaaacatttataaatagcctgctgatattgagagtatttgatggggtccttttcaaacacttcatatgtctgagattccagattgtccatcagaggctggagtggggactgcagatagtcttcatagcctttggcaaaaagctcataggcattgggtggagggcgattttggcttaagtattccaagtactggaggtaggaacagaactccttctctgagtggtggttggttcccgtgatgataaactgcacttccaacttgaggagccggaagatcagcctctgctgcaccttagaaagaa

SEQ ID NO: 1021 - DNA, 2151 bp, Mus musculus
atgtctgtggatgagaagcctggctcccccatgtatgtatatgagtccacagtccactgtgccaacatcctcctgggcctcaatgaccaacggaagaaggacattctctgtgacgtgacgctgatcgtggagaggaaggagttccgagcccaccgggctgtgctggccgcatgcagtgaatacttctggcaagcactggttggacagacgaaagatgacttggtggtcagcttgcctgaggaggtcacggccaggggctttgggccactgctacagtttgcctacactgccaagctgttactcagcagagagaacatccgggaggtcatccgctgtgctgagttcctgcgcatgcacaatctggaggactcctgcttcagcttcctgcagacccagctcctgaacagggaggatggcctgtttgtttgcagaaaggacagtgcgtgccagcgcccccaagaggaccatgggaattctgcaggagaagaggaggaagaagaggaaacaatggactcagagacagctaggatggcttgcgccacagaccagatgctcccagaccccatcagctttgaggccactgccatcccagtagcagagaaagaagaagccctgctccctgagtctgaggtacccacagacaccaaggaaaactcagaaaagggtgcattgacccagtaccctagatataagaagtaccagctcgcgtgtaccaagaatgtctacagtgcaccctcacacggtacctcagggtttgcgagcacattcagtgaagacagtcctggcaatagcctcaagccggggctccccatgggacagattaaaagtgagccacccagtgaggagaccgaggaggagagcatcaccctctgcttgtccggagatgagaccgacatcaaagacagaccaggagatgtcgagatggaccgaaaacaacccagccctgcccgtacccccagtacccgtactggagccgcctgcctggacaggtccaggagtgtgtcctcgccttcctgcctgcggtctctgttcggtataacgaaaggtgtggagtccactggcctgcccagtacatctcagcaacccttagtcaggagctcagcgtgccctttcaacaaggggatctctcagggtgaccttaaaactgattacacccctttggcagggaattacggacagccccacgtgggccagaaggatgtgtccaacttcgcaatggggtcgccactcagggggcccgggccggaaactctctgtgagttctcctcttcgccctgttcccagggagccagattccttgccacggaacatcaggaaccagggctgatgggagatggaatgtacaaccaagtccgaccccagattaaatgtgagcagtcttacggaaccaattccagtgacgagtctggatcattctcggaagcagacagtgagtcgtgtcctgtgcaggacaggggccaggaggttaaacttccttttcctgtcgatcagatcacagaccttcccaggaacgacttccagatgatgatcaaaatgcacaagctaacctcagaacagttggagttcatccacgacatccggaggcggagtaagaaccgcattgcagcccagcgctgtcgaaagaggaagctggactgtattcagaacttggaatgtgaaatacggaaactggtgtgcgagaaggaaaaactgttgtcggagaggaatcacctgaaggcgtgcatgggagagctcctggacaacttttcctgcctctcccaggaggtctgtcgagacatccagagtccagagcagatccaggccctgcaccgctactgccctgtcctcatacccatggatctccctggagccagtgttaaccctcctcctgtgggtgttgagcagagccttgcaccctccccgtgtgcagtaggaggaagtgtaccctgctgcctggagccaggggcggctccccccgggctcccctgggtgcccagcaacacctctgagaattgtacctctgggaggaggttggaaggcagtgaccctggaacattctcagaacgaggacctcccctagaagccaggagccagtctgtgacggtggacttctgccaggaaatgactgagaagtgtacaacggacgaacagcccaggaaagattatgcctag

SEQ ID NO: 1022 - DNA, 96596 bp, Homo sapiens
atgatgtgtacctgtagttcgagctacttgcgagaaagaggcagaagaatcactcgaggccaagagtttgaggctgtggtaagccataattgtgccactgcattccagcctgggcaacagagtgagaccttgtcattcatagatagatagatagatagatagatagatagatagatagatagatagatagacaggaaaaggaatgtaatggacatttctccaaagaagatatacaactggccagcaagcacacacacaaaattctcaatatcactaatcattagggaaatgcaaatcaaaaccacaatgagataccaccttacacccataaggatgccaactattaaaaaaaaactaacgtgaaaaaaaataaaataaaaagtattggtgatgatgtggagaaactgatacctagagtagtcaaattcatagatataaaaagttaaaaagtggttttcaggggttggggagttgtttcatgttttgcaagatgaaaggcattctggagattggttgcacaatatgaatgtactcaactctcctgaactgtacatttaaaaatgattaagatgatacattttatattatgtggatttcaccataatttaaaaagtaaattttaaaaaagagggggtggatataattataataattgctgcaaaggatttaggtccaaggtacctataaagaggatctgacctgggtagtggtgaagaaagctccacttagctgagagcagaatgagtaggagtttgctggggggaagaaaagaggtagaaagaacaatatatgcaaaatccttgtgaggtgagtgatcttcatgcacatgggatgctttcttaggtatcaactaagtataaacctttattttcacttgactatttctgtttttaaaaatggagacataacttatcaacacagattgcaaaaaccttaagtgaacagctcagtaaatttagtaaaacactttgaatccagtaacagtcaaaaaaggtgcagttgtgcttcctttatcccttcctgccccttcccctaatgcttccctgggctgaggatatgtcagggggagctttccatactgaaggagactaaagagctagcacaactaactgtaccccatgatcctgactcaaactttgccctagaaaggaaaaaagatattgttggtacagttggtgaaatttgaatagggtctctggattgagtggtattgttatactgatgcttactttctgatttggatgttgtattgtggttatgtaccattattccttttgaaaatgtgcactgatgcatttagcagctgatggagcatcattgttgacaacttactttcaaattattcagaaagagaataatggtaatgggtgtttatattagatatttctgcaggcatacggagagagaaagagagaacaaatgtgttaaaatattaacaattgggatatctgcatgaaggagatatggtagttctgtgtattactcttgaaacttttcctaaagtttaacattattccaagatcaattatttttaaaagatactgtctatgatggcaatggactcacaggtgaggcagcaggtaagagaagtgagattagacataaagataaacattttatctgtcactgaatttgaaaaagcaaagtgtcagagaaaagaattagtgttcacttagcgcttgccagaatgaagtaggctatcctgcaaataacccacttatggttatcataaattaataagcattccgattcagcatctgctttcattagcataagttggtcatcaggctgggagcacgggttcctcctctagacaatggcccagccaccaatcttaagacaccttatatcccaacccacttccctagaccatcctttccagctttagaaaattaagcaccaaggaaatgtaccaatagaagcatgcctgttgacaagacctgggaagagctgtaaatccagagggtgctgaagtgcagctggaacaaacacagcacacctccatgttttcagccttctgcaaaatcaccaaaggctcaattcaagttggggcacgaaacactgggtttccacacacacctaacaatcgaaaggcagagaaattagctcctcagtgtgtggtactgtgggagacctacttagagagcacctggggaaaatggagaaaccgatgacacctaaatgtctgtcattcacataagcactatgccggatgcacacacggggcacagaacagctgtgctgaccagcacattgctgcaaccactgttcaggttggatgcccttgcataattatatcacataaacagatttgtgaaaaacagattagaaactgtaggtgccatcttacatattctttggggaaattgctatagggttagtgaactcaactttctgtgtctctcaaaaactcataagctgagttgagaaatataattcaatcgcaagtatatttttatcaaaataaaagcatcaaggctttcttttcacagtaatttaaaaattgtcagattacttctgtctacgaccaaacttttccaagtttctttaagcaaagatgtaataaaagctaaaactcagaccactgatcaaaaacatcttttagaggtgggcagaataaagagatggacatttagttaatggagtagtttagaaaaaactaggcatcacaaaccctgagggtaaaaaaagggaagcattgttagagctttttttaaaaaaaaaaaaaaaaagggaaaaaaagaaagtaatcttgtgattattataaattttattattattttgcttacctgagcctgacctaatcacctccttccctgtttcccaggtaaaaaagaaaaattaagctcttacccgaaatttcatgtctcttggccctacatcttatcctgaagcttcaaaatctttgcatcatccctttcttggatgtccctgtaatccagacagttttcagaggcgagatctgagtgatcctcccccgtcctgcaaattctgtttaatgctcatgttctgcctttcttccacctacccatgtttacccctgccccagagttctgcattcttgccatttttttcctctacatcagtgctccttctgttatctgctccattaccttaccttctacctcttccttcactcagattcctaccttcctgcctttctccatctttccaggcccccacttctctcattcattccccccctcctctgcagtgggtctagaagctccttgctgtcatatcacacagcccccatcccaccagacctttcttaatcatgggatgctattcccaggcccctcattgaaatgcccttttccttaccttcctcaacttcccagtctctgcttgattttctaccttcctgttggctccattcctgtctttttcataaactccttgttctgtgcccacatccatccccaacccagctattcctcaaacttcagcattgaggaagtcaaacttccctccttttgactccaccctttaccagagtgatcttagcctcctcctgcctcccagggccagttccctcctagtcacacaggctagaggtctccattccctctttctcttcttcctccctctccgtctcctcccacaagcaaatgacccctaaaccataagcgcttcccagccctgctcactgccttaacataggctgtaggacttgagctactgtcttatagtctccagcctcttcaggccccttcatatggccaatgctgtgttctttccaaaaccagatctgattatgcctctttggcaactggggatcactcatcggctttctacccatgcagccaggcttttcagtgtttctggggaaattagaagataaactcggagcattttcctcaagtacatccttcagtactttgattttgggtgtgggagaggaacttttagtcctgatcgtcacaaattgttaaacttttttagtaaaatcaacccatgtacttcaaagagaacaaaagaagttcaggtgattttttaacatgtaacaggaaactgcaaagacattttatgctttgaaaaggcaatttggggccatgttctcagatccctaggaagttagcattccattttctctgccattctgagcacttcactggaaaagttcaatgagaattttgatctgtggataaaattacaccttcatgctgatttcccatgtctacctttccagtcccatattccaccactggctgtcgctgctaaccatctcaattcctgcactttcgctactccaattttcctgcctggaatgaccttccaacattttcttttcacaaaatctcatccttcagaatccagctctgttgtcacctcctccaggaagccatcccacattctcctaagcaaagtcacttgccagaagacttttgtcctattcaggcccttagcatggtgtgctgtgaggacttcttcaccggttcaccttccccactagtccaggagccctgacttatgcagtgttttatctccaaaagttagaatagtgctagtacataggttgtgtatgctcgaggtgtgtctggaaaaaaagaaaacaggcaagtaacaggtacaaggtcttggccattgggaggggaaagaaggaaaaatctacattttgaaaaaatgagtcatgatcacaatggcattttgtcaccatggtacttcagtactccttgctagccatgacagcaggcacaatcccccataccttccacttctgacctatccttcttgacatcacaacctctcactctttcccaacactgcaagatatgaatgctatagtcagatgaaagtgtaacctcaaggggtccttctgcattaaaagtccagccaccttccctcctctctgactccttcctggccttgaggttcaactgaaattccaccttctcagtgaaaccttttctggctactttaaccttcataatttgtttttcctcttaacatctacaatacttaagttcttgttagaatttaattatgcatattttgaattttacaacatttattggctacctttattacagaagtaatatatttatattacagaaaatttttttaaaaagcaaaagtaaaaccacttataggctctttatttcaagagaaccacttgaacactgtgcatatagccttccagatttttcctatgcatgcactggcaattttttttcacaaataggatcctattgtaaatagttatacaaattattgttaaactatactaacaaaatattaatatatcaatatacataaattttcatcactaatttttttcattattattattatttttggtagagatggggtttcactatgttgtccaggctggtctcaaactcctgagctcaagaaatttgcctgcttcagcctctcaaagtgctgggattataggcatgagccaccgtgcccagccaccaatattatttttgatggatccatgatattcatattttatatatgaaccaccatttatttagccaatcatttcctgtaaggcatttggatttttccattttctttttgctatcatacaaaaaagatctgtacattcttaattttttcattagtataaattataacacatacaatttctatataattttaaatattaatatataaaagtaataaaatcaaatacaaaattacatttttcaattgtttcatgtatattagttttgactccttatgtagatttaagttccttaaggatacagtccaatgtttcttaatttttcacctcaacatgtaacagatgctcagtagtgtatgttgaaaaattagtttatttcatataccatattttactagtttatttcatataagcttttagataatagtggcatcaattctttactatagaagaagatcactatagatagtaatataagaacatcactttcttttagggactatttccaaagtccttcttaggaactgaggcaatctttgaggagatgaagatgggacagataagagatatacagtttgaaggaaaaaggctgccagccaaatttaacaatagctagaagcaaaatttttgcttttctggtttggattgccctgatcatttttcaaaacttgtgtgagattttgtacaatgagaaatctcttcttggcagtggtgtgtccagaaagcccccaggagtgggcccccaaggtcctctgtgccgtccagcaattctgccacatccctggcactggttcacatcttttctctatcccctaaatctatccttccctcctccactatcagtgaacggtctatcttcttactccactaagaaaacagaattcctcagacaacggcttcccatacttcctaccatgatattccagcctccctgcacttccccacctgtgctgcccttccttctgttggttgggatgaactggcccctttctctctcaaggaagcttctcagcttccttgtggggatctttttttcttcatcttgctgacctctaaatgtcggagtgccccaggtcttaaaccttagacttcttctctttgctcctcttctccacccatgtttccagttgctgtgttgatgacacacagatttctatctctagtctggacttctcccctaaattctagattcccatgtctgattacctgctcaccttttccacttagatgtctgatagacatctgaaatgtactatatccaaaaccaaatgtttcagcatttcccccatacctgctccgcctggataaatgaactctccattaataagctgttcagtccaaaattcagaatttcctttgactcttctctcatatcctacaatggaatcatcaacaaatcttgtccggtttatgctgaaaatatatctggattccatttatggctgtcattctagcattctattaatagtttaaatcaccatcacctctctaatgacttatctcaatagcctcctacttggtctctctgcttccattcctgtacttcccgtgacccagcagagtgatcctttaggagttgaggccaggacatgttccttgtctgcagaaacccctacagcatcccactccattcacttttgtcagatttcattggatgttaaatttgccctgccatgccttattcaaggtaccacatttgaaattctgtctactgttctgcctaagaaaaaatacaatattttctcaacatcatcaaatcctgtacagggtgctggagagcaagaaaatcaaaggctcaagaactgcccatgtctttagtccgtcttcctttcctcatctgtttcctgtatattttaatttttcctgttttattttctacaatcaagaagatttctattatagaaataaagtttatttgtttcaatgccatgatacagatttattgtccctggaaatatcatgcttagaaatgaatcacagacaaagcccatgctctggatcaacacacatgtgtaattatgtaggaaaaaaatgtatatcaggaaaggttgaatgctccaggcatgagaaataaattgacctccactcaacttactgccatgattatacagagggaaggacctggatctgtttcacatcataaacgcctaaattgccagagcagcacaagcccaggagtggccatgcaaactcatgatggaggtgctaaggctgtccacagcccaacctctgcagcagtactgttaaatgagtgtctagtacttgacttaccattttaatttcacataattctgaatgtatttttcggcttgaattcaaataacccacttctaactaccgaaaataaagtagaaaaatgaactcactaccagacttcaaagcttatccaaagcaaagatttcgtcttacagccagaggtgcatgattgcagagctggatgtaacctgagaggctaactactcctaattcagcctccttgaatgactggatgatgcaacctatcacaggtgttttaggttttttcatctctatttaatgtcccacctcatgcttgaaaatctcaaagtgaaaaagctccagtctgagtctttgggcaagcagactaactgaaatgacctgttagcctttgttgtatccatctgacaagatcagcttgtagaatccagaatggaggtgggagatcagctggcagcctcatttccctcctcaaccacccctacgctgatgtgcccaactccactcacagctgggcagccaccgcttgcttgaaaataaatgaatctacaccactctcatacggatgctctcaagcatcccttgttgtgagaaaaacatttattgctgctactaaaatgcgtaaagttatctcacaaacacatacttacaagaatgaggaatgagaaacagaaccatccataaaactataagaaacggcctggccagggcagaccaggaattagtactctgtccttgccaggggtcaggcagggacctcagaagcagggtgttttgtcctagggggcaccagaccagaggtcaggagactgagggctactcctagctctaggacttttccttatctgaaggccgggtcggttagcagagaaaatctcacagtcccgtgccagacctccacgcagggactctgcagtgctgttagaaaaattagctcagcaccttcagcttgctttcagccatcacttagctttccacacagacattccaaatggggcctttcaaaactctgccctcaaatgaaggtagttcagagcaacactttagatgatatcacaagactcccaggacgcttcactgcttcctcagcatacgccagtgcccgttttacaggggggatttatgatccttctctcagtagagcgagccaaacttttataatattcattaaaaatcagcaccacgtgtaataatatggaatactgcctgtacacaagagggccaagttataggtgtttagggaaacgtggcagaattttctggccttggcaagaggtaaagttgcaggcaccagcacaacactaacacaaccttattttattgcaaatgtacattcagcctaaatcctaattaccttctgtaaaatcctaaccaccaccaagctttcttctgacagggcactcacacgacggcctttaagggcagcaacaacatcctaagagccgcagaaaggaaaggcaggggagagtggctggaaggcagtaggagctggggctgaagcccgggaggttggcttttaatgtcctcctgaaattgaccactctctttccaaaaacactggcttgggggcttaaaggttcgctcagtagggcaggcggagggcctcctgaaaaggattgagaagtcaacattcaaaaggctgcttttactcgcccggtccccacccaaaagggagtccggtcagctttgtgggggccagtggagcatcttttcttgcccttccgggaaaacgctagctaaccctgggatccccggtcccgacgtctgctctccttccccaggtgcagcacctagggctctggccccctccccacgtgccacaccagccctcaccactactctcaccctgctatgcccccaaccctcgtctttcgtggccgggaaggccaggccgagcggggcggtcagccgggccgggaggagggggctctccgggccgcgcggccgcacaaagcggggagatctgctgctgcggcggcatggaggcgcgccccctcccgcgagccagcggagcgcgcgcgcccgcccccgtcccccgccccccgccccagcccccggagcgccattcgcggagcggcttacgctagtcgccgggcgtaccgcgccccagcggccggggaggtgcgctgcccggctcccgtaaagttattgtgaatggggagcgggtgacgtcagcgccgaatgtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgaggtgagtcccgggccccgggccccgggccccgccgctgggcggggtggcggggcaagtttgcggggggagcgggcgcgcggggcgggcggggaggcgtggggaaacggcgcgggaagggagccccggccgccgggcgcgcagccgccctccccgcgccctgcccgcttttatggcattttctaggaacgggaagggggtgggagccgagccggcggccgcgccgcgccgaatgtgtgctctccctcccggctgtttacggcggccgaggcgcattgtattttgctggcgtcgaagggtgttttggaacagcagagggaggaggagcagagagtaataagtcaggcatggggagggcgggctgcaggaggcgcgcgtccgcgcgagccgcagcagctgtcagacccgcggccctgcccccggcccggcgaggcccgggtgtcccggcccccagcctgcgatcccagctccaggccgggcggcctcctccttaaccctcggcgtgcgcatcccgggctgctccgcgaggaccttggccgcggcgcctttgcgctcagctgtcagccgccgccgggtggcccggaccaccgcgaccggcggggaatcaaagcccaagtttagggtcgcaggaagaggcgagctgggggcctcgcggcgcagacctggatcgaatctctcctagcgaaagatcgggttgtcggaaagcgtcccgcgtagctaagacctaagggcgccaggcttctgagagggaaaccttgcacctcctctcccacagatcctccatgaagtcaaggtgcaacacacacacacacacacacacacacacaccctacactccagtctccaagccccagaagcttcacccaggagactggtttatgaaggggacactgccctccccgtccccgcgtcgaggcgctccgtggccccgctgtgcttcgctcacccggcgggtgttcgggagcccggcgccgctggagacggcggcgggcggcgctcacgggctaccctaggtgcccacgaggggagagactggagcgagcatctcggcgacctcggtctggccaagcatttgcaggaactcggaccgtgaggggaagcgtgcagggccgggagtgagtgtgtgaaggggtggcacactcctggcttctggggtcgcgggcgcatggggcatccccagcactctcccgcgcgtaggcgagtttggtaacttgagggaagttccggcgcggccgctgccggggtggtttgtctgtggcccgatgaggcgcgcctcgcagcctgctctcccggtcaccgccgtcgccgtgacctgtggcctccaggaaacgagagggaccggggcgccccacccgcgagacggacccgcagtctcccggcgggcccgcgggcggcgagacgcggcgttcctggttttcaccttcgctgtctagtgctgcagtctctcactctctgtaaatttcatctgttgagtgtatttaactaaaaagggtaattactttagataaaaatcctttcctgcctagtgggaaccttggcggagatgatgcctaatgagatattttgcttttgtctgtttagagtaaaattagagatgttaacgctgataacggttttctcagatcattaaaatgtaacatgtaggaaaggcacgtcttgctgcaaaggctcgggctgacatgaaagaagctgagcgtgaaaggctgcccctcctttggcggagagggctattttggtaaggcagcgggcgtcttgcttaaaatgtgagatcgccccaccctggttctcgggcacctcccgagtaaacggcgtttttcattcttgcaggtaataataaacgtgagtcaaaatgacatcttgttagaattagtctttagtctgtaagagagattgccaaattacagtgttgcgttcaaactgctccactgaaaggtctgtcagcatttccattataaattcagtttttctggagtttataatttcaccacaaaactttgagtggctgaaatgttttcccttctagtattctggtttttgaaagaaatttattgattgcccatttccaacgttttttttactctcgaaacctgaatatcattgaaatagagcgaagtcccagaaatggaacacacaaccatggaataaagtatttttgttagaacataactttattggtgcagagccgtattttcgttttgcattgcaggaggcttcaggtttgccatttggtaatcatgaatgtgttgagtaaattcttctgctgtctgtctattctgcaggtggactgaaatgtcagttggtagtgtgtttgccaggattacatggagacacacacttctcagttaagtgtgtgtctgaactcatagctaaattgtgaacactcctgttagttacttttttggttctttgtatgttgcatgtcaggatctgctatgaagaagaaggggtgaggtgaaagagagggaggggatcaggattcactttctgtattaccagtgcctgggagaaagccatttattattttcctattgaattatgccctttgacttagtatcttcaggcaattcttttccagtagctcacctctggctgctgtgtaaggggcttaattatttgcaaactgccttgaaatccctggatgaaaggcactgaataagtgcacagtattgttattcagatatggaatttaatgatccattatagttcatcaggaaaatgcactttgcagtgatggtaggaaatgtttccacctgatagagggtaataataactgcttaaaagtagattcagattacagatgagacaattaactctagccatgtgctcttcaatttgttgcaattcattttgtgatcaaagtgagtcacagagggccagatggtcaggttcatgttcagatctctcctaggccagcccttcacttctgggcccactgtctgcacagccgacaggacttagttattcattagcgcttgtgagctgtttctcagaattcctaatcgaggctcctgtgatgccaacaaaagggctcaagccaatctgtattgttgagagcagtttaattttacttggattaactttcagtgtctctggtgtggatccagtcttaacaaaaaggaaagagaccctagtggctctctatctctgctgtgcctggcccctctactctagtttttgaacctcagatttcaggggtgtgacatctagcttattgtaaatgcaggcttgattgttaatgaatgagagaatacttagataaataaatatcttcctgtgtgtccagggggtgagagccagtactagcttcatgggcataagacctgtgcagttacataggcccccttcctcttccctgctcagaaggacctcatatttggtataaggttctgctgttttcttcggaaattcttaataatttttgaacaaagggcccctcgttttcatttttcactgagccctgcaaattatgtacttacctggttctggtgaggagcagggcatagtgtggagtggcaggccgcccctactcaactcattgtagactcttgctagggaacagttggtaggactactggctttgtgttgccacatcatttgatttttccaggggaagctgaatattggatatttatgtggaatttcctgatttttaaatattggctcaaatctttaaaaaatttttggatgaaagcatatgtaagagctagtgtcggcctgggggctgcttgtctcccactactgaacagactgaaacatctttttttgtttaatatctttgtgtgtctctgttttctaaaggcctggcatatagtggatgatttgtgagtatgcacccaatgaatggttacaactacctggaaaatagaaagatgccaaaaaaacaaaacttcaaatcaacattgagtcccactcagggattgatcagcttcctttttaacagagaattcgacatgaaaggccgaataatttaataccatgagtacagtgtgattccttgcaggtgaataatccattacttttgaaccacctgccctctatttagttgttactgaccagatggggtaacttggctgggtaatgcctgaggacctccatgggagtttgacatttgagaacactcaccaaaataatagttttgatttactgaatccgcaccatgtgccagacccagtgctgactaccttgcctgaatgtacttcattgattcctcaaagcaaccctttgaagtaggtgtcgtgcctgcccattctgcagagttggaagaactaatctcatgttggaatgaacttaatctgaatatagtgcatgttttcttgaatgtctgaaggttatttccccattccattacacagtccagtcctgaatcaatgactgggcatggtgtaggactgtgacatacagagaacatggtccctgccctcacatagaacagagaacaatataaaatgtaacatatttgtcaaaatctgcaattcagatagcagacgctgtaaatctgcctccctgtttttctcctttccctgtctggatgttgaagaagtttcagcgacatatgaccctgtcagaggtactcacagttcagaagtcaatgctggttgcaaaaattggaatttctttggaaaagaagacaagcttttggcagagctggggccacatatgggaacgcagcaccaaggccttgggaatgacggaaaatcgcttctgtattgttaatagcaatatatgacctctgctgtcctcctatctttaaattttatgtaaatatttacaaactgttcatgtccaaactgaaacctgctatgaactaaacattttgtaaactcagtaagattgcccaaaatacaactcaactttcacctttttttttttgtttgtgatgacatttaatttaaaaaaaaaagacagtagttgcttttttttttctttttttttgtcagttcagggtcttttaattttttccctttacttttttttttgttaatttcaaatgtcagtctatctaaaactgaaacttaattttactatcagcatgctactcagcttccgtaaggctggaaatgtcctgcgaatcttaccactatgtcttttccaagggccatttcatttctaaagaatgtataaattgaacctcatcctgctagtgacactacttcaaaattcaggcaggaattttgccatttgtttttccttgagctattttttttccaaaataataaatcttcccaatccaaaagcatttcacatcatccttcattctagtcattggaactacagccaaaatgcctctcagtcttccccagtgacttcataatcaccgtttcttcagcatattccctggttgacttctcctttgttccttagcctcataatgaattgccctttggttctgagatgtgtcattttcctccctgacctttttgttcttttcctgaaggctgtaggacatgctgctgctgatgtgatgagagccggcgcttggttgctaggtccctcctgtccttgtgtcagctttcattggctcctttcctaagcatttaaatcctccactttccagtcctcccattcatctcattattctcttcatgtgtgcctgagcctgtagctggcatgtagacaaagtcccagttagttagaagaaagcttttcgagtttccaagtcttccatcactctagtcttgggccatcttctattctccctcccctgtcactttctgcagatacttcaggaatttcctcaagactttccaggagtctaacccaaagacagcttagaccttcacttcggattttaaagttgggagatcccaatgtgatgatttccattccacaagtaggaaacaaagtgaatgtacatgctcagcatctttccttagtatttcagtatccatagatttttggcaatttttctttttttcctatcctgtattcttctaagcaacagaagctcgtggatagtgcaaaatgggccaagtgtccagaaatactgttgcttagaggcagatgcctcattcattcattaaacaaatatatactgagtatctcttacatggcaggcatagtgttaagtgaccacagtgctaatggggagcaaacccagtcctggcccctggtctcatgaagcacgtcatctggtaggaagaatggcactgatcagttagtaacagataacccactgctcgtgaaggaaagtatttcatacaccagagtgtctaatgggcagatttaacctggtcgggaggttggggaagccctccctgaggaattgtggagtgaccttccatcagggacagtctgaaacttgagattcactttttctccagcttcctaatcctattaattcactactatctttggccctttggagtattgcctaagccatgctggaacctctggggccattttggcaaataatagttcctgtatacagagtccagaattgatttatttacctgggtctttagaacctgataaaaacagaagttaactgccaagagtactgttcatttccatacttggaaaaaatacaagttaacattcttattttgaacatatttaggttggttttgacaatatttgaatgatcagaagctacaaagatattctctcccagtcagctgatgtgtgtagggcctttggtgaaaaagtgagtctaaatagtctgtctgaagtccctggctactccagagcagagggtctccatcctctgtggcccgaagattattccaagcttgtccaacccatggccagcaggcctcttgcgtgttgaatgcggaccaacacaaaggttttttgtttttgtttttgtttgtttgttttttgttttttgctatttttcttgtttcagctcatcatgtatcattagtgttgagtgtattttatgtgtggcccaagacagttctccttcttccagtgtgtcccagggaagccaaaagattggacacgtcttatttagaccattcttagatgcaaaattaaggaattttgacagcatctatttaaaataaattgattatacttcatgctaacacccctctattttctttttctttgatgatagttaacttgtattgagagcttcctctgtgtgctgctcatattaactcacataatcctcagaacaacccagggctaggtgtgatcactagaagccgcagcataggtgtcgctcagctaatgaatggtagaactggagttggacactagctgtctgatgcttgggcctgttctcttaccatgttatggctctcccttttccttttcttcttcatttgaagttggaactctctttagcagttcccagaagtagaaataaaggtcatctcactctaaaatattggatgttttgttgacatctatcttaaagttaaaaaataatttctcagtaaatctgagtgagtatatctcctgtctttcacatggcctgctttctaataattgcattccttaggttttagtgtccatttagggatcggaaagtaaaagtgatgcatataaaggcaaaagaagtactaggcatataactgaaataccatggctctgtctccagggtttacttgtaactcacactcctaccctcttgttaggtggagggaatttgttttttgcgttttgttttttgttttttgtttttttggtgggtaggaaaaggtaaaaaactatacctgtaagaggtagagtattctaccaaggaggaagatgttcattcagaactaattccatcagaaatcctaattagaaatattagctaccagtaacagataaaaggaggtaacctttgttctcattctggtcaatttcaggaagagattatcttgccagattagcatgttgcaactctcagctggagatttgaatggttttaaaggactcaggcagttggtatggcagtaacccccaattacctcaggtttgcagggtcactgtttagaatgctgactcagctctgcctgggccagacaccgaagttgtcatctttagtcaagaagcatcattctcaggagccacttgaaacattaagcacacatttgaagctcaatttgggaaatgatcaagtgtatgaatgtatagtactgtgcttatttttcagcatttagttcaaattttggagaaagctaaatgggagatgcttagtgtgtcagtgttggaggttttaagtgatttaaaaaatcaagcagatgagtgcataaagatttctatgcaaacaatgttgagcttaaattaaagctgctgatttagtgtgagaattacttgcattgatttgtagaatatctatgtgggttcaagattccatattatgcaaatgaataagccctgaagagtcaaactgaaaaaaaaatgaaattaactgtgaaagatattattacccattcagcaagaggaaaatgtagacagagttaacccttccttttcatacattttcttgggaagataagtgccagggatgatggtccgtgtcccagatgtaaagaagctaggcacggtttgcagccagttcccccatcctccttctgtgctcacttttttgtttcatgctctcttaccttttggccacccagtcccctcaactagtccttgtccttcccttccaaaaccaatctcagagaaagattttatgaacacagttttactaatatataagtaactgagcatacttaatgtgttacttttctgaagcatcagcatgttaataggagacaaagccaaagaagtaaaaccctaaagataaaaacaatagaatttcgcacactggtaacctggtgataggagaccatttctgaatggagagagggctcgtgataaataaacacaaccctaggcagagaatataggcaaatggattacagtatttaaatcaaagtagtattaaaatacaaagagaagattatttttaataatacatttgtcagtgagcatttcccgccttttgccgtacattggagttgatcacataaacctctatagcaagatggtatgttatttaacatttaaacaaagcttccagggaaagccatttggtttgtggttagggatttttgttattcagtagcaatgaacctgaaattctatattatctttgcatgttgaattttagaagaaaaaaaaagcagcggatccaacttcacttacctccccaccccagttgcattgatacaaattgaattgataaatttatttcaaaattggtgtgtcccaatttgacataccacaagcatagtggtgtcagcatggtggtgacatctggacattaggagagttggttgattaattaaactatacttattttagatagagttgttggcaggtaaatacctggctgtagagtcaacgcccttcagtcccacctctcccccaccatacccttctccagcaaccatgctatgttgagttgatggctccatctagtgccagtctgtggaactgtcttgcaggacttcactgtcacctccagagctgggtatgatgaagagtcctctttctctgggaacacactgtctagcggggaactgccctctagttcctacctctcctttgtttttgcagtttagttatacctccgtgtctttctttgttccagacttaatttgtttccctctctctagtaccccctctttgtacttgtttctcctccttttttgttttccaagtctcaattttttttttggagaacaaaacagtacttaaaaccggtaagtataaagattttttttctaacaatactttatgccaaagtaagagaattctatgcattttaaatgaaactatcaattgaaaccatgttagagaaccagaatgaccctaaagttgaagtctgaaagtgtcacttggaagactgtgtcccttcatcctcctgtagttagacatttcctcaaacacagttaatcaagagtattttcttttaaatggttttggaactatcattgtagtatcattttctttttagattataaatttaacctctcatattttaagttcaagacattttcacggactatcaaggaatcctagctcattggcctggccctatttctgtgggaaaatgtattctcagttccagacaaccagtgttcctgcagatttttaggtcccgtataaaacgagagaacatagatgaatgagaggcattgtcagacaaagcctggcacatgagatctcaattagcatacaggttttaaatttcccacattaaacagtacattttaaatttccacttatgttaagcgtgttgatattgtgggtttgaaagtaagtcccctctgaaaaacaggaactgtgcttgtctgttaccagttcttgtggtcgatatggtaactattttgatttttcagaagggaggaaaagcagttaaatctagttaaaattaaaaccagttaaaattaactggctcgtgagatttcagtgcagctgttccacacatagcaacactaagagtgagttgtttattaccatgattaattattattagttgttacttctttttgagcagtggcatagattatttatatttttggtctaaccttggaaaatagaaactgcaagcgtagagaggttcccgtttgctaatttgcatgtaccctgtttttgtttttgccaggtaggtgtgtgcatctcaagtacacgagagtaatttagcatgtcagcactttcctaccagcagtgcttgctgactcatgcagctgttgtagcactcagctggccgcactgtaaactgcccatagtaccagcaccgcccttggagagctccgggctgctgggctggttagctactgggaggctattttcagatctgtggtcactgctgagctgggtcctcttctcctgccagcagccagacacagccttctggttgcaggggagaaaattggacaaatttctacctttgtagggactgcataaagattcatagcatttctggatatgcctcaggaaaactttttttttgcttcactttatttttctgggaatatttaaggggagaggcaaaaggggctgataataaatgaaaagggaatgtgctgttatttcctactaagatcagaaagagttttcataaacctttaacttagttaggctttcttggcgtaactgaaacctgacccacttctccctcagtgcaaagcagtgtgtcctgagtagggaagcaggggcgagggtgcaagtgactagcctgacattgttttatgtggctgaagtccctaagtgatgacagcttttgtttatatccgttccctgttattgaggttaaaaaacaaaacaaaaaacttgacctcaggtcattttaaagctagcatgtattttcagagatggtttcactgtttgttttcagagttcagttttgcttattttcatcggaaagtgtgaaatgttgcttttctgaggcttctaaataaacttccttttgtagatacaagttgatccaatcatcataaactgtcttgaaaaaggatgattaaagtaagatcagctggggaagggaaagctttgcacacccttgaggagtttgccttctttttcttaagtttcaataagcattctgaagcagctttgaccagtaataaagaaaagccacagtgactgtgtgtaacatgatgttgatggaagttcttggtttccgccgatacgaatgactcatcagtatcaatagaattgtgacttctaataataacacagtgcaagaccttcaaaacatgtggttttagcccttgctcttagtgaaaggttggaaaatgttagtttgagctttttttttttaatctcttgattttgcccaagtataaagttgttttttgtaggaatgatgatccccctgttgttttctcatcttactgtttttagtttcattatgattaaggagccaaactcagatcatttcatcgtttagaaatctctgcgctaagcatctcctgtcggggctgtgtttgagggaaatgtggctgaaaagcaaatcctccctgaatgcagaaaggaaaatactggtgcagactacaatccactgagctgcgtccctcctacacagcatctattgcggagggctgtggtattgctaagtagccccataaccctgtgagtcattgtcaaaggattccaagaggaaggttaacagaaaatgcgagtcagaggaaacagcagagtggagcagctagctcaggaagaactgtgctacctgctgaggggctgcccagatgtcaccaggaattcaggtgtacgttcatctttttgcagcccatttccgtatgtctacatatggggacatttttgttttttgtttagttttggttggttttgctgcagtttggccagactatcagagatcactatcttagcttcgtatcacagtggtcttatcccagagcctttgctttttgtattttatagtcaaagcaactgaatttctagactgtaagaccaacatgtatatttaacataattcttttcctttctaagtgctttatttatttatttatttatttatttattttgagatggagtcttgtcctgtcacccaagctggagtgcagtggtgcgatctcggcccactgcaccctccacctcccaggttcaagtgatcctcctggctcagcctcctgagtagctggactacaggcacatgccaccatgcccagctaatttttgtaatcttagtagagatggggtttcaccatgtttgccaggctggtctcgaactcctgacctcaagtgatctgcctgcctcagcctccctaagtgctgggattataggtgtaagccgccgtgcctggccagacctaaaaaattcttataaaatagttcaaaagttaaaaatgcatgaggaggccgggtgtggtggctcacgcctgtaatcccagcactttgggaggtcgaggcgggtggatcacgaggtcaggagatcgggaccatcctggctaaaacgatgaaaccctgtctctagtaaaaatacaaaaaattagccgggcatggtggcaggcacctgtagtcccagctgctcgggaggctgaggcaggagaatggtgtgaacccaggaaacagagcttgcagtgagccaagatcgcaccacagcactccagcctgggcaacagagcgaaactccatctcaaaaaagaaaaaaaaaaaagcatgaggggtctttcacttattgttggaaaaaaaagtgagtaggacttctgttcactgagtggtaactatggagaatgagaaaacaagcccaaagtggtaaagacgtttgtggcacataaataatactggttcagcacacatgtgaatcaataaaaaagccagataaccaaaaagaaaaatgatactgtacattcatattcttaaacatgcatttcacaaaggaagaaacccaattggctagtaaatatataaaaagatgctcagcttcattaataaacaaacacatgcagattaaaatcatagtaacatatgattacacactctctggattggcagaaattttaaaacctgacaataccatgtaaggatgtgaatgaatgggagtttttgtatttagttgacaggagtctaacttggtacaattatatcggaaaacaatttgctgttacctaaccaagttcaacctgcaaataacttacaacacagccatcttacccctaggtatacacctaagaaaaatgattacctatgtgctttaagaaacatgaacaaaacaaaaaataattgatgctggcaaggttatggagaaaaaggaacacttacacactctcggtgggagtgtaaatcagttcagccattgtggaagactgtgatgattgctcaaagtcctaaagatagaaataccattcaacccagcagtttcattactgtgcatatacccaaaggaatataaattattctaagacacatacacgtgtatgttcgttgcggcactattcacaataagcaaagacatgtaatcaacctaaatgcccatcagtgatagactggataaagaaaatgtggtacatacaccatggaatactatgcagccataaaaaagaatgagatcatgtcctttgcagggacatagatggagctgggggccattatccttaagcggactaacacaggaacagaaaaccaaactgcacattctcacttataagtgggagctaaatgatgaaaacgcatggacatatagaggggaacaacggacactgagacctattagagggtgggaagagggagagaatcagggaaaataactaatggataccaggcctaatacctgagtgatgaaataatctgtatagcatacctccatgacacaagtttacctgtgtaacaaaccagtacatgtgcatacccctgaacttaaaagaaaaaacatggacaaacatattcaaagaagcattgttcataagagcaaaaaactggaagcaacccaaataaatgcccatcaacattgaatcgaatcagcacattttgctgtgaggtatttatacactgtgatactatttggcaatgaaaaatcaactagtataaccacatatagaagggtgtggagaggcagcatttcttggtggtcaagaggaaggattgtgcctgggttcagattttggttctgccacttattgtgtgaccttggatgaatttctgaacttcagtgtaccttagttttctcatctgtacatcagggaaaatgatgtctacctgatagtgttgttaggaagtttaaatgagtcaatgtttgtgacatgcttaggagaatgactggcagacaatacattctatatgtgtttgttaaacaaataaaagtgcatcaaaatggatgaatcttacaaacaatatggaaagaaagaagcaagatagaagaatatatacagtgtgattctattcatgtaaagttcaaaagcatgcaaaactaaatatgttatttagggatacatacatagatggtaaaactataaagaaaattaatatgatttaatatgattgtcacaaaaagcagtataacagctacctccagaggtgaaggagtgggtatgatagagaaggggctcactgggggcttctgaggtcctggcagtgttttatctcccaacctggacagtggtcccaaggatattctttcttcttaattgtttttaaaaactgtctatgttttttatatatgtgtgacctattagtaaacattttaaaggatttatgtgagttgttatagtagcaagatgacattaaatagaaataactgtaaattgctacattttagttaaaaataattgttcaagtgcacatgggaacacttgcttggtattatttcctccacaacattgtgagccaccagtgcagtgtgattcttacagaaggcgacacctccttaaggccacattaagagagctgtcccctttagatcagggaatgtaatgttctcactcaactactctcaggtctggatgtcccatgtgtgggatgctatgtcttgtcccaagggatttattttaagaaagattttcaccacagagggagcattttctgtgataaagatgtttaggggtctggaaacctatcagttctaagagtggccaaaggaagtggggattttcaacatggagaagaggagatgttgggagagaaagagtgtcttccatcactagaagtggaagcagcctttccttgttgcttccctctctgtaatatacaagtccctccctgtaatgtctacccttggaggcaggtttcaagtcctggatactggagatgcccaagcagaggctgtgggacctcccttagacttgactggggccacaatacccactgcctggtccctggaccagcagcatcggcatcacctggagcttgttagaaatgaagtctcagggccacccacacctactgagtctgaatctgcactttctcaaggtgcccctggggtctcacataaacatcaaaatttgagaggcactgggctaaatgtctctaagatccctcatggttcttaagatttaatgattttatagaataaactgtatgttcaactgaaaattatcagttcatatggtgacattatcaatttaaaacaccttgggatgttacatgtccacagaaccatgtaagtatttgttgctaaattagttttaaatggatttgtccagtttcccccgatgtcaaagttaggttgcttatgtatttgggcacctataagaattaaaatattacataacgttgtattttcttctttctaacatacaggattagattcttgctttaaaattctccattaatgtcttcaaatttttcttttatattcattgaaaattcaaaagcagattagggttctgaatacctgttaagaatactcaaaagggatatttaaataaatatatctcattaatacattgattttatatttagcatattttttcttcttatacatagtccatattttgaccttatgggaacctttgaagtctgagtattttataatgattctccacaatacctctttatcttttagattctagatctgagatcaggcaagtaaaatagttttacctttttcccctcaaaaggccatgactaacaagctcatttactttttccttaaatattttgctaattatccttttaactgatgaagttcaagtggaatccatgattcatttaatcttttcccctttatgtaattagtcacttgttcttttgatgttcctagcaaaactaatatttaaagggctagtcataaaattccaaaataaaaagttcttaaatgacttaaaataagagataaaatatgctttactgtatagtaaaaatggagaaaacgtctcatgaatagatgttctttaaggctgtgagttatttgatttaagcgtgtgttaccaggtctgtgttcttttggtatataggaccaagaaactactttatggcttaatgtttgctgtacgtatgtcatctagatgagataatgtatgacagagggctttataaaatgataaagtagtgtagactttttttttttttttttgagacggagtctcgctctgtcgcccaggctggagtgcagtggcatgatctcggctcactgcaacctccacctcctgggttcaagcgactctcctgcctcagcctcttgagtggctgcgattacaggcatgtgctgccgtgcccagctaatttttgtatttttagtagagacggggtttccctatgttggccaggctggtctgaaactcctgatctcaggtgatccgcccacctcagcctcccaaagtgctgggattacaggcatgagccaccgtgcctggccgtattcttttttttttaagagcaagatttaggaagattactgcatattcctatagcgtttgttcgattttagattttttcagaatggtttgaaatcacatattctagcttgaactctaaacctggtctgtccagtatggtagccatcagccacatgtggcatttgagcatatgaaatgtggttgagatgtgctgtgcaatatacaccagctttcaaacaaaaaggatatatatctccttgataatttttattatgttgattacatgttgaaatgataatgttttacatatataggattaactagtaaatattaagatacatttggcctgttcctttttactttttaatgtggctactagaaatttaaaattatatgtggttcaccttatactttgatttcaaagtgctgatttagtctctaaagtctagagtgattgagagctctcagagaaaagaagatcagagcttaacagagagttttagagatgaggtgccaccgacagaatccacttacttgaagaaatcccagtctgcacctttgccctacttttacagattactgctttcttgaacccacaaagtagagcactgggtagcaagcatttaatatctacaatgtacagagcattgaagggggattaaaataagtatcacacaggtccctgcctttagggaaaacatatagtctactggggaagcaagatatgagcacatgagttgttaaatcatggcttgagagatacatagctgttcaatgctcaggtccaagactgttgcaaacagacggttgaggcactaaaaaaagtgcttcaaaggaaggaaaggtctccacggcctggaaaggtctccatggcctggaagggtgtcccaccagaggaatgccttggctgggcactgacgagtgggtagaatttcagtgggcagagagaaagggggcatggccaggtaggaggcagggtagagtgggaagaaggaggaaaacatggaaaagcacagaatggttgagaagtcagtgagaagaagagatggattgaactgtgagctgtgagtagaatcattctctagtccacttattattgaagctttaatatttgacatcgtctcctataatattatgtatcttgacactcttccgaaaattatttaccaagtgtctcaaagtagaggttagggcaggacactttaactttgggtagaataaatgttgcatatctttgattgttaggaagttctttaaatggcaaaactgataatattatcttgccagttatgtttatactaacattttgtgtagaaccatgtaactttaaaggcttctcggataagtacattattagtatttcaggcagtagtgctcagcatttgtatattcttcttgcttaaaatgccttcagtgttatgtcatttgatctttgctgttggctccattttatagaactggaagccagagaagctaagattgaataattaatggtagagtctggaatttgaacctagctcttaagcttcttccattttactgtgtgaaacacactagttttcattcctgtaagtctgtttcttaagagaagctgattaattttatttctttttaattgaatgataatataaatagggaaaagtatgcatataacatatattcatcttactgacgaatttccataaagtgaacacgctgttgtaaccagttcccagattaagacacagcattatcagcgccctagaaatccctcaggcttccttccagtaactacttcacccgtggtagccactactctgacttgggaaagcatagatttgctttgcctgtttttgaactttatatcaatggagatacagaatgtactattttgtgtctaacttctttcactcgataatatgcacagttaactcatattgtgcatgacaccatattgactatggtagttgatttttcattctccatgctatatagtattatattgtgtgactataccactatttattaatttgtatagtttccagtttggggccattatgagtagcaatgtgaagattctagaacatatcttcaggtgaacaacataattatttgtgttgggcatatttaggagttaaatcaggaaagcagtgtaatttttaaatgtcttgtagatgaggctgaaatttgactttgtgacactcttcaagaaaagaagtgaaaacctcaaactgttggtgtcttgaatagtatatcaaaataaatactaaggcagccattatgaaaaggtccaaggtagaggaattttaatgcccgaacacattttttcaagggaggatgaaaatagtcaattctcatatagagagaatttgaaagggttaggatgttaaaatactgacgttatatcactcaggtttctcttacagttatattttttttcttcaagagaacttttagcaggtgatagtggaaaactaaggtgtgattggtaccaaaatgaccattgtcccagggtataataagggatgaataactggggagtgtatttactaggaaataagaaaatggggttgggttaaatggcaggaaggtacattccaaaatctataatgcaagctatggttctcaaaattttactgaaatttcctctctctctcactcttttgcttagcgtaatctgtaggcaaaagaatttgcattcttttaaagaaggcaattataaataccataacttgtttttagaaaaaatcttagacgtttatccagaggcaacctgtctgaatgaaaatgtagttctaggatttgccaacacaaaagacttcagtgtctacctttaatgcttattaacattaatggtgatcatttaaaggtgtgtgttttatgtttagacttataggtgttgttgatcttaagcagactaggcagagaaatccttcacattttctgtgctctcattcaggatggccctaggcatgttacatgggaaatgagaatatgtgaataaatactctcatactttcttgggcctcaatgaaaagaacatttgttaccatttttagtcataaattaaaattatttcagagtaggaaatataacattaatttagaacatggctgtcatagatgaaacgttttacacatgtattgctgtggtagacattccttgcatttattgaaagcctctcctttataaagttagtgaagtgtgactactctgacctccaaatactgggtgtatttgaactatgaaagtaggtttaaaagttacacttttctttaatgcccattgatgatttctttctttttttttttttaagacgaaatctagccctgtcacccaggctggagtgcagtggtgtgatctcggctcactgcagcctctgcctcctgggttcaaactgttctcctgcctcagcctcccaagtagctgggactaaaggtgcacaccaccatgcctggctaatttttttgtagagactgggtttcaccatattggccaggctggtctcgaacttctgacctcagatgttcaggccgccttggcctcccaaagtgctgggattacaggcgtgagccgctacgcccatccagaacaacaggcactggggcctactggagagtggagagtgggaggagggggaagagcagaaaaaaaaaaacctatcaggtactaggcttagtacctggatgacaaaataatctgtacgacaaacccccatgacgcaagttacccatatcacaaatctgcacatgtaaccctgaaggtaaaagttaagtaaataataaaatattttacatttatttaaaaattctaaaatggttgtattttaaaagtaaaaacaaattttggttaggatttgagcttattccatttttcttctaattttccaaattaaatgtaaaatgagagcatcccaggtagggggaggtaggggagaaaccaaataattttcaagtcatatttgaagagcaggtatgttctctcacgatttacagtgcaggtgcattttaatttaactgctttaaatgatgataaaaattgttcaagtagaacaaagcaaagttttagaagtgacttgtaaacagccattcttaattttttcctgttttctctccacttatgtgacttgcatgaatttctgaagcagtcctttcaaatgacactgctccaaacatgtgaattgcattcatcaacaaaatccagccttttcctttgtaggacaatgtggggtcacggggcaaggggtcttttctttgtctagcctggtgccaaagcaaagactagtcctccctgcgtttggacccagtgacatgtttccatttgtcattgaacactagggggaggaactgtagcctctgaggtacccccatttggtcctcaccctctaccagaggatttgctgcttcagcctcttcagtgccccaggtatttgatgcaaagattatgcacttatgctgccagttatcagggttgtgtgggtgtctttagaggggtctccccttagcatcaggtctcaatgacagaatctaaataacacaggttactcatcacgagttaaagattttttcccttttcacattgatgcttctgatatacttttatacgttagctgattgtatgtgcgtactttgtggctgcaaagatgcagctggaaagtgtgtgggggttgtctgcttcctctgaggctgctacaggtggtcaggtgggggcggctgtgataaaggtacagcacccacttccgccagcttgtcttgtgcgccctgtaacccactgcatgaacccgagtggcacttcaaccggattttcttgttggcacttttatctttcactgcttctgacttgcctgttgaggtttatgactaaggttgtgattaaaaattccctttttaggtatgaaaagtcttttcaattactttgtgttcctttttttgttttgttttgtttttgttgtgtgtggactttctgggttttgtaaaaatgaatcttaaaaaaatcttaatattatgtaagagttagataaaggttaagtagctaatatattctctcatcagggcatagaatcaacgtatgttcttggaagattaagtgtgtcaaaatgcattttatgatggaagcactgtcagttgtttagaataggcatggaaaagcccttttcagaatattgtcataaaatcagacttggaaaggttttcgtttattcagtctgtattcccctatctgtctgtttaatctctgcatattactgtccttggagcacggagaaacgtgagctacccttggaggtttatagtcccactggaagggaactaatgtttacgcctgattatatgataggagctttacatgttcttattcagtctttgaggaaaccttataaataagataataactttttcagagaaagaagctggggttctgagacattacccacttaggggcacccagaggaaagagcaagacctccagctccatcaccagtaatttccagcctgtgagcttccctccacactcagtaatttaaaaaacaacttgatttagggacatctagtaaatattctagaagttcagaggcagaaaagctagtttgcagctgaagtactcagatttcccactggctgagtgggaaatcagacccgagccttgacagtgggcagaatttgtatagaggagccaagagaagaagagtttccacactgtataagccaaatgatggaaggtgtaataacaaaggaagggtgagcacacaggtttaggagatgctgtgtgggccagtccagctgggagccattaccatttaacacttaatggagtgcttactgtgctaggcactcttctaagttcttcacaccttttaactattcttatcttcacagcaagcctttgcaggagatattatcaagtccctcctgcccccactttttttagaaacagagtcttgctctgttgcccaggctggagtgcagtggtatgatcgtagctcatggtggcctcgaactcctgggctcgagtgatccttttgccttagcctcctgagtagccaggactacaggtgtgtgccaccatgcctggctaattttttttccccatagaaacaggaactcgttatgttatccaggctggttttgaacacctggcctcaagcgatcctccgccttagcctcccaaagtgctggggttacaggtgtgagccactgcacctggccttcattgagggatgaggagactgaggcacatagcagttaagttgtggaactgtgattcaaagcatggccaccaggatccagagcctgagttcttagctactctgctgtcttgttttctctctactgggcaatgcaggttgcttgttagaggggtgatgaggattctcaaattgctggggatagcgagaggaagatgaaaatggcaggggtagtgatagaaagatcaaaatggcagcagcacgctggccaattttacaagaggaaacattaggaaagaagagaagagggagtttttctcagctaagcaggatctggtcagtgtaagtgggtagcaaaagatagaggtgagatgtaacaaatcaagaggccttgatgaatgactggaattgaagaagagggaatgagcaaaaatgaatctaagatttggagcttggttggctgggaggataattctgctattgcagaaatcaatgaggtcaatagacaagctcatttttccacagcagtagtgttgcagcaagaaatgaaggcttttgaagagcatatgcagtagagataccatatgcaggaaaaatggctcactggagagttgagaataaaggagaggagttcaagggagggaatggggatgattggggggctatctgcaaggagagaattgatgtgctgggaacagacgatttctgagggagagagaaaaacccagggccttaaaaagtgtccttggtcaagaagcagaaggagaaagaggagcaggaaaccataaaagaaacaggcgaagcaggagagagaggagaataaaaagaggaaaaaaaaaactactgaacagtgtcagacactacaaagaagtcaaggagaacaagagtgaaagggggacataagatttgacacggaagaaggccatttgtaccctgcacagtaagtcttggtgacatgaggaggtgaaatccagttgcattaaagtctgtggtattgctgagttcttcctcatgggcaagtccctggaccttttctaagcactaaatttgcaggtagttcaatgtcaagcagagaaggaagttggttaacagcacttggttgcatgatactacgttttgttatagtgacctaactgatctaacgtgttttgtctttcagcgcgttcgttcacatagctcccagttttaacatttcgccacctactgaagacatcatttgggaccaagctgatgagcccttgaagcacagcaggtgaggcaaggacctcagcttggtctttgtttcataagtttacacagctagcttacattcccaccagcagtgtgaaagtgttccctttttaccagatccacgccagcatctattattttttgtttttcagttatgtccgttcttacaggagtaagatggtatctcgtgcacttttaatttgcatttccctaatagagatgttgagcattttttcttatgtttgttggctatttggatgtcttcttttgagaattgtctgttcatgtcctttgcccagtttttgataggttctttttaaattagtttattagcttttaatataaacatgagaaaaaccacataaattgtagcattcttttcaaaataaaactgcaatcaatacttgaatgaatctccaagctctgaacttcataaacaatgttttttcttttctttttttttcttttcctttcttttttcttttttcttttttttttttttttaaatggggttgtttttatcttgctgatttgagttccttgtagattctggatattagtcctttgtcaggtgcatagtttgcaaagattttctcccactctgtgggttgtctttttactctgttgattttttagtttaattaggtcccaactatttatttttgtttttgttgcatttgcttttgggttcttaggcatgaactttttgcctaagccaatgtctagaagagtttttccagtgttctagagtttttatggtttcaggtcttagatttaagtctttgattcatcttgagttgatttttgtataaagtgagagatgaggatccagttcattcttctacatgtggcttgccaattattccagcaccatttattgaatagggtattctttcctcactttatgtttttgtttgctttgtcaaagatcagttggctgtaagtatttggctttatttccggattctctgttctgttccattggtctatgtgcctgtttttataccagcaccatgctgttttggcaactatagccttgtagtatagttggaaattgggcaatgtgatgcctccagatttcttctttttgcttttgttctattggctatgtgtacctttttttggttccttgtgaattttaggattgttttttctagttctatgaagaatgatgatagtattttgatgggaattgcattgaatctgtagattgcttttgtcagtatggtcattttcataatattgattctactcatccatgagcatgaaatatgtttccatttgtttgtgccatcgattatttctttcagcagtgttttgtagttttccctgtagagattttcacctccttggttaggtgtattcctaagtattttatttgtttatttagcagctgttgtaaaagggatttaattcttgatttgattctcagcatggtcacggttggtgtatagcagtgctactgatttgtgttcattgattttgcctcctgagaccttactgatctaggagctttttggatgagtctttagagtttcttaggtagtacaaccactctggaaaacagtgtggagattccttaaagaactaaaagtagaactaccattccatctagcaatcccactattatctacccaaaggaaaagaagtcattatatgaaaaagacacttgcacatgcatgtttgtagcagcacaattcgcaatttcaaaaatatggaaccagcttaaatacccatcaaccaatgagtggataaagaaaatgtggtatatatacatcatgaaatactactcagccataaaaaggaacaaaataatggcattcacagcaatctggatggaattggagaccattatcctaagtgaagtaactcaggaatggaaaaccaaatatagtgtatcataagaatgatataatggactctggagactcagagtgaagttccactagggaacttatccatgtaaccagaaaccatatgttcccccaaaactattgaaataaaataaaaattaaattaaaattttaaaagttcacacagctgcccagcgtgtgtcccactcaccggggccatcagcttattctgtgtatttctaagcatcttatgaacacactgattgttataaggaatccaaacaatatagcactgccacacttggggctgctatttgttttagggctcttttattatggaaagtccaaccgatatgaaaataacctaaattttctctgacttctcagaaattctcaaaacatcaaaatgtgccctgtcttttgatgctggttaccccttggtgggaatccaggatttccttatttcagtgtcacagctgtgagttgtaaagcatttcattcaccacaatgctagttacagttgattttatttaagctgccagatttggaaatgcacctcactatagcattagtttaaaaaatttaggaaggggagaagaaatttgtatgtacaaatgatattttttacttttggactgtaagtatgttttttggttctttattcttcccaccagtttttctgggtaactgtaacttggtgtatcaacttttagaaaactcagaagacttaggagtatgtaagctctctcccttcccttcccacccctcacccccagcatagaatattggtaggtgaaactttattaaatagaatctgcacggagtagtcagaccttagccccacctaaccctgccacttgtctctgttactgttttctgttgctattagcatcttcattcagaaggacgagaggggagaaaaaaatgaaaatgaagttaattttgttcagcaaaagttaaagtgtctggctgaactctgggtagctggttttggagttgtatggggtttcatttattctccaggtctcttagtcttcacttgaaaatagaaactagagttcatttttcctgacaagaatgaacttaattatttacctagaatggttagtaatctgttcttattaccagaaagctttcttctgatctatttagtatcttttttcataagagtttgaatatattagcatgtattctcaatagaatctaatctttcattattaaagttcctaaatatcttatattactatgttttatcattatgaacattgactctcattgtttagagttttgcttctctaattatcttgggtgaaggaccagttttgtttttaatttccagtatgtcatggattgataattttataaaatacaataaaaatgatttactagaaaaatgaaatactagaaaaatgaaatttaaagaaactaaaaacataagcctgattaaacatttattattcttatagtcaacagacataaaattactctggcaagctgctgtaaaaaaattctaaaggtctactctcagtttctgtgcttattctgggactagggctggtctgcagagtccagttcgagttgcactgttggacagaatatatacaacttaggagactgaagttcagtagatactaatttcagaacatatcctcaaagtgggtttttggggactgtccccttcacatttcttgcatgtataaaaggcaagtgcagttcgggtacagtggttcatggctgtaatcccagcactttgggaggccaaggcaggcagatcacttgagatcaggggtttgaggcaaatttggccaacatggtgaaacctcgtctctaaaaatacaaaaattagctgggcatggtggtgtgcacctgtaatcccagctactcaggaggctgaggcatgagaattgcctgaacccaggaggcagaggttgcagtaagccaagatcatggcactgcactctagcctgggcgacagagcaagaccctgtcttgaaaaaaaaaaaaaaacaaaaaaggcaagtgcagaaaaaaatgctgtttacttaaactttttctattttaaaaaaaattgtaggacaatgcataaaataatatttaggtgaatatagaaaaagttgattgtctttctcccactcctctggttcttttcctttctctatacatcatatacatacatacaaacatatacctttacatggagaagggacattttttctgctatgaaaatggcatcataaacaatactctgcaactttctttaatattttgttacaacatttatccttatcaaatatgaatctagtggctctttttaacagttgcataatatcctatggtatcgttgtaccatagtttattcaattattccccagctgatataccttcaagagcattctaggtttttaccattcctaacaacactgcagttaaattcttgtacatatattcatgtgtatctactttgatatttgaaggatagattcctaaaaacggagtcagtgactcatgcatgatgtcagatgatactccaaaaaagttgcattgctgtagagtcacacctgcaaaatatgagagtacctgtttgcctcacccctgccaggtgttaggagtctttttaagtgttctctctctgcggtgtaaagtgatcactagctgttttaatttgagttcccctgattgccagcaagagtgtgcttcttttcatatgtttaagggcctgctggatctttctattcaatttgggggcaacaaaacttgacagattttattttattaggtcttttgtgtaccaagttttctgtctgtggtacactcagtggttggggtttatattatttgttcgttttagtagggtagaggacatgggaaaagaacaaagatacagtgttgagggttttttggtgggggggagatgtcttagttctgattttctttgtctaacatgttttttttcttcaagatcagcttacaggaaatccgtccctatttgtgtgtaatgtaaaaagggcacagggtggggcatctttatagcttggcatagtgtatatcgttattcaagattgctcaaagactatgcgttgccatgtgtacttttaaaaaattgaggtaagttcatatagaattaaccctcctcaagtgtacaattcagtggcatatagtacatttacagtgccgtgcgactgggacctctatccagttctgaaacattttcctcaccccaaaggaaactccgtccccattaagcagtcactcctcattccccttatccctcaacccctggaaaccacttctctgcttcctgcgtctatggtttcaccttttctggatatttcatataaattgagtcatgcagtatgtgattttttatgtctggcttttttcatttagcataacatttttgaggttcatttgtattgttgtgtgtatcagtacttcattccttattgtggctggataaaattttattgtatgctacaatatacaataatttgtttatccatttaccagttgatattagggttgtttccaccttttggctgctgtgaacaattgcccatgtgcacctagatgccaagttaagtcatagagaggcatgagggaagaagaaagacagctgaaaagaacctcccagggagcatcttctgtcttctagagccttcctctctctgtagttggtcatctacaggctctttaggaggctgggtcagtcgtggggccagatttgggatctgttttcactggcttcagtatcttcgttaaaccagagatagaccctccatatcacaccctctggatttaaaaaggaatttacatcccaccctcagggcactaggtctgctctagcctccatgggtgcagtggccgcaaggaacattcatggctattcctccatggttgttgcctctacctttagcatctgggttggagcttgtagaatgtggtgatcaggaggaattgtgcccacatagtacctgggcatatgacagtataggctcatttcccatctctgcagccttagtccagttatgtatctctcagttttctccctggtaaaatggcattactaatacttacatcatagggttgtagagatagttacatgggataatgtatagagagcactgttacagtaccatgtggtagtacttgataaatgttcatttcttctgttctcagtgcttctctgtcctcttctatctggtgcccaggacattacatacttcacaaggtagtattaagtttaaaatgagttgataatgcagaggaagtctcttagcaccatgcctgcaacgtaagtcaacactcactatagatagaaaggtaccttaccttgcagttaggatttctcattgggaaaatgccatccaattgattacaagccgtctaaagtgttttaagtggtaaagatttcacctgggtatattgagttgttctgcagcgtggtgtttattaccatagacacatcgggctaattaagacagccatgttcaggatagatgcactatcactaagatcctgatgtgtgagttgggcatttcccatcatgttagcacaaatatattaaagaaagttacttttatatcaaagtgtttgcatcccaaagaaaatacttgtacagcctaaagttctctttcttgtggaagctgacaagagacttctgtcttgccctccaaagtggtttagtatcctattttgagcactctttgggtgctgttatttagaaattctattttagagcaaatgggaaggattttataaaaaagggagaagcaactgtcctccaccatgctctctctcagctgtgtaacaagcctctctgagggtgaagtggatccccataatgtgggccccatgtgtgaaccttttacaaggttttcttgttgtaatggctgatataattaaaggagagagttcatgttttgtctgaaatggagcatgccttgagttacaatgttttgtttttctcaccaaatatatcctgactataatagcaaacagcttgtataagatttttacataaacatttgaaaaagcattcttgtcttcactgaaattttgaaagccttttaagaatatttgtagcacttatgtttttaaatgtacaggtctaacatgcagttgtttatttggtaaattcattccatgagggtgctttgaatctacctccaacctctcacgggtctcccagacttcccaggaaccactgcttgacagctggagagacagcaggtgaaccagggtctcactgggagggaaagacgaggaaaccccaaagggacagctttctggagaaaaatgcctggctgtgaatgcctcttcacctccatcccagatacacacttccaggatgtgcaaattgagtcaacatcatgtctgtagaggacaacaacatgtcttttgttagtcttgacatttctttagccctaggcctctcaagttttggatatgtgatgctcaagaaatgcatttacaatttgaaaacctggtgctcattaagtaattcttttaaaatttttttcttttccttttgaaaaattcaaacctagagaggagatgaaagaatcatatgaagaacatttatataccctttgtttatatttgccaattattaatatttgttattttgtctctgaatttatagttttgtatgtgtgttggcaagaggggttcattttttagaactatttaaaagtaagttgcagacttactttcatgacatttttccctgaagacctcagcatcatttctgaagaataagaacattttcctacgtaaccacaatcctgttataaagtaagtcttaattgaaaacttcagacagaggacaaaagagtaaaaaaggcagagattgaacaaagctgtaattgaacttggaaagtataaggagaagaaatatagggaggtaattagaactcctgtttggttccttaaaggataaattttgtatataccagcaaatcactcaatgaatgcagattttcttcaaatatttactttatctagtccaaggagtttctcctggtgctctgaagtcagtgttttggccagggttataagcttttcagcctgtaaatacatttcttcagcatcatcaatctaaaacctgagtgaccacatcctacttagacttgtggttaggagcaaattttcaagggattttgctggtgccattaccttgagaacatgggaccttcagttattacagtcagaaatgtttactaatgggcagttagtgtaaacatgggagtcctttcctgacatttaatttaggtttgagtaaaagctgatgtgttagcacactattttgagaaataattttacaggcttggcaaaatgttaagcttgatgtcatcacagacttttgcagatttaggcttcaggagtcagcgcaagaaaaaatgctactcttataaaggctgaacagcaggaacaaagttaagtggatggcatgtagatgcatcactaatttgtctattttaaaacaaagatatacattttcttgataccaatagcttatagaacattaaacaaattaaaaggtttatttggactgtttccctgaaagcctccttcttcggtaggatttaatattttgccagaagaattatgtttggggatttatttttcaaattttttaaaaaagctattttcactaagctttgggaggggaaccatattaagctgtctgtctaactaagcacatcaggcatcatcatgtcaagaatgagaaactatgtgtttcctttaacagcagtgtatgtcatagagatgtttgacccatgatttttcatgaaaaggtccattttcagtaaactcttgtgcttacctagtgtcttcaatgtgataactggcttcccactgatcaggggtgagatgcatcacagagagtttgaaactacacattttgtcttttatttcctttttctttttactctttcagccttcagtggccatggagattttttattttaaattccaattttacatatcaaatttacaaactgtgacttttaaaataattgttgtactcttttctgtgagtgaattttaaaaagcatttaatgtaaaatgcatgtgtagtttcttgtgtatcaaagccatgcttttccttagatcagcttaatcgtctcctgtttccaatttgtgttagaaagttctgtgtgaaatgtgaactctagtttatatacttactaacagttaatgcgtgtcccttgggataatagctcttgagctatctttgtggctgtcttacgtagaccatttgaatctttctcctttaatgccaagtatccacttttcacgtgtaaattggagatgtcactacctgcacttggacaccagtgtgtgcatgtaatgttgattggtgtcatcatggtttttggctactctgtgataattttgtttttcagaggcaaattttgtgaggccaaacttcggagattgggtctgtacatcattcattctttcagtcagtaaacatccatttagtgcctactctgtgtcagtgctagtcaaaaaggaacagggcaggattgctgtcctggaatcatgtgcacgcatggtacccatgaatgggtactaacaacacaacagccacttgaatggcctgggaatggggcgtggggatgggaaggggctccacagataggtgaattggtctgtaaaagtcatcgctgtacaaatgaatcccaaaccaaacattgaaagaatgcacagtagattcccccagttagggcagggtcatagagcattttgggcaaagagcccatacaaggccatagaagcatgaaacatatgccacattgtatgaatttcaaataacttcatataatgagagtttgggaacatggagaaggtagtggaggaagatcagactaaaactgattatgaaggaccttacgtaccatgccaaggaggctggccttcatcctgtagtcagtggggaacaacttcaggaatctcaatgcagaggtttcatgatgaaatttgtgctttagaaatattctcttgcagcactgtggaggtacagataagtaggaatggaatccaaggcgagagggtcactctgctcctacagaagttcatggggcagtggcagtggggagataaggagatgatggtgctgagagccagttaagaaatagaatcctcagaacttggtaactgattggttatgagtattgagactacatgggtgactacatgagtgatctcatcagtatataagtatataagtgctcaattagatcgtgagatcaaggggcgatattaatgtaggaaacagagaacagagagaaccaatgatataagccctaggaagtggacttttaaggaggaagcaaataaaaagaagctttagaaggaatgatctgagggtatgaggaaaacctgaggatagggtgctccacgaacccaaagcaggaatctgcagaaggagggagtagtcaagaatgttgaatacttcagaggggtcaagcaagggttccaggatgtgtcaactggtaggttcagtaatcctagcaagagcaattagtgggtggtgaaaaataagaaatgagatggttcatttatactactctttcaaggagcttagatactaagggaaggagagcaagagttgtcaaggaacatttttttaatattctttttcaaggttaaaatctcaagcaagtttacatcctggaggatagatataatccattagacaggaagaagaaggagataactgatggaataatgtctctaagcagatctgatggcacgtaagctagaacacatggcaagattagctttgggctagacaaaggacaactcagtttttaatagatgggaacaaaggaggaaagactgggtgtggatatggataagggattgtaggtcttgaaagttggaagtttgaggggtgtagtgtccatgaaaataagtgcttagatctacagctagaagcgtagttgactgatggcccaactgctgcccctctgcagccacccttgcattgtactaaactacaaattgccactagcgtctcccagtcatgaccaagcacaataggggctcctatttcaggctcattcctgtgggacacaggacttttccagtgggccaaattggctcaagaactcctattggcctgagcagacctttcttggaactgtgttggaatccaagacttcctagccattccttcttcctttcctctccatgtccataggtgtggtttgaaggacctcccacattctgtggcttcctttctcaatatatcttttgtatttctagttctatcttggtacttgcttctgggtagacccaaactaacataaagaatttggtcgaaatgtgtatattattaaggtaatgctagctgctgtaaaaataacttctcagttcaacaacatgtacatcattcagacagaaaattagtaagaaatgcaggacttgaattgcatttttggccaaatggacccaatagacatgtacagaattttccatccaacagcagcagaatgtaaagtttttctagagtatacatagaacattctccaggatagaccatatgttaggccacaaaatttaagattgaaattatgtctagtatcatttcagatataacttcaaaccacagtggtataaactagacatcagtgacaggaggaatcttgaaaaattcacaaatatctggaacataaacaacatgccccagaacaaccaatgggtcaaagaagaaattaaaagataaatttaaaaaatgccttgagacaaatgacaacggaaacacaatataccagaactgatgggatataggagaagcagttctgagaggaaagtttatagcaatatatgcctacattagaaaagaagaaagatctcaaatgaatagtgtgacattacacctcaaggaactagaaaaagaacaaactaaaaccagattagtagaaggaaagaaataaaaatcagaacaaacataaactaaatggataatagaaaagccacaggaagaatcaataaacttaagagttgggtttttttttaagtaaaattggcaaacccatagatagtctaacaaagaaaaaagaaaactcaagtaaaaccaaaaatgaaattgaagaaattacaacagacacctcgggaataaaaaggatgataagtccctattacgaacaattatatgccaacaaattgggtggcctagaggaaacagataaattcctaggaaaatacaacctaccaggattgactcaggaagaaatagaaagcctgtaacagaccaatcacaaatagattggagaagtaatgaaaaacctctcaacaaagacaagcccaggaacagatagcttcacagctgagttctaccagacattcaaagaattgataccagtacttcttaaactcttccaaaaaaatagaactagaaggaatactttcaaacacattttatgaggccaggatcaccctgatacccagccagccaaagacatcacaagaaaagaaaatttaaacccaatttctctgatgaatattggtgcaaaaagccccagtaaaatattaggaaaccaaatccaacaacacatcaaaaagattacatgtcatgactaagtgggatttatccctggcatacaaagctggtttaacatctgcagatcaatcagtagtgatacattgcattaacagaatgaaagataaaaatcacatgataatcttaattgacacagaaaaagcatttgacaaagtccaacatcctttattgagaaaaatgctcaatagtgtatgtatagaaggaaagcttctctatgtaataaaggccatttatgaaaaacccacagctaacattataatacatgggggaaaactgaaagtttttccatgaaggtctagtatcaggcaggcatggatgcccactttcaccacttctattcaacatagtactggaagtaccagcaatagtaattagataaggaaaagaaattaaaggcattgaggtcaggaagaagtaaagttatctctatttgcagatggtgtgatcctatattgtagggggggaaaaaagcccctgcagattccacacaaaaaaactgttagaacaacgaatgaattcagtaaagctgtggggtgcaaaatcaacatgcaaaatcagttgcgttttttttcataccaattacagtctgtttgaaaagaacatgaagaaaatggtcccacttaacaaagcatcaaaaagaacaaaatacctaggaataaattcaaccaatgtgaaagatgtgtacactgaaaactataaaacattaatgaaagaaattaagcacaaaaaaatggaaagatatcacatgctcatggatcagaagaattaatattgttgaaatgtccatagtacccaaagcaatatacagattcggtgcaatctctatcaaaattccagtgaccttcttcacagaaatagaaaaaatgcttcttaaatttgtacagaaccatgaaagaccctgaatagccaaaacaattatgaaaaagcaaaacaaagttggaggtattatacttcctgatttaaaaattatattacaaagttatagtaataaagacagtattatacaggcataaaaacagacacatagaccagtggaacagaatagagagtccagaaataaatccacgtatatatagtcaactaatttttgacaagggcaccaagaagacacaatgggaaaagaatagtctctttgataggatgttaagaaaactggatttccacatgcaaaagaatggaattggactgttatcgtataccacatacaaaaatcaactcaaaattgataaaagacctaaacataaaagcagaaactataaaactcctacacaggaacataggggaatagctcctggacattggcgttggtagtcagcttttggatatcacaacaagagctcaggccacaaaagcaaaattaaataaatgggggctgggcgcagtggctcacgcctgtaatcccggcacttttgggaggctgaggtagggggatcacaaggtcaggagatcgagaccatcctggccaacatggtgaaaccccatctctactaaaaatacaaaaattagctgggtgtggtggcgcacacctgtaattccagctacttgggaggctgaggcaggagaatcgcttgaacccaggaggccgagattgtagtgagccgagatggcgccactgcactctagcctggaggacagagtgagactccatctcaaaaataaaataaataaatgggactacaccaaactagaaagtttctgtacagtaaaggaaacaatcaacaaagtgaagtagcagcctacagattgggaaaaaattccaatcagtatatcccaatattccaatgtacatcagatatattgtaaatcatgtatttggtaaggagttagtagccaaaatttatcaggaactcatacaactcaatagcaaagaacaaacgaattacctgatttataaaatgggcaaaaggcctgagtagacatttttctaaagaagacacaaagatggccacaggcatatgaaagggtacacaacatcatatcagggaaatgcaaatcaaaaccactgtgatttacctcctcacaactgttaggatggctgttatcaaaaagtcaaaagataacaaatgttggtgaggatgtggaggactcttgtccactgttggtgggaatgtagattgggtatagccgttatggaaaacgttatagaggtttctaaagaaattaaaaacagaactaccatatatgacccagccattccttttctgggcatatacccaaaggaaatgaaatcaccacctcataaagatgtctgcactcccatgttcactgcagcatgattcacaataactaagatatggaaacaacctaagtgtctgatgatggacaaatagagaaagaagtggctgtaagtataccacatttggtttatacaaaatgaatattattcagccctagaaaataatgagagcttgtcatttgccacaacatgggaaagcccattgtgctaagcgaaatacgccaaagaaagacatattatatgatcttacttatatgtggaaccaaaaaaatttcaaatatgcagagagaatacaacagtggttaccagggatatgggttgtgggcaggaaatggagagatgtaggtcagaggatacaaagtagtatgaacaagtatagagatctaatgtgcagtatgaagactataggtatgggattcatgctaagtgagattttagctgctcttaacataaaaacaaaaatagggtaactgagatgatggatatgttaatttgcttcactacagtaacctttttactatctatattaagcctataacatcacgttgtataccataaatatacgtaataaaaattatttttcaaaataaaaaaatacaagataacttctcaacatttcactgttctaacacaagtttcttccttattcacatgaggtcttaaatgggtgttgatgaatggtaggtgacattttcctcctggaaatccttcaggaattcagattccttccatcttgtagtttctccatcttcaccatgtgactcccagagttactgtgcttgtttgcatcacatcaagagagggggaaaaacatggcaggttacacatggaaggtttttatggagtaggcctagaaattagcatagaaattaggcctagaaattagcataatcactttcacttatatttcgtggtagaactcaatcacatgtcaccaactagctgcaaaggaggctggaaaacgtggcccagctgtgcaccaggaagaagacactataagtttcatggaatagtccctgtgggaagtgggaggacacagctaatgctatgaggcctggatttatcacactgtacgttttatgtgagattttttttttccccaggagcttcaacattgagttcactggtgaagttgctgagaaagcaggtggttgagtttgaaattcagaatttggaggttcaaaactgaatagttttaaaaggaaaacttgggcaagtctccgttggaaaatgtcttttcagtgtttcggtacattttggggttgatatgagaagggcatagtcacaacatatgtcactctgtgtgttgctggttttgggtcctgcacctggacaaccaaacaggactggccccttcgttcctgcttcacgttggacccttcagtcggagatagtatgacttacagagggagagatgttttcaaaccctgtgaaaccacccattgttcagatgaaccatttatcttgcacttttctctaatacaaatgaatgaaccttgctgcttctagctagtacccttattcacctgctcttctggtggtatgcaatgctcattacattttttgcttttgcaaatttgtctcattgtgtttcctttgcttaaagttggctgttttcttcttccctcttctcttcccttaaatcattgtcaatccaaatcctggacaacctgtcctctcaggcccaactcaaatgccatctcctctgtcattctccccatttaccacagttgagtgcctcctgtcttcctgacactctttgggtctcagtttcaccactcaggtggcccatggctgccttgatacttctgtatgagtctttcacctactagatttaaaacttgatgatagaactgtgacttcctagtacttacttgctcttagcacaatgtcttacacacagtacatttttagtaaacaattgttgagtgaaaatgaataaatattgcttattgtggagcagatagaatgaagttcagtttggagaatcagtcttgtgtggccacagatcacatgaggaatgtaaaaattaaataaataaaacaagcctaagataatgtgttagaaggggagaaaggcctgtaccgattttttgcatctctaatgatcatagagatatgatttgtattatttatgtgggctagaaaaggggatctctattagggctctgaagtttgtgaaggctccagccacccatctgatgttgaaaaagtcaattgattgagaacccactgtatttacaatcttgacttattttggagcgttaatggaggcaaactgagatttgggttggttggttgtagggagtataagttatatcaatgctcaggggagtagttttgagtttgaaacattacaataacttcttcaggcttttaagatgtacataaaatacttgtaagtggatgataatgaattgacaagagacctctttatacagctagaatatatcaagttgttacttttctacaaatctccttatagattgggttttgctggtactgtttttatggttgtagttgtttattgtaggataaaagtccaagaggaaatgtctcttaaatataaaatgtatattctaaatataatatatagatactatgtataagctatttttctgctctaggtcctttttattttcttaaagccaaacatattgtgtgtgattcaaacaggtagagagcaattaatttaaaagtggcctaaaacccaccttcctctactacctttgaggggcattataccattatatgatccaggatttatatagcagattattttatcactactcccttagagcaaccaatcaatcagcttcattttattaggatgctttaatatacccattttaaaaatgtttatttaatatttttaagtaatttttgaaaagatctaggaagattcacatactcattttttcatgaacaaattatgctgtatacttaattgagtctgtctgtagggatcatttatttctattcatcaactctttaccaagcttcatactagatattgagatgatagtctattgattttgtttctctctctcatgtttttctagtatgtcttatcttttggggtttatttctggccctggagatcattcttttatgtcagttctcagctagttgtgatttgttgctaaattacctgcattcaagtttttataaatgaatgtagatattttgaaaactatttcttttaggatactaaacagtaagacaaagatacactgcacaattgtgtacaaaaggtcttttggaatatgacttctttgttaaaagcaatttgtgccatgatagtttaaaaaaaatagttcggcaatgatgttttcatttatgactatgtacatactgcatttgagcagagagaagttttttattatgactaaggcctctgtgtaaccaacttcaggtcaaatatgaaatatatggtgtaacaagtgctgtgttttctctttaaaatacacttggattcttccacgaggtatattaaaaatgctttgacatcattatttcatcttgagttaccctttcattcactagcttggttggagaaaattaactcttcaatacatgatacagaaaatctgttgatgcagcctccctccagttcttagtatttaatttcatgagggacatagcacttttccccatgtaattacagattggtagagttgagcaagaccttaaacatcctgaagtttaacacccatcaaatgcagatacctcttctaaggtatcctaatttctatatcgaaaataattctaattatcagtttacttggcaaatctgccataataaagtctttttcaaagttatctatgcccagttcccctcaatatttctcataatattagttccacagtcattctgatctcactcctttttgctttctccagtttatcagaaagttccttaaaaggtagtggacaaattatagaagtacctcccttttttttttgaggcaagatttcactcctgtcatccaggttggagtacaatggcgcaatcttggctcactgcacccttcacctcccaggctcaagcaattctcctgcctcagcctcccaagtagctgggtctacagttgcataccaccatgcctagctaatttgtgtatgtcttgtagagacgagttttgccatgttacccaagctggtcttgaactccttacctcaagtggtccgcctgctttggcctcccaaagtgctgggattataggcgtgagccactgcacctggccctaaagctactctttctgagcagtttgagagggactgtggcttatctggccttgagaacagtgtctttattaatgcagcctaagagtacatttttgcaaacccatcacactgcctgtattgaatcaagaggctgctggacctccatgtactgaccatacaggacctcacatttgagcctagtaaacttgactatattcattttggtctatttttaaccttgtgagaacttttgtaatcctgtttctggcatccctggtgttgtgtttttgtaccaatacagcttctggatcattgtctcaatcattgataaaaatgggcaaatacagactttctgtccagagtgataatcatatccattacttttgctttagataagagtgttgctgttgatcatctttgcctgggaagttgaatgataaagccagaagaaagcatgctttctgatcattgtaagttttacttttaaggaaagagactaaaaaaatttagcaggaaatttaaattttattaatatcatctcatatactttagaagatctaaaactgttaaaagaaacaaaatggtttacactggagcctggttataacctttctttggtagcccatagctgtggggcccatagctttggggcccaaagctctctttgatttgagtcagagaccttcccatgtgcccaggaattttgattatggcaggtgatattatcaagtcttcatcagatttggctggagggaaaagctgtctgtcaccaagttgtgtgaatctttgtattgctaaaaaggatacccgggcagtcttaaaactggtgccttatgttatttgaactttaaaatattgtgatgttcatgtttgctcaggctggctactccagttttgttacaacatagtgctgctcagaccatggttgaaagtttgatgctaaaaagcacagtgtatttgagcatagtcaattctaaaaaaaattttgttttctttcttccttccttctcctttcctttcttctttctgtcttgaaatctgtggattgaactttcccacccctggaaaaacaactcagaaagtatatcatgtgtcatcactatcatcttccttttatcagtgcaggtttatagaaagtgttctcatatcatcctgaatcatttctacaaactataaaacaaaattaactttccattacaatcctaacaattgtaataaatgctcctattagaagcttttacttccatcctgtgaagtatatcatgctgaggggaaagttgcatcttcattagtcacccatgacttactccaggtgttaccctctaagttagaaagagagagggcaaaataccctggtgacacatacgttttttaagggaaaaaattctgaaagcaaaagggttctctctttttttaatatgactagcaaaagagtgttgattaagatgtgtcaagcaggtgctgggtatgtgctaaactaatggttttcagagtactgagtggctatttttaaatgtttctatatcattctcagttaagctgctggatgaaaagtacaaaaggctaaaaatatttacagtttcagtaatgtctgttttaaaagaaaccatccgcgtctatggccacaccaccctgaacgtgcctgatcttgtctaaaagaaaccatcctgtgtgatttttctttatttccatttgaaggaaaagaatattatggcttacagagaagtggttgaaagcagtttgttcaacactgaggtttttaggaaaaaatggccatcaaaaggacagtaagttgggttacaaatcatcaggattaaaaaaaaaaagttgattattattccttgtactatattattattactatttttgtattattaactgtagttccaactgaaaatagtattatctttgaaactttttgtatggagttaggagacaagttgctggtatcagattacttgggcctatatctcagctctatcccttggatatgtgatcctggataaattgtttaacctctttgtgcctcagtgtacccatctgtaaaacagaataataatagtgccttcctgctaaggttgttgtgattaaatgagatgatgctctgcctaacatggtaagtactcagtaaatgtttgttatgcttatttttttcatttaaaaaaatttttggttaaatgaacacatttattctcttaaccatttttgagtatataactcagtaatattagctatatttacattgtagtgtaacaaatctttagaatttttcatctggcaaaactgaaatgtttattatgttttaaaagctcatttttcttcagagtcagttacacagctgtgtggacgtaacacaggaatgcaagcaccattggggcagggagtttagactcttctgttcactgctgtatcacaagtgccacaatcagcatctggcccataacagggctcaatcaatatctgtcgaatgaatgaatgaatgaatgaatgaacagtgaggcttcatttgacaaactacatgtgtgtttgaaaattatttcttaaatggtaaatccatttttatgagtgattttaagtatacatggaaagttgactcctttcggagggtgaagtgatttctaaaacaactgttttgtaattatttagcagttctggctttggtaggtcaacttttcttaaactggaaaaaaaaatagtattcttagtgtagattgcaaaaggaaagaggatatgttagatgatttgcccaaaatttaaacaggattcgctttttaaattcaagcctttttgctttcattcagatctggtcaccagacttactttttccttaaggcatatatgaatcatcttgttctttcattcagaaatcaaaagttcaggcctagatcagtatttaccaaaactggtggaacactacctttccactgagagtgcattacctttttttgagtctttgaaaagaatgtcagctgaacatggtctggaagtggccaaaactctgtgggtggggagaaaggaagaaataacctatctcccatttaaaaacctaccacctattaaataaacggcagtcttgttctgtggagtattcatttgggttatctattctgatgaacaaatacaaattcttggtagggttttcttgcttctggataaaatgcttagtgttgctttttgttgttcaatcttaggttttgtttcattttgtttttcagggtctcactctgtcaaccaggctagagtgcagtagcgcaatcatggttcgtggcagcctcagcagctccctgggctcaggtgattcccccacgtcagcctctcgagtagttgagactataggcacgcaccaccacaccctgctaatttttgtgtttgtagtagagatgggagtctcaccatgttgctcaggctggtctcgaactcctggactcgagtgatttgcccactttggcctcccaaagtgctggcattacaggcatgagccactgcgcctggcctgtttttatgatatgtattgaaatgctccaatagcattttatttttatttaaacattgctgttaggtagttggcacaaaatgtgtcttatgccaaagtttacttccttctaccaaggaaaggggactctgtctcctggactttgcagttatgggaggaagatgacaggaagctacatcatctgccaggatttttatggggccacatcacatacagtgcctgtctgtaactaagagcaagagcacatctctcctttcagctgatgtttagcaaaccctcactctgctcccatggcaaagacagtcactcatcttccaaattgtggtatcttgagtcatttccattatgacttgtcttctgaaaagtgataaaggaaaatcatcttacctagtcattttttcccattctacaagacaaagtttatctctgaatcaaagagcataaatctctgttgcctctctgagataataaaatatttttatatttaaattttctgttaacaggaaaatgtataaaaccttcccaaatttttaactccttcttttgattctatacctacataggtttttatttggatttgaaaccaaataaaagaccgtttcatggtctgggcccttgggacagggtagtagtgaagcagccagttcatttattcttcatctgccctgccatggcttcctgttgcactaagaatccagcctcctccccggagttggtgggagtctgctgacctggccccagccaggctctctggcctcatgcagccattttcccttcattgaccccataccaccactgtgaccaggtgcaccaggctcttcctgaggctgcttttctccctgaaatgcccaccccacctcccacttttcatttttctaactctcgttcatccttcacttgcattttaacatcacatcctctgagaagccttccctgatctccacccttaatgagcaccacccagttgtccatactttgctttctcctttctttcccagcccttattagaattttaatttcatatttggccatacatttgtttctttaatagttttctctcccattagtctatgagcccattagggatcacggctattttgtctgctgtatgtaatatccacttcctagcaagcaggacacactcaaggaagagttattgaataataatttaaaaatattttttattaaatgaaaaatataaatatccaattctaagaatgtgcaattctgtcaggagtgttaagtactgaaaaaacgacagcagattagttaattggttgatttcacaaacatctgtagattgttgacagtgcactatgatgtgctgttctaggtgctgagtacatgtggacgggttgttgcctggctttgcagaggtctcaccttggggagatagcaaagagacacaatgaggaataaaattagtgcctttctctcaaggagcatatgtattcattcatgtaacaaacatttgttgagcacctatgatatactctaagctagaagacacttgaatgtgatgagtataacatataagagagtaaaattaatctccaagaaagatacagaatgctgtagggatgaagattaagaaatgctgtctgattagggacatcagagagcatcctggataaagcagagaccgaagtgctacttgaagaatgggttcaactttgacagctgaagctatgagggaggaaattctaggcatgggaaccacttgggtaaaggcatggagatgggaagacattccagggatagctattaaccctttttaactgaagcatagggtggatgatggtgaataagaagaaattagactaaaaaagtaggtagaggctatactttaggggagtgaagaattcctctaagtttagaaaaagttgattttaattaccttaaataaggcagtaatggtactaatattgctgtttggtagcccttaggaaaatgatacttgtgacttggtacagtggctcacacctgcaattccagcactttgggagattgaggtgggaggattgcttgaggccaggagttcaagaccagcctgggcaacatagcaagaccccatctcaaaaaaaaaaataactgtacatggtggtgcatgcctgtagtcccagctactaaggaggttgaaacaggaggatcacttgagcccaggagttagagattgcaatgagctatgatgaccactgcactccagcctgggtaagacaccatctctacaaaaaaaaaaaaaagaagaagaagaaagaaattgatacttgtttaaatatattacatgtcaaatgtactacaacagtcctctccaaatgagaatataaagagcttcatccttgtaaactgcagtcatgttctcgttatagtggtagttagtatgcaggtcaataatttatatgtggtctttagctttgtctttttcattaaacagtaaaaacggtaacctgacatttgaaggtttttttttcacatttgtaatatcaaaaacttgattcgtaacaagtatcgtaaatttacaagtatgtttttcatgcatattttaagaaaattttcataggactttaacgtcaggtttcttttgaatacttccacatgctctacctaacaattttagtgtaaagtttcattttccttatcaaattctatgtaagtgagacattggtgttttagccaaggtaccctgctttatggagtatctgtgttcctagaaaatttgttttgaaatatgattttgtaaatcagattgtattgtaatatacttggtgaccttttgcttcaaatcaccttaaaataaattcatttatattatctaattcatattttataaatcctaatttttatatgtactcatttttcttgaattgggggtaattctacaaacaataaacaaggtaaatgatttttttttgccagtttgtactaagagaacatgttattttgtttcgggtgaatgtatgtatcttaatacactgtactacattagacatcaatagggaggaatgtaacgcatttttcttttgtatggaaatctgttgaaacctatcttaaagagttttgagcagaaattgaaggatgagcctgaggttttctgattagttggagaatattgttttcagtagacaacagtaagaataaaagtggaaaaattgtatttaaaattgatgttttataactttcagaagttgatgtctccattttacacattatacttataaaagtacagtaatcaactctgctttataactgttttgtgaagattatttaaaggtcaagggagtgtagtagaggcacagaaaaacagaataaaattggaatcctagagtttatgtgcatttaggttaattttgacttagtggctcctggctctcaccaatctgggttgagtgaaggacccactgttcattgtgttccagcagtagtcactcagacccagcttgccacgttatcagtccaacttaacttctgccacgtcccactcctcctcccttgatagcttctcttgctgacatcctttccacccctttgtgctgcattcctctggcactgccagcctcctgtcatggaatgagggtctgggccaggagacctttggagaaaattcctggagagcaagttttcatagatttttgtccaattttttctgtttccaccctgttacaaatattttaatccaaatatgaaaaatctttaaattcagacttctcttgtttcaaattcagacttctcttgtttcaaattcagattatttctgatcacctcatagctagttcttgaagttcatcttagcaggaacagagctaactaaactactgaatgatgtaaatgaacatataaaggctatgtttacctacttaagaaattgcttttagccagtttagaaatgtctgcttactcttttgtttttaaatttaaaaaattcttcagagatgggatctcgttctgtcaaccaggccggagtgcagtgccaccgtcacagttcactggctacctcagcctctggagtagctgggactacaggcacgcaccacaacacctggataatttttttaaattttcttgttagaaacagagtctctctatgttgccctgactggtcttgaactcctggcctcaagtgatcctcctgccttggcctccaaaagtactgtgattacaagtgtgagccactgagcctggttgaaatgtccacttacttttaaaaatgaattgtattttaaggaagagtttgcaatgcttaaataattttcatcagtttacttaaaaagtactaaagcctttttttttttttaagacagaatctcactctgtcacccaggcaggattgcagtggcatgatctcagctgactgtaacctctgcctcccaggttcaagcgatattctcccacttcagcctcccaagtagctgggattacaggcacctgccaccacacccggctaattttttgtgtgtttttagtagagacagggtttcaccatgttggccaagctggtctcgaactcctgacctcaggtgatctgcccaccttggcctcccaaagtgctgggattacaggcgtgagccaccacacctggctaaagcctatttttaaagcataatttatattaggtattgttaatccttcacggttcttgtttggttaatttcagcagcttaaggaagatcacttggagctagaaaggcccatgagggtgatgatggctcagagggggcaatagaagcagcttttagggaggagtcaagtgcagtaggtaaacatgggatgtgtcagatatgataccagccagtggtccccatagcacaggcagcaagtgtgaggcacagcacagagcacatgtacacgagtatttgtgtgcgtgtgtgcgcatgtgtgcgcgtgtgaaggggggagggggtggttgctgtcaggtgagcaatatacccaaatggagaccccagaagcagctgatactaatccatccaagtaggcagcagtgtctgtccatgagaatgttgggcccagccattatccaaggattctagaccagattctggagagatcacagcagagtttctgcttgacttcactgagcttcagtgtttgaatctgtaaaatggaagcagtaatagtaattacctcaaggggttattttgatggctaattgaaaacatgtatgcgaagcccttgaataccatctggtacatagtaagtatttagtaaatgttagctattactgtattacatgaaattgggaagacagtatttctttttaaatgtcctataaataaccgggtgcagtggctcatgcctgtaatcccagcactttgggaggcccaggcaggcggattgcttgaggtcaggagttcaagatcagcctggccaacatggtgaaaccctgtccctactaaaattgcaaaaattagccgggtgtggtggcacatgcctgttatcccagctactcaggaggctgaggcatgagaatcatttgaacccaggagatggaggttgcagtgagctgagatcatgccactgcactccagcctgggcaacagagcgagactctgtctcccaaaaataaaaaataaaaaatgaatgtcctatgactgaggtttattgctcctcaattgagctattccaatcaatgaaattttactacataaaggtagatgccttctaatggttttcttcccacagggatggtggggtgagatggggaactgttcaggtagtagacctgttcatgaggaaaaaaactatttaaatgctgagaaaaggatgctagcttttttggatccatcatcatttttgccaaattcatagaatttttggccagtggtgtcaaactttaaaattcataggaaaaagagattcagtaattactctgtaatattagggagggtgtggaaataaggaatgaacgttatgtaaagaccataatgctagtcagagaatgttccaatggaaaactgatgtttccttctgccaccaggacaaaacttttgtgatctaaaggcaaaacaataacaaaaacagcaacagcaacaaaaaccagcctaacagtcccaagtggtcttcactgtcatgattattaagcattttctccaaagtctgaactacagtttgttgaggtttcattgaaaatgatactaaaacaaatttgcttaaaagtaaaatggagttattggcatcacaaagatcatagtcaccttcttaagaattgcataacctttaatgactgtaaaggatttttaaagacgatccttgcgactagttattaatacatttttttgaggctgtggaaatcagataatttgggccgggcacattggctcacgcctgtaatcccagcattttgggaggctgaggcgggcggagcacctgaagttgggagttcaagaccagcctgaccaacatggagaaaccttgtctctactaaaaaaaaaaaaaaaaaaaaaaaaaaattagccgggcatggtggtgtatccctgtaatccaagcgactcgggaggctgagacaggagaatcgcttgaactcgggaggcggaggttgcagtgagccaagatcacgccattgcactccagtctgggcaacaagagctaaactccgcctcaaaaaaaaaaagaaatcagataatttgcccaaagtcaacagcccaaagtcaacaactcctgaattttttgatcacattatctttcaagtttagttagaacctgaaagttaactgtccttcacttaggtagatcataaataatgcactggtcacattgtgtagatattaagttacactttggtagatggatttttagatattgaaaatgatagattggtacaactgctttgaaagtttggcagcttcttataaagctcaagataggcttaacgtacaattcagcaactacgcatctagatgtttacccaaatgagttgaaaatttatgtctgcagaacaacctgcatgcgaatcttgatagcagctttatttataactgtcaaaaactggaagcaactaagggatccttcattagatgaattgataaactgtggtacatccagataatggaatattattcagcactaaaaagaaatgagcaatgaagccacagaaagacacaaaggaaccttaaatgcatattgctaagtgaaagaagccagtctggaaaggctacatactgtacgatttaaactatagaaaaggcaaaagtcaaaaccatagagacagtaaaaagatcagtggttgctagttcagggaagaggggacaggatgaacaggtggagcacagtggattttaagggctgtgacactattctgtatgatattgtaatggtggatagataggtgtgtcaaaacccatacaactgtgtaacataaagagtgaactcttatgtaaactatattgactgttatgactagttaatcctatatcatcattggctcattaattataacagatgtaccatacttgtgcaagatggttaataacaggggaaacggggaagagggaacttttggcttagtttttctataaacctaaaactgctctaaaaaatagtctactaataaaaaaaaaaaaagaaaatcaggatagattgtagcttagaaataaaaaaacaatactccaagacaaaacaaaacaaaagccttgtataatgtctttcatataatattccccaccttatttctctagttgttttttaatttttttttcatttatcttatgtgttatctcatcaacctttagtaacgggcagttaaaaaaataagcagtttggcaacttcctgtggcatacatttcagattgtgagcagagatgcccaccatgtgactggcaggtgtccctctccctagccacaccctgtccctcttttccacctaccctagcattagttgtctcctaccttgcttttgacaacagacagggtgaaaatgtgggcttgtggccattgtgctaaatgttttatttctatgtattttttaatccttacagcagttcccattttgtagatgaggaaatgagagcactggaagagaggaaattcctacccttgcagtctgactccattctgatcctctatcaggctaatgtgaacacacgtgactctctgtcccagcctgccccctgttgagtaggtgggagggggagccatttggaggatttggtcccagtccaggtgctatttaagtgagcggttgattttagctgtggtgaataccaccaccctacaggctagtgtctgccattgagaagtatcatctcatcattttcaatctattaagtgatacattatcacattattattatacatatatattattatatattatctggaaaccatataactataattttagtcaactcttttttttttttttttgagttggagtctcgctctgtcacccaggctggagtgcagtggggcgatctcggctcactgcaacctctgcctcccaagttcaagcgattctcctgcctcagcctcccaagtagctggagactacaggcgcacgccaccacgcctggctaattttttctatacttttagtcaactcttaatttctagcctcatattgacaagtgatagggttcaaaagtaatatctgttggctttggaaataatattatatttagtattatatttaatggaagttagcagatttagcttcttaataatgtttggctggaggcagtattaacctttggttgctgtcttgtggcctgcagatgtttgtaatgcaagagataggaatttggtccctaggagggtaaagctaaggttcactctaagaaagccacaaagcagacagtctacatgttgaggattaaatgttgattttacgtgggtcatcatttttaaagtccatttgccttcttattttgtgatgaatatttaagattttgaagtacatctcctcttatttgctttgtagttcttatgaggaagaattcccattatagtggggctgaggagataaccattatttttcgttatgcttgttttcttaatatcgtaaagcagacaatagcaggatatttaatgaaatacatcatgaatttaatcctagaccaaagcaaagtattttcaagtatttttcattttcacataaattatattaaaattcatatttaagttaaaatttttgagacagtttacttgaaacatagtagcattcttcactgatgttagaattactttataagttattttgcatttcttaggaggcaaaataggttttcaaaaggattaacatgtgttaaactttttgatatttcattaaaaaagatagtattggaaaaatgcagtattttttcatttacttccaaatgttttgtattaaactttttttgacctagtagatgactagtacaaatagaacttttaaagattaggatatacctgttacttgtaagatgaatttttttaatgcttaattcaaataataaaatatatctgtttttgtattttctgtaacaatatagaagtagttctcagatttctttttctataagatgaatttttagatctttattttacttggcaagtctaaaatagtggtggttctggggttgattcatgtgttcgtttttcctactgtttggctaattcttgtatgtggttttaatttttttaatagcaaatatatatttctgtatgtgaatagtcagcgtgtgtgtgtgtgtgtgtgtgtgtgtgtgtgtgtgtgtgtgtgtgtattcccccccccttactatggagatcatgcatgtcagtgctgagcttggggaaaacagaaaaacaaacgtgacctttgatcccttcagagataacataatctcttagtcatataaagataaggtccatctcttagtcatatagacgagatttatatcttagtcatgtatggctatatacataaatatgtgcatattgccagagattattaaagcatgtacatgcatacataaataatttttaaagtgaaaagagaatcctcctataacaccttacagggtggctatgttcttttaatgtttcatggggaccttgctgtaattttagagccagcacctggctcaggttcacccatgacattttcagctgatctttcgcttgttttctagttgaccttcaaacagaaagttcatagcctcttctcagctgttaatgtgatttacttcttatgtctgggaagtcaagattgttgctgaattcattgttttaaggggattgaggtccttggtttaatgccaggacattcccagctgacagaaaactaaatccgccaaccctaatttcaaagattaccaggtttgtggctcgtggacatcttagatcctaggtcgagcaactcttaggctgttcctggcacaccacatacatatggggttgtgtattgattttaattcaagtatcattttagcattgattggcaaacaccctagtggctttcagtcagtaaaattcagtgcagcagctaacctgctgctgctcctgccttaaaatcagtatttgagttagtggtcgtttaactttgcaattttgactctgtgttaaaatgtatactttttcttaattttcaaaataggaagtgaggtgtgctcttcaggttcttgggctcacagcagggaggttatgaaatataaatgaaaggagacactagatgagctccacacaaggcagtatcacaactcactcccccaagaaggaagcacatcatcatttcttacaccgtgagaaacagccatcttgtcacaggaaaatgagattgaagaattagtctgattaaaaacaaattaccagagttgctgttcagttaggtggcctgcagaatattagcagctgtggttggaaagccatcaggagtttctctcaagcaagaccaagctggtttccttagatccctgtcttgtgtcccagcctgttttatgccttcaccaccctcactttagctttttcccagtaggaaacaatggcaaggtagaggaagagtttttaaattcattcttattaggagtgagtttttttctttgtagatattagtaatctaaaagtagaagtagtgtaaatattttttacagcatataattcaattgcacatcagcagttgcgctatctgtatatgcaaatactctaagaaatttaatattttatcaaaagccacaactccaaaaatgaaatctaatgacttgtttctatggtaaccactatcgaaatatgtctagccagtgtgtgtcttcccataatttttctctaagagtttcagggagttcattaaatttgctttcccaacatagatagatgatcgatcgatcgataagagagaacagatacatttttccccctaatggggttatgagactattataaaattctctttagcttcgtatagagtatgacttcattcttagacatgaatgtatttggctaagggacaagcctattgttttataaatttagtttaaaccagtaataaagccaggttagtaataatttctaaaacgagattaatcttgcttcataaatattttctggtatttatatatggaactgttggattgcacacacattgatttctagaatgacccatgtccttttaaaattgaaattcatttgctgttcctttgagaccttgttagatttctttattgctcgtccaccgttgtctttgttatctaccagggcgttgagtgtctgtccaccttgatggagttctgacctggatttgatcaacatccccttgtggcctttcttccttgtcagaggttgtgtgctgcaaatacaatgaaagtcacaacttatttatttagagatcttgacatttcccagcaggttcattcagaaaagctgactacagtgtttccagaggtacagaagagattccattgcattttacatttaagagaaagtaaactattggtttggtaaatttttcaccagtctcaaggcctgtcatgtcacaaaacaaacagatgtggtcagatattctagtgatataagtgtgcattcaccgtgagtattaacattatggcagggttcatggaattctctggttacattcaaagggaaacattttgtaaagtaaagtggcaggaaatagatactgaggaaataaaactacactgggtctgacaacctggaactttcatttagcctacaaagttgacagacaggctaggatgtctctgaacctgttagatatggttggtcataataacatttaattgtttgttgaggagggatgactatttaacttaagggcccttcctctgtactttcaagctctcccagatttctaaaacaagagcactgggctgggcgcagtggctcacgcctgtaatcccagcactttgggaggccgaggtggatggatcgtgaggtcaggagatcgagaccatcctggctaacacagtgaaaccccatctctactaaaaatacgaaaaattagccgggcgtggtggcaggcgcctgtagtcccagctacttgggaggctgaggcaggagaatcgcttgaacctgggaggtggaggttgcagtgagctgagattgcgccactgcactccagcctgggcgacagagagagactctctcaaaaaaaaaataagaacattggccttcctgagtcctggagaatgggtttgtacaatttcacagtggaatcatggacatagtataagtgcatgtagttttcaattttaatttgtagtctcagttctttcaagaagtagctgaacagtgacaggcacagttttctatacagtgagctaaagtaagatagcttcatggaatcaggtggtttcatatcctgaaatcccagagactctcttttttgctccctcatctattgccctgtgttcaggctttaccatttctcttctggacaaacacaggaaactctttacctgcctcctgctttgcacatatggccagccccttggttcatcttccatactgccaaccaaatgttctttctaaaggcaaaactaaacatcatggcatgactttgcttaaaatcttccgaagacttctcttcctttgcaaggtgtctaaatcccagaatgtctcagacctatgtatctttccagtctactctttctgtgccctgggtaaactgttcgcttcccaagtgctttgtgctaattgtgtgaactctttctgggtcccaccatgcaggcctgaggtccctcatggctcaggtttgtctctggcctagcatactgtttctaatcgttagttgacgtgccttcctcactaaactctaaaaagcattttgagcactgtttattgcttgcttttgcttaacaaatactgagcccagcacctggcacctaggtggtgctcaataaatgtttcttatatgattgaataaatgaatgaaggaatgagttagtgatatcacacaggaagcagtggtgaaggagacactgcatttagttagtaaaacaggcttgagctgcaattaacagatttcagcaagagtgaggctggttggttgctgggtggcccccataagggcatagccctggtgaatagccacaggaccaaaatcagttttattagttctttttgagagatgtgacttgcaagaattgacttatagttaaatttatgagagattaattcataattgatatgctcatgtattcttgacaatgaaaagaggaaggccaggcagcacaactgacatgggtcatttgctcaggccacatcctgctggtcagtaagttcattcaggaggcccaatattagaacttactaaattctgagtaaatgcatcctttctaattgtctctaagggattgtccatcaagctggattacccagaagaaggattattttcttttcctatttaaaaatgtttttaaatttaaaaaaattttttagagacagggtctcactatatcgcccaggctcaaactccttggctgaaaggatcctctttgcctccacctcccaggtagctgggaactacaggcttgtgccacaatccctggcttttttagttgaagggcatttctctatagatcactgacttttacaacatccttaacagtaatcaaaacagttctacctttgtaataataatggctaattcttgaatgtttactgtgttgggcactgttctaaatgctttatctactttgacataatcttcacaaccctgtgatgtaattactattattagctctgtttttacagactgggaaaccgagagcaaagatgttaagtgatttatctctgttctaaggggtgctggaatttgaacccatgcagatggactcaatacctttgcttttaaccacacactaatcttcctttctatgaatgcaaccagcatttcttgtgtttgctttgtgtgacttcgtttaatgctcctagcaacttctgcaaattaggtgttaaatctcttttgcttgcagccgaaaaaaggtcttggttttttggttacaagcaacggactaaagcaaaaaagattttaccatgtcttatacctgagctatctttaggtcaggttgctgactatgatgatgggtgccccagttggtatggggaggggcaacttttcacaaaggaaggggagccaatgatggagaaacaaaatcacatgaagaaatggaagtttaaatgacttgcccaaggtcacccagctagtgagtgccaaaggtgggatttggccctaggctgcctctagcaccatctgggttcactctgatttgagtggaccctttgcaaactgtacatcctgctgctgctgttctttcatcagcaggttatgctatcataaccataacatgtatcattttctttattccattctggttctaagaatacactgtgaccaccttctttgaacctggctgtttcccaaatgtagtgcacattgttttatttaattctaaactatcttttaggatagttgtataaacagtttagttcatctaaaattttaactaaaatttgtactgctttccacttctgaaagtgacctttttttctgacctggctgcaaattctggagaaggcttgactgaagctctgtgagcagaccagagctttttcaggctaaggtttatacaaaacattgaccttcatggaaattctggttcttgatcacttgggtaagcaagtaagttcatgggaatgcccatctattcactgtcaactcacagccctactgtacaggtccttgctggggagcatgctctctggaaagtggcttatactttgcacttctgaatctgtttgtgaggaaatgacagtatttttccgcacttgcaccaccgactgaagcgctgatccttgatgtgtttagtttttacctgtgctcatctctacatcaaaaacagaggaagccacaggaaattgctgcctgtatttccaggaaacttaactacatcatcggctccccaatccgcacagcccagaagaccctgatgctggcctcagtgttgctgatgtgggtggtgataaggggccgagagtgttctcatcctgtggctctgccagtgaaagcctagaagagatgaagcactcttcagactaacaggaaaaccctgagtctggttctataagcacttagtctctgaacatgccgacagtgagggtgaagtgagggataattctatcccaaggctagtggtcctctttctttctgctcaggtgtgctatcttgtccctggtccatagggccgtggctggcattctctctgatcacagaaaattgaaatgatcctgggaaaattgtcacatgagcctgtggatggggtcaggagagataaagaccataggatttacactggccaccagcagttcctcaaagaattataataacataattgtaataccaatcgctgatatttattgagcattgactttggtgtgccaggcattttgtcgaggaccctatgagcattaatgtaatcctcacataaaccccaaaagggactctttattattcccaattgtcaggcgaggtacctgagactcatagagtttgataccttgtccagggtcatatagccattaaaggatgcaaaacttgaacctaaatctgtgtcattctaagccagcactatacatagtcaagtaggttttactggagggtggagtggggctggcagcctgtgtgcacaggcagacggaagcagacaagatccatccaaggcaggctgaagacttatacccagagaaggctttggtgtacatctgccaaagtgatattctcatgtagaagaaaggattgggtgatagtccaataaatactttaccacagggaacttatgtgtcttctggggtctggccaaagtcatgagtgcaagctcccaaataaaaaaaaggtggcttctcacctcctcatgatcccagcttcctagcatagcactcttctctattttagcttatcaattccaaatgtgattgaaacaagtatgagaaattgatgttgcttcagcttctctgtgaactgaaacaaattcttgttgaaacatgatatctcctgcctcatggatcaaagagggatggtctggaagagaagcccccataaatatttgaggcttaatgaaggctatctgttgaataatacacctgtattattgtaaaaagttttaatttggcctcagagatactccccactaaagcagacaacaaaaaagtgagaaaatgaggctaggaattaataaaagatgtcaagaaagaccatttaaggacttcttagagacaggccataaatgtggttttgaactttttggcagctattatgaagacggaaagagaagtgtcatgggaatcaattttcaaaacttaaaagttctcttaaaattctagcagaaaaatagtttgcagctctacacaggtattggctagcattagtttaaagtggttgacatgcagccctactgcacacctctttatattccctttgtgtttaggattagaaaaactcacatagtatgatctatcatatgtctacttctggattatttcaagattgataatctggtttgtgtattatcttggtcttcatttctctttccttctgggcctgttgttcatctactggacatttcttttcttattaacatttctgctaaattttaaacagagaaaagaaaaataaatacacaattccagctatttgcagaggtgatttcaatgctttgtcagctaaagggaatttcaagagagatctttctacatcagtctactcataatagaactcctggctatcttgggttgagcctgcctgcaggtgtgcttaacctgggccacagattaaggcaggtaagggagaaacacctgcagaggtaggttttgaccccattatacctaagatgaaggtcactccttgtgaattgatatagaatgtgaaaagggtagaaactgctgattaaaacaaagtgttttgattatctggatttcagtaataagtgttttcctctcttccagttataaagagttgaaaaccttgcaaggcactcttgtataattgtgtccttaaaaggtttagataacggttgggcttctctctctctctctctctctctctctctgtctctctctctcagaccaaatatatcatgtctattgaaagtctgaagatcagtacatttcctcctgtttggaaaataataatgcctaggtttcactagaattctttttatctccaaggctctcttaaatattgactaattaaataaaaactaaggaagtctagctaaatagcctcactttgaggaccagcccagtggacttagaatacacagtgatttgctgtatctctgaaacaagcaactagaaatcttttattattggctataatagcaagtggcatctcttattatgtttggcagctgacatttcaaattgcattttggttggttgttatacatgaaatagtaggatatgagtagactaaaaatgagaatttgcagcccagggatgacatgaaatatctaacatctaggggttgccatgacaactcatcagaaagttgctttgtaatcttttggattaggctctggcccagggtcactggattggagttggagaacgctttggtaacaggatgtgaatgttgtacctttactcaatggcatttgaatttgcagtttggtcatgttgctaaggtcaagtagaaatgacattgagggaatttttaaattcccgcagaacctagacaaggtcacatttgtcagcaaaaatactcagatggaatagtctgagacttagcaactgaaagacaggatttcctgtccttgatagataaaaagtatgcacatatccatttatatatgcctatctctaaacagttgtatgtaatgaaaatttgggaaattaaacccttttcataattgtcttctgttataaaattggaactgaacacccctaagaaaacagtttggccacaaacaaaccacagctgctttctagtgctctgtgtcctccctttcagctggaaatggcctgcagggtgtggaatttggaccagggaagggaattcggcagagagaggaaggaagcaattgggaaacagggtaccacattcctcatcccccacattggccttgaccacaaggacagcatcttccacatgataatgcacctctcaggcatgcttctcaccagggatgatcaatggaagcaacctggaaactaaagagctctgttcctaagtctgatcccagttctgccactcacactgtgatcttgagcaaaacacatttcaactctgggttcccctaggaaatgagggggctgagtttcctctggctgtcaagttctgctatttatcatcatgtgggggcagagccaggtctccacatcgcttttctttgccattaagcccacattcccatcataactttgcagtagaagtaccgttcattgttagtgggacctcttaataattaaaagaaagagaaaaaatgatttattcttatccccataccttttaaagttgtggttttctgaagcaaaggctgccatgcagtgaggaaaggatgaaattccagacagaagacagtcagttgcaataagttgtcctactaccagtactgtcagcatcagctcagcttatatttactgagtattttctatatggagacagtgctaagccctttatatgcatcaaactgtttaatccttaggacatattcacatgtacacatgtataggtatgatgcatgtgattaaaattgaacatttgctatgtaccaggtgttatgccaaatccgtacaataatccactgagatcaataaatggattcagtcagtcaagcctcacaacaaaggaggtgttatcagttatctccgtttttacaaataaggaaactgagccatagctagtaactagtggagcagggatttgaacccacgtagtatggcctcagcatcctttctcaaaacctctctgcctgtggttctcctcactcatatgacataaccacacctggggaactttagaaatataaggatcttggggccccattctggatcagtcagaatgtcggggattgcgtcccagacccaggtttgctaatatgcagccagggctgggaaccactgcctcagatggaataccagggttatgttgttggagagttgcctgtagctctacagccagcagatgactgacctaggacttgcatccaggctgtaggctctcaagccaaatatctcgacggcacaatgggcaacaattcagttgttatctgggctcatatctaccaccatgcctagtttctctctcctagtctaaatcgcaaagccgcaagttcatttagggctgtttaaagactgtatgctacaccaattatgagaatcagagcacaaacttcttgttgcagccaaagcagtgatttcctacttaaaagtttcagaggtaacctttgcttttacctgtcaccaacttaaatgtaagttatcgtgctttttcctcattgagcaaaatcttgtactgacagagtctaggacagtggttctaaaactctgatgcacattagaatctcctggggatctttaagagctacagatggcctggcttccaccccagacattttttttttctttttttttttgagacaaagtctcgctgtgtagcccaggttggagtgcagtggcatgatctctgctcgccgcaacctccgcctcccaagttcaagcaattctctggcctcagcctccagagtagctgggattacaggcgctggccactgcacccggctaattttttgtatttttagtatagacggggtttcaccatgttggccaggctggtcttgaactcccgacctcaggtcatccgcctgcctcggcctcccaaagtgctaggattacaggcgtgagccaccgcccagcctctgattttattagtatgggatgtgacctcggcaatgggagtttgtaaagctctccaggtgattctgatgtgtagcagagtttgaacagtggtttaagaacttggtctgtgagttcacagatgtgttgacttgagaagactgtggaatcacctcatggatagaactcactttttaactctctgacagtgtctcttgcgtttcagctggcaggattaatttgagtttaattccacccatttcactacctgacttggaattgtacctcactgtcaaatgatggtttctccccaaaggttgttcttatacttaggctcatgcagtgatattggcgacatgtctgtaagatccctttgtaaagttctcagcctcatttgactctcttatttccactatagaatatttctttttatgttgttttaccttttaaaactgttttttcttgagacagtgtcttgctgtcacccaggctggagtgcagtggtgccatctcggctcactgccccctccacctcctgggttcaagcaattctcctgcctcagcctccagaatagcttggtgtgccaccaagcctggctaatttttgtaattttagtagagacaaagtttcttttcactgtgctgcccaggctggtcttgaactcctggtctcaagcaatccgcctgccttgacctcccaaaaagtgctgggattacaggcgtgagccaccacgcccaacctaaaaacatttttatgattttaatacatgttgctttttttcttccaggagcaaaataaacacctcttccacataatgcattatagtaataatccacctatggttcttttcccaaaatggctgaccatcagcctcactattgggagacagcagctgatgtgcctgtagtgtttaacggctgatagcgtcttacagatagatagtgatatggtggaaagttggagattatgtaaagaagaattgactcagactttatcctcagagattttagtaaagtcagattaatgtaatcaactggaaaatatagatggattataaaagtatattaaagcagaagtgtaaatttgttggcaagtttgcaaatgtactggattaatctagaaatcatttttgcagtaagtcttaaatagatttttaaacagagatgttattttgtggataaaaagagacaggtaatttacaagtggaacaattcttgataaaggctggggatggcaaatggagtgttgcaggccactaggccagctagctaggctggtatgaaaagtataaactgggtgtagcagttaatgaggaaggattgctgaggtggatagagctagctattgcatgagatttaataccaagaatactttggaagagcttttttttttttaaagggatatatcaggagtttctgttttcctttatgtggttgttgaagtctagttgatttctagtctgtaattttgttgatatttcagatcaccaaacaaggctggtaagatgggttagttatgcttctcttgaggataaagcttttgaaattaactctgcttctttaggtttaagaatttctaattctgtctgtctacatcttgctgctgtaatctccaagaaaagaaaaaggggttaggatgcctctcttttgaaatggaggggtcagagcaggcagggggctgtcactgttgtttctctttgttcagaaattagaacatgtgagcaagtggttccacccctcattttgtgagctgttttcctctgatatttcctaatttttcccatgacgttttagcctgtttcttcacaagattgtaaggcctgaaagaccccattgtttgacaggagtgcaggcttgtgcacatttgctgatctggctgcccggggtctgagtgtgggtggtataccgcccgagggatcatgcagacgggagaatgcgtggagcagactcctggtagttgcaaacactttatgtgtattaagagttcatagaatgtctttttgtagacagaagatgctgcactttgaaaatgttattcacaaactgaaatctcattgacagaagtagggatattccattaggctaagaaaagtttcttaatggcaaatcaaatggatgaaggccttattcaaacttcatttcatcttcagatagattcaaacttttattcttgcagttcacgcacattccttgatggcctgtcttggatttatgtgagcctttggagcagcaatctcacatactatgcatggcaaatcctagtcaatgcatactttttgagagtgcaagatgttaattgtagtaagagaagagaaattcaataacaaatgtttttgaataaaggaagctgaaatttaatactaatggtgttttctctaaatgaagttaatatattattgttgtattaacttttcaggagtttgaggctgcaatgagctgtgattgcaccattgccctccagcctggatgacagagtgagaccctgcctcttaaaaaaaaaaaattctaaggacttgggctctgtgtttgattgacagtaatagaccaatagaagacattgcatttatatagacttataaaatagcattcacatttccaatcagatttacagaattctcccttatttttaaatgttctcagtggtaacagtgacgttgggactagagtcagtattgtgagtcgtttatgcacatctcttcacaactccatgttcagtgagtcatactggcagcttgaaatcagccatggtgggagagtttacaccatggaaatcaaacactacaaattggtgctcctcaccctcagagtctgtttttaaacatttagcagcataccactgcccaaaatggagttgagcagtcagggagtctcctcttgaggcaagtcatgcagtgcttccactcaaccaaacagccaacatgaacattttgaaatgtaggctgtgtggctcctgaagaaaagtccttcatagctccacatttttctgagccaaagccttgctgtgatcataaagctattcatgctgtggccaccaccgtccgtcctcctggctctcacctccagatgcctggtttcacccctttttctgtagaacatcctagacccactcctattttagggccttttctgtagggcagtggttctcaaactttacagcacatcagaatcacctggagagtctgcaaaaacagaccactgggtgcctctctagcatttctgagctagtgacaagtttcagggtaatgctggtggccttaggaccccgcttggagaaccactgcttgaactgatggcctcttggtttacctctcccctccagatctctgatcctctttttctttctctcagtaaggcacaccctgactatcctatgtaaaattgcagcctttctcctccaccacagttctaattcctgactccaatttttatttatttaagttccaggatacacgtgcaggatgtgcaggtttgttacataggtaaatgtgtggcatggtggtttgctgcacctatcaacctatcacctaggtattaagtcccaaatgcattagctatttatcctgatgctctccctccccacccccctctaacaggctccagtatgcgttgttcccttccctgtgtccatgcgttctcattgttcagctcccacgtataagtgtgaacatgtggtgtttgcctgactcccaatttttttcagtgcacctgtcacctgttaccttacaacaagtttcttatttgtgattatcgtctgtctctccccactaactctaaatttcacaaagatagggaattttgtctgtatttttttaaaaaacagggtatcactccaattatccagactggagtgcagtggcatgatcacagctcactgcagcctcgaactcccgggcctgggcttgggtgattctcccccatcagcctcccgagtagctgggactacaggcatgcaccaccatgcccagctaattttttgtattttagtagagagttttgccatgttgcccaagctggtcttgaactcctgggctcaagtgacccacccgcctcggcctcagaaagtgctgggattacaggtgtgagccagcatgcccaaccttgtttgttgttgttgttgttgttgttgttgttgttatgatgtatttcaagcctctagaacagtgcctcgtggcaggtgctcagtaaattgttgaatgaattaatggatgaacaacattgagatatgaataatgtatttcaaattttggtcccagccttttaaattctaactcaccagagaatctgaaaacactttctgcagttttgtttctcagcttcactgctcttaggataatgaggaatggtttctgccctgggctgaagtttgggaatgacttgatgagccttaaaatagcaggtgcaccaaattgttgttcttccatttacattttaacctcaaagtccctaagccagtgatcttcaaactctggtctgcagaagttccctggagatacttcagaggctctgcaaacatctaatttgcatttcattttaatatattttaaactatgttttataactataataaaagaaaatgcacacaaatgtgctacctaccaaattttaacacattaggaccaccagcacattgaattggactgccaagtcaaccttgaaatagtgttttccactattttggcttacatatttgaacttcttataaataaatgaatcattgattaggaacttccatcccagtatttttcatattccagcctgatcataaattgaacaggcaaattcctcttgtcacacatattcagcacacttgatgacatgccaggcagcgtttcagagcctctgtgggatggaggcttctgtgtggattaatggctagttgtacaataagtgaacaccacacacatcacttagtgatgtacattctgttagaggatcatgtctacccactctacattttggatactcttttaccttaaatagttgtcaaattatcattagtgattaaaatttgaaataaaatcttgactgctgcattttctccaagcttttagattagttttgaggcatattatgagattatcaaatgaaatgctaaagaactgttataatttccaatacaactgtgccttacaattcaaatctgctcatttccagaattcaggtgccaaaatttcccattgtaaattccagtgcaaaggaatttgaacttgttatgttcatgtcagcttcgtttctcagtttcagatagtaagtagtaagagtagcaaatagcgagagatttgtctgaaaatttgagttttgagagcagagattcagatagtgttatctgtatttaggagtatcaggattctcttaatacagtgagtgcaaccaaatacagacacagaagtaaatcatattctggatcacttttaaaaatcaattgaggctgagcctggtggctcatacctgtaatcccagcattttgggagctcagggcaggtggattgcttgagtccatgttttcaagaccatcctgggcaacatggcaaaaccctatctctacttaaaaaaacaaaaaaaaaattagctgggtgtagtggtgtgcacctgtagtcccagctacttgggaggctgaggtgagagaatcacctgagcccaggaggtcgaggctgcagtgagctgagatcacgccactgcactccagcctgggcaactgcagtgaggccctgtctcaaaaaagtcagctgatagaagccttactatctgaaagccccactccatctcacaagtgccattgaatacattatatgaaacagttctaagttatacattatggaacattttgtaggcctctttgcatatctgtttattaatttacttaatgctctgttgtaatttgttttgtctcctacactgtatttgagctctttgaaagtaagaattatgtcgtagctttgcttccccagtgcccagcgttgcctaacatgtggtgggtactcagcacatgtttattaagtgttggaagtaaatgctcggtgccaccaagtgaaaatagcacccaggcaaaagttttctcagcaaggcaatttgcttctatagaagggtgcgtctcatggatggagcaatggcgagagcacactggacaaggaaggggaagtgggtcttatccttaacgcagctagtccctactgctgtgtctttcccctattggctagggttggaccacacagtctaagctaattccgattggctgttttaaagagagcaggggtgcgcgccagagtggcgggttgagtagtttcggcaggaaggactgtttgagagcaggtgacagaggatgactaaggacagtgcaggtgactaaggatgactaaggacagagcagttgactaaggacagagcaggtgactaaggatgactaagagcagatgatagaggctaagagggggttgtttactgaaactaggggcaaggagacataaagaacgaggaagttttaaactttaaaatggagaacaaagaacaggagagctgaacatgctgaacgtaccatattggttctttgaagaggaatttactatatcctacataagtgacactgcattctactgcagaaggaagcaagctcaaaaggaacaatgaaacttcatattaaatacacaatcagtgagctttcattctaagcacaaatttcagcatgaaaaaaatgtaatggttctgtgagtccttcacttgatccctcacatacagtcttctaaagttttctgaattccttttacaagtatcttctgactctgactcttccatgccatcctacttgctctgagccttgttcttctctgtgtcccttgcatggactgtggaagccacctcagaagccttctcccagacccaatgtttctgcttcttcacattgttgccattgtctcatgaaataaaaccaagcatatcctttggtctgcactgcctgcaaaataagggctaaacctgtgctttccaaatataatagtcactagccacaggtggctgttgagctcttaaaatgtggcttgtccaaattgagatgtgccgtaagtgtagaatccacaccctgtttcaaagactcagtatgaacaaaatttgtaaaatagcacattaatactttttatattgatagcatgttaaaataatacttttttctataatattaagtaaatttctctctttttatttgtttaatgtggttattaaaaagttttaaattacaggtttagttcaccttgtgtttctgttggccagcactggtctaagctatatcatgacatttagagtttcttataacctggactcagttacctctttggcctcatctcccagcccttcctgtcccttgcagaatttctcataacccccagactcaccaaccctgtttatacttacgggttttaatttttttcacattcagtttcttctttctgaaatgtccctccttttttaggtgtcaaaaatcctgctcacacttttaggacctgacttaattgtcccttgctggtgatgtcacgccctatttcctcaagcagaattagccactccttcccatatagtgtctctcagcacctccattattgcatttgtcttgctgttctgccattaggtgtcgtcttaagtagactcctcaagggaaaggctgcaacttatttctctgatgaccacagggcagtacctcgtgtgtagtaagcacttaatggatgtttattacattaacttatgaactaattttcatcctgctatacacactgctatttttatatacatcagaccttgatcatcttaaccattggccatggaaaaaattagatgctgaggtgtataggactggacctttcagccttaacctcaatttcaggttttgtgttcaataaaatggcctcctttttctcactgggtggcttatgattaaaaaattataactttgaacttaaaaaatccatgaatattgtacagactaaaagtataaaaggacagtataaattactgctttttacctatcttgcttatagggatttcatataagattttgtttgattgaagatttcacttcagaacaagtttggaaagctactgttctattcctaaatttcatttacatttctataccaaaggtttcatttttattttgatgagatggtttctactatcatgttagttcacataaggcaacacttctcaactttagttgcacaaaattgggaagcttttcaaaaatacctccccactcagggatccttgtataattgagctggaggaaaggggcccaggcaccagtatttatgaaaagcacaaatacctgtaataaaatgattctgcagtgcttagaaaaccaggtagttaactatgaaaatactgaagttttaaattgctaatttttctttctttttattaactatgctgttattgtttttcttggcagtcaagctaatgcaatttaaagtttgtattatggttttgagacctcaaacagcatttaatagacgccatcatctgtggacaattttcctaaggcttctgaaattaaaaatttccttttctgtcactctctaaaaacctacatgcagcagaattttaatgtcccttattgatagaaatagctaacacaacacctatttcagatcatggaaatgaggactgacaagggctgtgggtttaagaagtttacataggtagtggccttcctggcacccttgttagcctgaataaacagtcctcccctgacaaatcctctgtagctctgccacattgataaaatctgacattctggttagtcactttttaatgatattctttcttttgttcttgatatgttagaaaccagcccttatttttttcagtgtgtgggaaagaattaactttaatttcctaattcggtaaaatgggctgctaatgcagaccttattcttagggggacaggaagaaaagtgacctaatttctatatatcaaatacatcttccttcatacatttaaaaatgtatagagttataaaggaccttaaatcctgtagcggagaaactctggggtaaatactttggaaacattgtgaaaaaattctataaattctgatagtaggttccatttcattgctgtgtactattaaaaagtgcagatgtaaataagcataagttttgcaggttgtcaatttgttacaagcggctgcatgttcttattcttctgaagtgtcatctctttcaatgtgggctgtttaggcggaaaaaaaaaaactcagaaaaatacacacttgggatcaaacccttagtgcagaaaaaagaatcaaaacctgtagttaagttggttatttgcagtggtggtatgtcatcctgtgtgagactgacgtcaggcagattgaatgcagaggcaaacttcgggagcgtgtgtgtgtgtgtgtgtgtgtgtgtgtatgtgttttaaagccccactcccagaatatgaagtgagtatgaagggcaccacagcaacccctggatctctcaagaatgtacctgtttttaacatgctggatcaagtgtcagcactcagtagatgaggaaggggtagagcccgacttgtacagattccgcggatggtaaatggccctctggcgtgtttacaatacagctgtgcattcttaatggctctgccgctgccatgtcaggtaaagttttctttgtacgtgatgaatggcagagaattctttagcagaaggaaccaaaggagctgggaggaggaaaggggaagagaagagcggaaaagagagagaaaaagaaacacacagctccagagggacatagcctgtgctttgcagttgcttgtgtggatagaaaccagatggtaagctggaacacccgcttggctatctgaggagccaaacatatggttaatggtcgggagaaatagctttcagagccagggctttgctgactgcctcatattacagattgttacagtgtgtcattacattgccaacctaagtgcttaatacccactgcaggcgctgggcatacacttacaagaaagacttttagctctttgctggctctaaacagagaagtgacatcatagggaggctgaaaatgtctggtgttggaggtggggagaaggataattttgtagtggaaacaacaattttttttcttttttttacaagccttcactccactgaagtctactgttttctgagaaccttttaatactagactggttctctcactctctcaatctctcttgcgtgcactctcactctctgtgtcacacacacacacacacacacacacacacacacacacggaaaggaaaccgaaattcacagcccaggccatgtcccccaactccagtggatttgacaggcctcgttcacctggaagccacatcactgactcagaggccctgcatttgaagtttctgtttggggagctttgggcaacagcaggcctgtgttatctaaggaactgctgagcccattcatctgcttttcacggcccgtttccttttatttttagccaaatccgtcaggcctgacaggcgggtaattcgagccagagaaagggcagagctccaggtcctttccacaaagcaattcttctcctccctcctgggagggctccagacttggcctgcttcaggcagatggatttgttgagtcatgtgagatcatttacacaaaaacacagtgaggcagtggaaattaaaaaaaaaaaaagaaagaaaagaaaaagaggagggtgggggaagaggaaagaggggaagccaggggaatgtgcgctgccctgctgctgaggagcataggaattttgcagtgaggcagctagactgaggaatgcctagagtcatttgtgtataaggtaatgtctagtttacagagtggggcgggccaggcgaggacggcgcctccagcagcttgcctctgtttaaaagaagaaggtgttgggaaactttaaaaaaatttttagagcaacacccaccaaacaaagaccacactgttgacagcgttgggttccagtagcggtaaactaccaaggggctggtttacagaaaatgagtttgctctgtgatgtcatacaagtttgctttgtcctgacgccaacatgacactgaggcagcagaggagggagaacaggaaaattggaaccgtactcttagttaatggtttccagagattatttagcaggacttgaacagagggaggaaaatattgtgaaggattgctgcgaggtgtaccataattgcggtaggtaaaacaaagtcattactatggttttcttgctcaagaaggattgagcaatgacttcaaaatgccaagtaaggtattatttttccctaccacagtatttattttcctttagcttctggggcattaaaaaaaaagaccaactctcacatcatggcaaacagtattaatgttagtgaatcaattttgtttactgtttataccacaagcctttaaaacattccattaaaaaattgtctcccgctcattcatgaaattctttttttccttcaaatttgcttacatgcattagctttgtttggatagggactttttccctttttggctggagtaaaagaatgcataaaagaatagtgagtagattatctaaatgtacattcttacaacaaatgtaatgaaaatatgccgcgtggatgagagggaatatttgaaaacagaaagaaaaacagaaatggggagcatttcaaaatagtcaccctgattatctttgttatgatgcatttcttcaattctgcatttatttagaaccctattgtgcagctatttcttttagccaccctagatagaatgtaggtcaacatcaacattgttcctcatattttgttggtattttaaaagttgaaacattttgcagttttttccagagctagatattcttaggttatttagacggttttagtgaccatagaacttcacgtataaactccttctgttaatagctaccactgaattttgatagtagacactcagatcacaccttgacctggagtaaacaaggcactgatgatattgatgataacatagtccaacactgaagctgttccacttcttccaggcaactctgatggtcttactctgtgtaagttacagcttttacttcgctcaaggagagaactggtaaatttttatggttgttaattgtttacattttggggaccccaagttgcatggtgccacattattataatgtgattatgagttggcatgattttaagtctacccatatccttgaatgttccctccccgtcaggatttcccaatctcagcactattgacattttggaccagtaatactttattatggggtgtgtcctgtacgtggtaggatcttcagtagcatcattggtctcacccactagatgccagtagcaccctcccccgggtcatgacaaccaaaaatgtctacagcattgccagatgtcccctgggagacaaaaccactctggttcagaacttctgctccacatttcttactctggtttagaagctcacgctttacgtcatgagctggctgctcagttacttctaagattgaattaaaggatatgaaataatgttttaagttggaattccaagttaagtaaagtttttgaaggtgcaggcaagagtacttttgagtatggttatgcagaacaacctctctcttggaattgcgaccttagcaggtggatcccctcaggactcccttacagtgagtttcccagtgctgtttaagaggaaatgaccccaccgtctgagccgagggaagtcgacattagcagaaagggaacttcccctcagtcacctgagcagacagcctaggccccaggctcgctgcctgtatatccagccccagaaagagggcaaggcagcagccacagttctttcttgggagcacagctgacctcctccccattccagcggctgtggtctcagaagctgaaactctcgttaataaggaatgtggagctttccacagctaaggcaagcataaatttcctctgtttgttttgtgaggactagtgtcaactgctgtaatgagatcagagaggaccccagggtcagctgctggaactgctttctgtggctgttctcttggctgcttgctgtcggagaacgcagtgactccctgcagacctccctgatgtgttaaggtggttgtgcccttgttgcatttcttgctgtctttgcttctctcattctactaaaacatcagtgtgcagtcatccagttctaaattatggaaaagttaatggaaggcagattcctttccacagaactgagggcagacttgggtgtggaaaatgcagccttgggaaggaaggtgacctgtttccttggggtaactgcctggacctgctgcttctggctaagggtaggtttctcaaggcctgggctacccgtaagcactttctacccccaatggcactctgtaatgaggatgagttagtgaaagagtcacagcaattagcttaggctacaaagaacataattctagttgtagcctaaatgacagctagaattggctacatatggaacctaaatatggcagaattgcatttagggaacccaattctggcagaatggtatactgagctcatgcagcctggcctacttctgaccacccaccccaaaaagtcctaagcctggcctacttctgaccacccaccccaaaaagtcctaaggtattatattggttaaatattttcaagtacatacgagctttaaagcaggacagggaaattcttaggtgccagaagacattgatgccactggccttagagtgtttcagacccagctgtaggctctaggctctaggggctatggtgtctatactcacacaggaattgcttgtgaaaggggggcaagaagattttccccagtctgtttggggctttaagtctgtgtgttggggcacagaccagggggatggaaacccagggttacactgtttgaatagctctggggttcatagttacactactacctgcatggtataacttcaactgttttggcagaaactggtttgagagcattgaacgccctcaggccatagtggaggcaaacactagatccctgtggagaggcttaacaacctgggacatggtactccctcaaaaagaataagctgcactaaggagatgctgataataagtacagaatatggccagatacagtggctcatgcctgtaatcccagcaatttgggaggccaacacaggaggatcacttgagcccaggagtttgaaaccagcctatgcaacatagcaaaaccctgtctctacaaaaaattatctgggcatgggtggtgcacacctgtagtcccagctacttgggaagctgaggtgggagaatcacttgagcctgggaggttgaggcttcagtgagccaagatggcaccactccactccagcctgggcgacagagtgagaccctgtctcagaaaaaaaaaaaaaaaaaaaaaaaaaaggaacagaatctaagccccagaaaagcagaggttaacagtgaaccttcaggccaactagagttttcttctgcagattaatgaaagtttcttctcaagaggaacaaggcatataacccattctggcttgctaagcagtttcagttgtaagcactagccccaattaaggtaacatcctacttatagcttgtccccaagatcttcttgagaatattttagttccttaattagaaactttttattggagagatagctggcccccttaacgcttctttaacagtgctcccattgcagtggatcactctgaagtaacccatcaggctgtctgttatttcagtttctcaccaaatcataggaaatatgtttgcctgaattgtacagcaaccccctccccccgccccgccaagggagagggaagttgaaattatttggaggggtctgggattctttcagcataaaatcaaagaaacccaggtaaataagacatggttagtaaacatttgttctagatgaatataattcagccttctcaatccaaagtgaacaaatggatcaagagttgcctggaatagccactgtgtactccctttgcagtgacgtgcactattggcaaacatgagttgagaatgctaaacttaatgcatgattccttaatttattaataggacaatgaaatctcttttgtttagttttttttcttctaaagtgcgcaaaaagctgtcaccagtagtacccaaatagtgccttgctgacctaaaagtgtgccatgcttcttaagaaaaaacttcagtatttattcttaatttggacttctataaagtttaatttcaaaatattctgaccaagcgagaagtagatatgaatattgacattaaagcatcagaagaggagagaatgaaaggaaataggttcaactggtgccagacttacaggagatcttcccaaacattataattaaatttggcatatattgagtgcctactgtatgtatgtaaggcagcgggataggtgctgggtatttgggtactagtacaaaatagacaagatctcttcttgtgaaatgctcaaaacaatcctcaaaagaatctccagagatataaagaatttcccccagctttagggataaaggaacagagactgagagagagccagtaacttgccaaaaatcacattccgagaggtggagttgatattcagactgacttggcccctatctctctttgcctactcttctccctggctttctgtgggcagtgaagccctagcagtacaacccagaggggccaagaggcaggtagagagttttctctcccggaggtttacaggaacaaagaatcccctgactgacatggaaggtgtgcagtagaagaggcaaactagccaaccagacccaactcctacaaaatttccaaagtattagcatgagtttccaacattaaaacagcaaattattttacacagtctctcaactccgtttcttgagtatcagaagctcttggcacatggggcttgttcctgctttgctggggctagagctgagtagcagactccccggatgccccattcctcactgtcttcccagacctgacctttcactcatctcattctttcttgacccttgcagtcatctgaatttgtgacccctggtttaaatagtcacttaggcaagggaagtgggccaggccaagtaacctcttgggggctcctctgtgttgtgcctttaaattgagatagtcctaaatcactggagactgcgatttacattttacagtgatagccctgaatctaaagattagatatcctgacttatcatttgaccaagtgcaagaaccccctagcctgtgtgccagaagtgggtgtatgaaagtgatggaccctctaccacttgtcactcttggcccttcctggcctctgtttctccccatctggctctcagactatttgtgtgcgtgtgttaccaacaatgtgtctctcttttataatttataatcctcttgtttcctcctctttattaccatttcctattgaaccataactcatatattagttaaaatttcagaacattcattttcaaattacctaacctatccttggggaggaaggctgttgttgatgcttgatgggaagatgctcttgttgttctggcttagaatgtctgttttccatggtatgctgtgaaggcagcgcacaggggagcaaagcagaatggcaaacgtctggtctcttggggcagaaccatgttatagtgtgtttgctgcctccatgtggggtggcgaggacactgaagtcatggagaaccacagccacacatctgctgtaactttgaggatggagagggacctgcaggaatctccttggcaagctccactctgttcctcttgcctcttctttaggaagcagggaatgagccagccacttggaaagaaggtgtgtatgcattgggggaagggggcaggagtctagtttctttgcctttggatccttcaatcccagcaccatgccccctatggtagaagggagggattagctttctgtaataaaatgaccttatattttttcagttgaaagtctccagttgaagattgtccagacttaacttcaaagccatgtgaattactccaccccttaaaatagagtagaggaaatttgggatattgctctcacctgtccatctgatttcccaagtttctaagtcctagatgcaagagcatttttttctagacttcagagccggttcaccttgtattacttcacttactccttctccaaaagctcttgggcctggcataggccctcatgccccagccctctgcctaagctgctgggcgtggtggtgggaagggtaggaacaagagtccatcccacagactggcctcatggtacgttatgtctaaaagctagtgagacctttaacactgcgaagagtgacctgcttgctcttgttggcctatctatctcccacaggagtgcctgagctacccagctttgacatatattactgaaggcttctagaatggacatcatagaagggggtgggagttggagtggggagaaaagcccaactcaccatattccattcagtatttggcagtattagttgcattttcaagggtcaggagagcacacacacacacacacacacacacacacacacacacacacacagcccttgacacttttaagcttctctttaaagagcataggattaaaggtggcttatgttattctcagcatacctctataccacattaacagtgatccaggtaaaataggcttctctccatggtagatggaggttgatggtaaataaatagtggtgaatcaggtacgcctggtgttttctccaactcccatttgctgacacccaagacatcagagtataaccctcagagaagccataggatgtggaattgtcaccaggagcccaaatctctgggtctcttccatagcgaggacctggctggtgaggggcacttggccatgttaccaaacctatctctgagtgtctttgtttgcttgccgccctttgtttttctccattctttatatctttcatcttttcttgtcatttctctcttcttcttagacttactttgtctctgcctttttttttttttttttttttttgagatggagtctccctctgtcacccaggctacagtgcctctgcctcctggttcaggctattctcctgcctcagcctcctgagtagctgggattacaggcctgccccaccatgcccagctaatttttgtatttttagtagagatgaggtttttccatgttggccaggctggtactcctgacttcaagtggtccacccgtctcagcctcacaaagtgctgggattctgtaattctggaccacctttcttcttacccatgcttctatccacctggaaagacaaattatgtttcattaaccttttagaagtctaagattgaccattgaaccaactgttaggatcagctgagtggaagtcacacgggcttatgggattaactttctcaaggcaccctttaaagacgtctgtagttttccttttgttcagtactagaggaatccaacttcttaaaacaataaaaagaaacattgaataataaactaaaaaagaaaacattcttgattccaccatggtaactcaggtatctttttccctaatgctttatatttaagatgcagtctccttttttaagctgtagattttgctaagcttcttcataaactgaattggctgcaaaacaaccaggttccctcgatttcaaaggagatggaaagtacttgatagaacaaggccagtctttttggttgctgtccagaagtgaactgacccagtttctaaaattgtcatctgttctctgaggcgttttctgttaaatggtggtcttggtgtgtgcatgtgcgtgtgtgtgtgtgtgtgtgtgtgtgtgtgtgtgtgtgttgttttggggtgtgtgttgtgtttattttttatttctggtctttcacatgctttatttccatagcgtcttgaaatgaagtcacttctagtccagggtctattgcttattatagcaagaaccaggaaaaattcttttacctctctgtgtctggtttccaaattaggaaaa

SEQ ID NO: 1023 - DNA, 9120 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcattcattcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacgtggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctattcaccgggaaccctccctgtccccttcccgaatcacacacataccctaccctcacctgatgataattttctcttcttgctgcaaaactggttggcttgcaacccagagagagcagcttcccttggctctgggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaagggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactcgtgggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtcacaaataggtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaattttaccttttgggggaaaaaagcattgctatgaactaatggaattggaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 1024 - DNA, 2516 bp, Homo sapiens
atgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctag

SEQ ID NO: 1025 - DNA, 23070 bp, Mus musculus
  misc_feature (370)..(389): "n" at positions 370 thru 389 can be any base
  misc_feature (3127)..(3343): "n" at positions 3127 thru 3343 can be any base
  misc_feature (17723)..(17758): "n" at positions 17723 thru 17758 can be any base
tgaatgcttgagataacccaaatgcatgctccacgctcgcgcgtttgctgcacaagagatgagggaggcctgagaggatcccaaagtgagcccaacttcaggatagcgggggggggggggggtcctgctttctccaaggacgttcccacacaaatgtgaatacgcatatgggcataaacaaaaagctacaaagtgaacctttaattttttttaatgtgtgaacaaaacaacaacagcaaacaaaacaaaacaaaacaaaaaaaaaaaaaagaaaggcctccccaaaacaaagaagacccagcagatgaaagaaagtgtttgctgactggggcgtggtggcacacccctttaatcccagcacttgggaggnnnnnnnnnnnnnnnnnnnntgggagccgaggccagagagtggttccaagagcctgacctcggacccttctaatctagcttgcctggtattgccagcacgaggaggcaacacccctcacaggtggtggggaacccccttctaatccctccctctaaccctgtaagggcgggcagatcagttgtggggcccacagagagggagcggttggtgaggagggatagagggtctgagagaaccggtctcaaatgggtatgtgagtgtcccaggaccctgcgtcgtgtgtgagctggctccccccccgcccctgccagaccgcagccccaagcacagcatgactggccctgcgcacccaagtcacatagatccagagccgaccccccaaggaaacagaagcacagggctggtacccacagccacaaccacctcttcattggtggtggctagcagcaaggctgggcaaccagcccctggtctacattcttgcaagtcttgccttgtgttgaagaggcatccctggctaggtgtctagtacaaaggaagttaggtatctggggttactattgagtgcttccttgatgagggtgctggagccctaagctagaccacagcgggaggtgctctttctgagtcccccacctctggagtagggaaaaggcagcccaagagctccttcccatttaggggaagaaggccaaaccatgtataacttctgagatgggccagcactgtctcagtaacttctaccctactccagaacccaggatcctcaccagtgccccatcctctctcctgcctgtcagcctgggactcacccaggccctggaagggtatttagcagatccttcatcagtatctcgaggatattcacgtttctcccgtggctgcagttccattcacacgttggattttgtcttgttcctatttgtccctaatgctatctttacctcctagttctatcattcagtcagatgtcaagaagggactagggcaagctggggcaggtagagctgtgtgtgtgtgtgtgtgtgtgtgtgtgtgtgtgtgtgtgtgtgcgcgcgcgcgccatgcttttactcccaacacttgggaggcagaggcaggtggatctccttgaattcaaggccagcctggtctactatgtagtgagttctgggacagccaggctatataaagagaccctgtctctaaaaccgatgatgatgatgatgacgacgacagcggcaacgacaataataataataacgacgaaggtgatgatgatgatgaaggggctaaggaagattatagcgcccagaggttcaacttcttagtggtctgggggctccccaagttgaactgtcccaaacctaagaactcataccgctgttctctaacctctctgaagtcttgctctttgataagaggccacaggcaggcagtgggtggcctgagctggccgagggtgccctcttgccgaccgtctggcctgagcactgacccacaggcagctagagggcggtgggacaggcggggcctggagaggcctgcgggtgcacacccattgcctaataccccaagcacgcagccagctccaagaaagaggaggggcaggaaccagagagaccttgacaagggttgagacctagatgagagggggaaaaaaggggggctgccatcactgcagggaggaaatgagagcaacctggcccatcttccttttgatgagaaaagtggaaggcccctccggcccttgcggggatggggaggggggacgtgtagcaaaacactgtgggaagaacaacgaggccctgaagggcggggagtgtcaaataaaagagtggggacctctggagatggggaaatcaagcaactgaggcggtggctaaagccgggctacactcgggaatctcctcctcctccccctcccctgatgtttgccttggctggggtcttgggtgactcatctgttgctaagccgctgataggggcggccagcccagggaacccaaattataggccctggagggatggatgcgcctgcggcggtgagctcagctgtacgcctccctccacctcaccggtcttccactgcagcaccgaaggccaccacccagaggcgccagagatgttgcagacgaactactggactccagagaagcccccacattcagtagtagccccaaggagtcttctgactcacccaagacagaatgttacccccttgtctactataggttgatggatgggttacaccctcccagcccgagggggtagcgcctgcctgggcttcaaaggcttgcccaagaactcagagctctgctccaatgttctctctctctctctctctctctctctctctctatacacacacacacacacacacacacacacacgtctaagcaaagctttcaccctcccccaccgcctccctcctagatctattccaaggcctgtgttttgctacagagtttctacttcaattctttagttaactgtagccaaaagtgacagcaagccgccccctgtcccatatacctagaataaggaagttgagggagggagatcaagaattccaggagagcagatctacagatcagcatcgaagagctcttgttgcttttgtagaagacttaggttcaattccccagcgcccacaaggtggctcacaaccattcataaccttggttccttgggaatcaataggtatgagtgtggtgcgcatatatacgagcaggcaaaacattgaactacaaagaaaaacaaatctaataaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagccacatgtaacccaggctagcttcaaactcaatatgcagttaaatatgacattgaactctgacctctgcttctcaagtgataggactatacatgtcagtgaacatggctttatcttctctttatttttaccatacctatggtaaagcttaggacctcacatatgctaggtaagttgtgtgtgtgtgcgtgtgtgcgtgtgtgtgtgcatgtacacatacgtgtgtgagcacatgcaaaggccagaggtggggatgggtgtcttcctctatttctctttgccctatatattttttagttttcatcttattttcatttttaatttatttattattagtgtgaggggttgttgagtgtgcatcgtggtgacagccattctctcccctctgtccccacttcagcagcggtactcatagataatagggtttccctgtcttagattgcattccaccaccagagatcaagaaaggtacatgtgtgaaaggtctcagtcagggtgttactgctgtgaacagacaccattaccaaggcaaactcttttttttttttttttttttttttttttttttggtttttcgagacagggtttctctgtatagccctagctgtcctggaactcactttgtagaccaggctggcctcgaactcagaaatccacctgcctctgcctccctagtgctgggattaaaggcgtgcgccaccacacccggctccaaggcaaactcttataaggacaacattttttaaaagatttatttatttattttatgtatgtgagtacactgtccctgtcttcagacgcatcagaagagggcatcagatcgcattacagatggttgtgagccaccatgtggttgctgggatttgaactcaggacccctggaagagcagtcagtgctcttaaccacgaagccatctctccagcccaaaggacaacatttaattgggcctggcttacaggttcagaggttcagtccattatcatcaaggcaggaacatgttaggcatggttcaggaggagctgagagttctacatcttgttccgaaggcaaacaggagaaggctggcttccagggagctaggatgagggtcttaaagcccacaggcacaagggcacacttcctccaacaaggccacacccactccaacaaggccacaccccctaatagcggtactccttggaccaagcatattcaaatcatcagagtgacccaggcctcagtgatgaggaatttctcagggacaaagtcaggcgacccatctatagtgctcattcccttgagccttctgtgcagggtactatgtggagaaattcctagcttacggacatgtgtaggaagctaggccattccatattatacctcagaaattcatctttggaggaagcagagttctaggctaagagagagcctgggaaagacatttccattaacaataaaataaaataaaataaaataaaataaaataaaataaaataaaatatctcagcagctagaggcatggctcatcggttaagagcatcggctgctcttccagaggacctgggttcacttcccagcaaccacatggcagctcacagctatctataactccagttccaaaggatccagcactctcacacagatatgcatgtaagcaaaacaccaatgcacataaaatgaaaataaatttatcatttttaagactccaccaagcttcatttgggttgatgtacatcttgttctaaacacattcacacctattgggatgactcagaaagttatgggacctgtgaccaaatctatcgactcgagttccatccatggaacctttgtactaaaaagagagaatcaattcttgtaagttgttctctgattatgcatgctatagcagtctcactcatttgcttattctctctctctctctctctctctctctctctctctctctctctctctctctccacacacacacagacactcaggcacacacacacaaagtgattaaatgtttaaattaagggctggagagatgattcagctgttgagagagcactgactgctcttccagggtcctaagttcaattcccagcaaccacatggtggctcacaaccatctatagtgggatccgatgccctcttctggtgtgtctacagtacacatatacataaaataaacaaataaatctttaaacattttaaattaaacacaagtgccccaggaacagtaactaaatctatcagtcatttcttcctcagagtatagcttggcgggaaaggctgatccattctgagagtcaagctcttttagagtcagactcagggagtttagtcagaaatcatacttaaaaagcagacgagatggaaacaaaaggtgccaaaaaggtggcaggccagacctaaaagtcactttctttctgtgtcaactctgaaaagggaccccagcctgctctgctgcatatcaggcagccactgagccactgacgatgcagaaagagtgtgcataggctttgagttcaaaggggctgtcaggtctgggggagggaacatgcccctaatctccactggaggactggaggaagagaggtcagaagttcaaggctagctaagaccgtatctttaatttgaagccagcctgagctacataagaccttatagcaacaaatacgcaaacaaaaatcaaaaccaaccaggctagaaagatggctcaacacttaagagcgcctgcagaggggtgggggtttaattcccagcacacacatagtggctcagggaatctgaagccctcttctggccactgcgtgaactgcatgcgcatgatacatgtgcatacatgcacacaaaatactcaaaacacattaaaaaaataagtctagcggtggtggcacacgctagcactcaggaggcagaagcaggcggatgtctgagtttgaggccagtctggtctacaatccaagttccaggacagccagggctactctatctcagaaaaccaaataatcaaaccaataagactcctctacccccaaaaaacaaaaaagcaaaaaataacaactgggtttgggtttagctttgagataagattttactatgtatcccaggctggctatactagaactggttactatgtatcccaggctggctatactagaactggttactatgtatcccaggctggctatactagaactggttactgtgtatcccaggctggctatactagaactggttactgtgtatcccaggctggctatactagaactggttactatgtatcccaggctggctatactagaactggttacgtagaccaagatagcctcagactcacagatgtgactcacttgcttcttaactcccaagtgctggatttacgaccggtgccaccaagcctggtgtccccaaggctttttaatcctcctgcctcagccttccaggttctgggactggcaagcatgtgcccccacacagagttggcctggggattgtttattctatttttcattagttattattttgttgttgtttgagatgggatctttctacatatctcagggttgtctcatgtttggagcaatcttcttatattttattgtatgtgtgcctgcatgtgtgtacatgcgtgtgcgctcatgtgcatgtgcgtatgtgtgtgtgtatgtctgtgtgtgcatctgtgtgtgtgtgtctgtgtgtattgtatgtgagcaagtgtgcaagctcatggagatcaaaagacaagtgtttagaatcaggtctctgctttcatcacatgggccccagggatgaggcgcagctcacctggcttgccagcaaacacttgtttgtttgtttggttggttggttggttggttggtttttggttttttcgagacagggtttctctgtattgcctggcagtcctggaactcactctgtagaccaggctggcctcgaactcataaatccgcctgcctctgcctcccaagtgctgggattaaaggcgtgtgccaccacgcccagctcagcaaacactttctttcatctgctgggtcttctttgttttggggaggcctttcttttttttttttgttttgttttgttttgtttgctgttgttgttttgttcacacattaaaaaaaattaaaggttcactttgtagctttttgtttatgcccatatgcgtattcacatttgtgtgggaacgtccttggagaaagcaggagcaggagttacagacagttataagctgcctgacctgggtgctgggaaacacctcaggtcctctggaagagcagtaagtccccttaaccaatgaaccatctatccgtccagcctacatttaatttgttttcttatttactttgtctgcatgtgcatgtgtgtgcatgggacactggatgcctgtggaggtcagaggtcagtcttctctccttccatccagcgacgctcggggactcatatcctcaggcttggcagcaagtgcttccttgtccccttagtcagggattctccatgtagccctggctgccctgcaactctcaatgtagaccaggctagcctcgaactcacagagatccatctgcctctgccttccaagtgttagggttgaaggcttgcaccaccacaggccttgctttgggtttttgagagtgtctacagaatgctgggaggtgaggaatagccttgaacttctgatcttcctgcctcccaagtgctggggttacagtcatgcgccaccaattcctggcttttgcagtgctggtgatccaaactagggcttcatgcaagcgaggcaaacacggtatcccagttcctgggaatgtggctttaacatggattcatttattagcagggacctgggacctgaagacactgccttaccaagcatctcctctgtgaaatagaagagaggagaaatattaagatcctgggaagggggcgcttccctgtgtgacagtggtgcgtgataaccaggctggcagtgccctctgcatcccacattgggaacagcagcctgatactccaaggctgccatgaccctgaagatcactggaatcaggaggaaagtagaatccacaatggaagagttaaggctcttgggtaagagtgggagaaaatgggggtggggggtggggacactgcagaaacctgggagaaaaaaaatccaactaaaatcaggaaacacatggaggcacaaatttgctaatctttctttaaaaaactgtttcaggagatttattttatgtatgtatgtatgtatgtatgtatgtatgtatgtatgtatgtatgtatacgtgcacctgtgtgtgcttggtgtcagtggggctcagacatcacctgattccctggaactggagttacaggtggctataagccaccacttgggtgctgagaacagagtccggggcctctggcagagcagtcagtgcttttagccactgagccatctctcattccccccaattatgttcatcttgagttgggcaggtacggtggcggaataggcctgtaatcccagcagtcactggaccatcatgggttctacatattaaacctttatgttaggtagggtcacacagcaagatccggtcacaaaaccagcaacaacaaaaccaaaaggagccagcttcttcccacaagcattctttccctcaggtcttcagctccatctgacagctactcggctggtggtcctatcctttctgagcctagttgccagagaaacaagcccggttcatcttcatgactagcacatctaatgataagcacaggttgactcaaggtgccatagggtgacactaggtacccagagcgacagaatgacacctatgagtgcacgtcgttaatcacaaacacacacacacacacacacacacacacacacacacactcatgcacccacctgcaaacacaattgcagccttctggacgtctcctgtcacagccccacctccttcctgatacactgcgttaagtggtgactgtaacaaaatgacttcatgctctccctgtcctgagccaaattacacaattatttggaaagggctcaaaatgttcttcgttagaagtttctggatacaccaatacacaggagcgtgcaccctcagaacacatgtacactttgacttaatctcacgggtgacacaccgacgcttacactccccctagcccacagaggcaaactgctgggcgcttctgagtttctcactgccaccagctcggtttgctcagcctacccctacaccccacgcccgggaatccctgaccacagctccacccatgctctgtctccttcttttccttctctgtccagccgtcggggttcctgggtgaggaagtgtctccacggagtcgctggctagaaccacaactttcatcctgccattcagaatagggaagagaagagaccacagcgtaggggggacagaggagacggacttcgagaggacagccccaccggcgcgtgtgggggaggcaatccaggctgcaaacaggttgtccccagcgcattgtctccgcgccccctggcggatgctggtccccgacgggctccggacgcgcagaagagtgaggccggcgcgcgtgggaggccatcccaaggggaggggtcggcggccagtgcagacctggaggcgggggccaccaggcagggggcgggggtgagccccgacggttagcctgtcagctctttgctcagaccggcaagagccacagcttcgctcgccactcattgtctgtggccctgaccagtgcgccctggtgcttttagtgccgcccgggcccggaggggcagcctcttctcactgcagtcagcgccgcaactataagaggcctataagaggcggtgcctcccgcagtggctgcttcagcccagcagccaggacagcgaaccatgctgcctgcggcccgcctccagacttattagagccagcctgggaactcgcatcactgccctcaccgctgtgtccagtcccaccgtcgcggacagcaaccacagtcgtcagaaccgcagcacagaaccagcaaggccaggcaggccatggggctctgggcgctgctgcccagctgggtttctactacgttgctactggcactgaccgctctgcccgcagccctggctgccaacagtagtggccgatggtggtaagtgagctagtacggggtccgccacttgtcctggggcaaagagccaggcacgggccttacccagctcccacgctgtggggatcaccaacctacagacccccctcgtgcattgtgacttcacatccagggtgctcacacctagaactagctctgctgaagtgggggcacatcattggcatgcagaagcccagatacaccaggctcagagaccattcccatttaatacgaccccgtttctgctgagcaacaggtcccaacctcgctgtggtgggtgctcaggtgtcccttaggtcttgaaccaaaaaaaaaaaaaaaaaaaaaaaaaaaaaaaaaaaaaccagatattagctttgaggtgagggagtggaattcctaagtttttcaaggtgggcaaggctgcaggtggggtttctcctcgggggctgacttgaagaaaggaagagctaaggtagccatgccttttctgtccactcactagactctggagctcagggccaggcaaggatagggtggtacagcctgtatggttaggatgcaggtcccctcccctggactgaacccttatgcatcccgccaggggcatcgtgaacatagcctcctccacgaacctgttgacggattccaagagtctgcagctggtgctcgagcccagtctgcagctgctgagccgcaagcagcggcgactgatccgacagaacccggggatcctgcacagcgtgagtggagggctccagagcgctgtgcgagagtgcaaatggcaattccgaaaccgccgctggaactgccccactgctccggggccccacctcttcggcaagatcgtcaaccgaggtgggtgcccaggaaagcgacgcttccgggattaagggaaaagcagggtcatctccagggcataggcgggcgaaggcagggaagacatcccagggttatatgtgatcaaactgagaatcgcctggtgccggcagttaccgtaggtcagcaccagattctttctagccttgcgttgtgagcatgatctttaacgttgctgagccactggcccacagaaagggaattccggatcgtgggcgctgggcgacagctgtttttccctagccttcctcaaaggtacctgggaagctgatctctgagggctagctagggttgtgcttcgcacccagcaaagtttgcactgccaatactagtagcgatcttggctatgcagatttgttctacttgggaatctccccttggagctgctctgctaaggctctggagtctcagtaaagcttagagaggagggcattccatgcttcgcacacatgactccaaggatgttggactgtagggtaccaagtcttccaaacagggtgctgagttggccccacgccttctctcaactgatgcggggtcgcttcacccacaggctgccgagaaacagcgttcatcttcgcaatcacctccgccggggtcacacattccgtggcgcgctcctgctccgaaggctccatcgagtcctgcacctgcgactaccggcggcgcggccctgggggccccgactggcactgggggggctgcagtgacaacatcgattttggtcgcctctttggccgagagttcgtggactccggggagaaggggcgggacctacgcttcctcatgaaccttcacaacaacgaggcagggcgaacggtacgtcggtgtgtccggaaccaatggcaggggagatgtaagacaggtgcacggggacagaggcacagggaaggggcttcccgagagagtgggactctaggagggaagacagagaagaggtggtggttgagggcaaagaggttcctgagctgatgacagaacagaagagattagcaggctatcaacacgtgggatgtattgagatggctccatggcacacttttgaaagataaaagtgacttgctggcgtggagcagagtctggccgaatgtccctatctcagcgggccattttgcacttcctctctcccgagcttagtcacacctggaccttggctgaagtttccacagcatcgacgtgacccgggtggggtgggggtggggaagtatgggtggtggttcgtgggatgttggctttgaccttttcttccctcctcccctcgtcccctcctcccccagaccgtgttctctgagatgcgccaagagtgcaaatgccacgggatgtccggctcctgcacggtgcgcacgtgttggatgcggctgcccacgctgcgcgctgtgggcgacgtgctgcgcgaccgcttcgacggcgcctcccgcgtcctttacggcaaccgaggcagcaaccgcgcctcgcgggcggagctgctgcgcctggagcccgaagaccccgcgcacaagcctccctcccctcacgacctcgtctacttcgagaaatcgcccaacttctgcacgtacagtggccgcctgggcacagctggcacagctggacgagcttgcaacagctcgtctcccgcgctggacggctgtgagctgctgtgctgtggccgaggccaccgcacgcgcacgcagcgcgtcacggagcgctgcaactgcaccttccactggtgctgccacgtcagctgccgcaactgcacgcacacgcgcgttctgcacgagtgtctatgaggtgccgcgcctccgggaacgggaacgctctcttccagttctcagacacactcgctggtcctgatgtttgcccaccctaccgcgtccagccacagtcccagggttcatagcgatccatctctcccacctcctacctggggactcctgaaaccacttgcctgagtcggctcgaacccttttgccatcctgagggccctgacccagcctacctccctccctctttgagggagactccttttgcactgccccccaatttggccagagggtgagagaaagattcttcttctggggtgggggtggggaggtcaactcttgaaggtgttgcggttcctgatgtattttgcgctgtgacctctttgggtattatcacctttccttgtctctcgggtccctataggtcccttgagttctctaaccagcacctctgggcttcaaggcctttcccctcccacctgtagctgaagagtttccgagttgaaagggcacggaaagctaagtgggaaaggaggttgctggacccagcagcaaaaccctacattctccttgtctctgcctcggagccattgaacagctgtgaaccatgcctccctcagcctcctcccaccccttcctgtcctgcctcctcatcactgtgtaaataatttgcaccgaaatgtggccgcagagccacgcgttcggttatgtaaataaaactatttattgtgctgggttccagcctgggttgcagagaccaccctcaccccacctcactgctcctctgttctgctcgccagtccttttgttatccgaccttttttctcttttacccagcttctcataggcgcccttgcccaccggatcagtatttccttccactgtagctattagtggctcctcgcccccaccaatgtagtatcttcctctgaggaataaaatatctatttttatcaacgactctggtccttgaatccagaacacagcatggcttccaacgtcctcttcccttccaatggacttgcttctcttctcatagccaaacaaaagagatagagttgttgaagatctcttttccagggcctgagcaaggaccctgagatcctgacccttggatgaccctaaatgagaccaactagggatccaggtctcctgagagaaaagcctgctcaaaagctcctgcagggctcttcctcctgttctggcagcagctggttaagtgatgaggacaagtgtgtcacctgatggggactcagcacaccaacagtccagctctcctagtgcaagagctggggaggtagcagcaatgaaaggaaaggatagccatgactacatcctgagaggggggggggggaagctcaagcagaaagggtgtcattgcccctgggaggctatcaaccttttctgcagtctgagctttgagcagtggaaggcccacctcttacactcttcctggaaattctttattagcaacccaaccctaacctacaggtaagggacatccaggaacaagccatgggttagagctggaaagatggctcagaggttaagagcactggctgctcttctagaagtcctgagttcaattcccagcaaccacatggtgactcacaaccatctgttaatgggatctggtgcactcttctggtgtgtctgaagacagctatggtgtgctcatataaataataataaagaaatgatattaaagaaaagccatgggttaacagtgggccctaaacttgaactagaaaacttaaagatgctcatagggaagaagaaaagagcagaaagcttagcttctagacaggggtaaggcttagagctcaataaaaaaggaaccccaagagtgattggtccacaaccaaagcagtaagctaaccacacccacaaagagccagaatgaggattccttatgacctgcaggctacctctgtgcttgcagtcaccagtcagcaggaaaggaatccttctcagagtactcaacctgacgccagtcatttcttcctcccttccttgtccaaccagagccttagccctgactcagggaacactaaccctttccaatacctgaccttcatcatagccccttcccaccagagaggacccgaaaggcattgacagaagctacagaggacccccgccttcccaagagccataaccagtctcaatcagctcagagagtttcttcttcttcccaggatcctttgctgcaggctatcacctctggggaaggggggggggaagaggtggggggggaggggtgaactctgacccctgttggttttttgactctgtgagtgggtagagaagtagattcagggcctgctcaagccatttccttgcctttctctccactggcaaagctagcactgggtcagttctgatgagtggatccaacctgggatactggatgtctggatgtctaaaaggttctgggtctccagtgatgatcatccagaagagcctactcagtcctaacccaagctgagctatcagcccctcagcgctcccaaagtatgaagccattgggctgtcccagggcacaaatgtgtgtgtgtctgtgtgtgtgtctgtgtgtgcatgcctgcacatgctgtgttgcacgtgtgtgcctgtgtgtatgtgtgcatgcacgcatgtgcacatgcacgcttgtgtgtgtgtgtatgtgtgtatgtgtgtgtgcatgtgcacgtgtgtgcacgcatgtgcgagagtgtgtacgcgtgggctgctgtaactcaatgtatcagggagaagcagcagaatggaggaaccaaaccatcgccgaccaatctcacccaaatcctaacccaggaacctggaaactagtgtgctgagcagaggtgtctttcaggagttggaaagagagcaccaccacccccttttgcccaggtatttgacacatcttttgtcttcagtcttctcagtcccatttgccttgcttgacccttaattgagaatattcaaatatccatctttgttgtcgcttaaggaggggataggcttcaaatgacatagtgtctgtgacagcttgggttgtgtggacggctactgataccttttctgtactagcctctgtcaaatgctggcagtgcagcaatctacaagccagaggtccagccaggactcaaccaggccaacaaacactaacaggcatagagggaaagaccctcggtgtgcaggaaaggcttcagcacccttctcttccaggggctggaacttggaagaagtgtgccatgggaaaatgcagaacaaagccagggcccaacacaacatgcacaaataaaaggaaacacttcagataaaagtgctggaaatgtgtggcgtgatggtagagcacgtgtaaggacgagatgggttggatccccagccgtgtgtgtgtgtgtgtgtgtgtgtgtgtgtgtgtgtgtgtgtgtgaaggggctgtggggtctacaagtgttgcctaggagctgaggactcttttgtccctattacctgtgttatctgcgctgccctctcaactggatcagtagatcagtaaggaaggggggggggaggtgcgtacctagaaagagtctcagggctcagaacacaaggcgctgtccataagataatgaatgtcatcagaaatatgcctgacgcaccttcctgaggcttccacccactcgtgatctttagatgccatgcaaatacacaccaccccggggacagggaccctggtcacagagctgacctcagtcagagctgttgcggggactgagtcttgaaatatcccaggggtggcggaaaagctgagaggaccaagacagccagcggggctgcacggtccctggggggtcagcaccgaacaccctgacactggcatctcggaaaaaccctgtcagtggtaactgcaaataccagagggtccaacccccccttccttacggccccaggcaggctcagtcccttggctccagggaagaaaataagctgtctggctgtggtgtgagcaggaacatccgtgcagagctgcccaccaactcacccttactcagtctttccacaccatgccagggccgggcatgagacagaccacccccttaccccctcccccgtctgggctaaaagcagacacactgggttggtgagagagcagcaggttataaatatgcccaaggaactgccgccaactcgctcccctgtcatcccctgggagggggtagggtggggtgacacctaaggaggagccagggctgccctattcagtgaggcccagagagaagtggagcctccaaccagctgctgaaatatttattgattttttttcctttacctttcccaggtgaatgtgccacctttgacgtgtgccctggacttttgtctaccccaccctccctggtatatggccttatgtccagcgtgaaagggctcaaagccctgggccatttccttacaccctcaagaaaatagcagactttttaattcactcactgagtggacatagtgaggtgcgcatgcgcacctgcagccccggcgcatgcacaccctactcctgggtgatcgtaccagctccagcctctgttctgcacgctgtgccttcaacctggcaacctcccaggggaagggaagggaagggaagagaagggaagggaagggaagggaagggaagggaagggaagggaagggaagggaagggaagggaagggaagggannnnnnnnnnnnnnnnnnnnnnnnnnnnnnnnnnnnctaaggcaaaaggggcagccctcctcttccagggctgagcccctcccttctccatcctccctattaatcctcggaagtgaaggggccgtccctggcggcccttcagccctattgtggcccctcgccctcctcggctggcgtctaattaactcctcctgcccctggttttgtgtgccccccttactccaccttgtcggccccgcccctccgctcggtccgctccccccgacggacattccagtcaggccgggccagtgtgccagggcaaccagggccagaccgaggcctaatcccccctccacccggccgggctcagggagccccactcacctcccggctctctaggggctgctcggctctgctgtggcggagacacacaatcaggacaaaggcgcagcccccagggggctaactcagccttcacgcccaggttgtgcggcatttggggagtttaatgaattgtccatcacgcctttcagggcccgcccgtcagcctggattaatcttcggagccctggtggggcaggagacactaagcctgtatttattactctcccattgtcactaattgaggtaattatctgtgactctggcctggccaacaatgctgcattcactcctgggacctcgatgggcctggctcccactctcagcaccaaccctccctcccttcctctctaaaacgcgccaagggccaagatgggccctggagcatgttgggaaagtggacaacgttccacaatgttccacgttcacgtagtgtctcccaaagcctcctccactatggagcagtgttgaggagaaacctgggtctcctaaagttggtgagagaagagggcacacaggcttgacccgcagaaaccccaggccacagccagcctggcatgcttcattcctgggtaaatggcactaaagtctcacggggcctttcacatgtccctgtagcctacaggactctggagtgctagagggcacatactattccctgctagatgagaggttctggaagcagaagctaccagagttgccagagcggcaaagttggagaaagttaacaagaacaggatagggcgcaacagggagcagaagggcaggatgcagaagcatcctaggaagaagcaacccaaagtcagagcattccccagggatcacaccaatgtgaccatcaattagtgccatgcagcaagctggagaaaaacccaatttagagtagatgtcatatgaagatggccttctgggtcaagggaatattcctggagaacgtgtgtgtgtgtgtgtgtgtgtgtgtgtgtgtgtgtgtgtgtgtgtgtaatgcatgtgcatgtggtgtgtgtgtgcatgtgttgtatatacatgtatgtgtgtgaattcttgtgtgtgtgcttgtgtgatgtgtgcgtgtgtgtgtgtttaagatacaataaagaagagtagacttggatgagacttgattttgagattcttgatggcaaaaattatgttttgggtcactgttatttttataagatcctaatactttacctagaatgccaggctatatgaagcccgtacttcacaaccgttgcggcctgtcagatcttctcttaaatgtctgtcctccggctcttcatttacctagttcttggtcaaaagagatgtctagagcattcctggacagtcctgtcctggatggacaactgaccagctgaagcactaaggatcctggtagaactcagcgccaaagttcgaacagcgccacctcgtggcaaatcttgggagagcttctggagacactagctaagaggatagagccagcggctgcaggggctcaggctggacagcagccatcctccttcatggctgcgttgttgtcttcccggcttttattttaaattgtccctccattatttgaagtaatgtatcgtgcacttcgggatgtcatcaagtttcccatgtgctgaagataacagagaatacccggtccttttgcctgtaccccctgagtgctaggacttttacggggctaccatggccagtttatagagttttggggatcaactgtgggaccttgtgaatattagatgagtttctatcaactgagttacattctcctgcctcacttccctcttcttacacaaacctttttggaggtgttttccatgccaagatttcgtggctacagagtcaaacatgtaaatcaatgtatgtaaatcatattctagtaacaaatttcaaagggtaaccaagtcaacaaagatgccaggcatggtggcacacacctttcctcagaggatttgggaagcagaggagggtggatctctgggagtttccaggcagcttggtttaaatagagggttctaggtgagtgggggctatgtggtgagaccccatctccgatacagtcccaccatcactaacccacaccaaaccaaccaaccaaaaagagaaagcacagcaaaggtcacgatggagagccagggaagtattcagaactgaagtacaataagatactcccagctcaaaactctctgtcatcactcttttgattcttctcacaaaagatcctgtgtttctttagccagaggcagagcctcattgcttttcccatgttgccttggaattcctgggttcaagggattccccacccacaacccgccatgtagccgggactacaggtgtatgcgtctgccccatgtgaaggtcagatgcttgctttatgcttgccttcagtaacctcttcgtgaccaaggcctctttcttcccagggccttgttccctgtggaactcatgtcttctcacattctggacgcatctgtttcctcatcatctttgtgagaactacctcaaacatcccttcttcagctttcccttggcagagtgaccttgcctgcccgaactcttgaaatgctttgctggccatccgtgtatgcagtagaccaggcttgcacctgcatgaggacacaggttaggtgtctctcattttgccatccttgctagcaccagatagggacattatatgccctcatcaaatgatgaataagtggattcatggatgaagaagcagacgcatggatagatggatatggagaggcacttgaatggatgatagatgagatgtggatagatcagtaagtgcataggtaggatgcatggatagatgcatgcataggaaggatagataggtgagtgggtggatgggtggatggatggaaggatgactggatgggtggatgggtgatgattggatggataattgggtggattgatgggtgggtggatggatggatggatggatgattggatggttaattgggtggattgatgggtgggtggaatggatggactgatggagcatttatccacagatgacttgtatatcctagttaatacaaggagattcaaagaagggagcctacccccatggcatgccatgaagaggcaggaacacccctagtttaaatttttctctctatgtgcacccttgaagacttgtctcccagtaggcatttgtggctatatcccattccctatgagtccaagtcaaggaggtgtcctcctcccacttctttccataaaatatggaagagttcacaaatttgaatgttggccttgcagaggcactgcgctaatctcctctcagctgctccaaatttagtgtaaaagtgatctccccaaaggtagaaggtgtgcccgagtctcctcgatgtccctggaacacatggttagtgggcaagtggacaactgagtaattactgagagaatactaccctgtcctcaacgaacactctgtgcacacatcccaggaccctgcattgagcggctctcctctcttgcaaacacatccacattactgatctctgttttgttttgttgttttttggtttttctgagacaggtttctctgtatagctctggctgtcctggaactcactttgtagaccacgctggcctcgaactcagaaatctgcctgcctctgcctcccaagtgctgggattaaaggctgtgccaccactgtgctcactgatctctttgatgtcccagttatagctcttgggttccccacccatttgtagggggacccaggacacctcagagctctcccaagtctaaaaagggcagggttcctggctcccttaatgccttatcaagcacaacagaactcaggggcagaaaatgttcccaggaagaacttagctgtggggagagtcatggggtcccctgctaacctaagatgtgttgcccccaaaagagtagccctccaggacctgctgtcttttctcctgatcaagggggcagttccagggtgggggtggttgtgccctccttcagaaggctgggtagctggcagacacagctagatttagaagtcattttcacagcagggagtcgctaacctgccacccacagggccccatggggcctaagatactacttaccagggtctggccctgaaacctgcagacactcctctccttctctcccagaactttggcagctggctccgactctatccttggcaagctctggaagaaggcacgtgttgccctgacaccctaaatacccaaatgttcccccacacaaaatgggtggttgttacctaacctaggatatgcctttttcaatgctggggaccaaactcaggactgtgtacattctagccacacatgcatactaccattgagccaccaccacaacccggttccaaagggacttcttttttttttttggagacagaatcttgctgggctgaactgggataggctggaagttgctgtgtaaaccaggctgggctcaaactcatgaccattctcctgactccagttttcaagaaagtgcgccatgcctggcttccttctctctctctctctctctctatctatctatctatctatctatctatatatatatatatatatgttttattttgcctggatggcatgcagctcattatgtagaccaggctggccttgaacacccagagacccaccagcctctgccttctgagtgctgagattaatgatggagagtgccaccaatggagagtgccaccaaccgggcttctttccctaatttttatctacaagtcacctcctctgtgaactctccctggattttctaaaactaggatctcccttgattgactcttcctagaacttaacacaaccgtcctcactgtcagacaggccttgccatttctgcccttgagcccagcccagagtctagttcctaggaagtgttcagtaaatgctaggtttcgcttggcagcagaaaggactgcattggacgtggtaagacctttggtatctttgatctttgcccagggtgacccggc

SEQ ID NO: 1026 - DNA, 2230 bp, Mus musculus
agtggctgcttcagcccagcagccaggacagcgaaccatgctgcctgcggcccgcctccagacttattagagccagcctgggaactcgcatcactgccctcaccgctgtgtccagtcccaccgtcgcggacagcaaccacagtcgtcagaaccgcagcacagaaccagcaaggccaggcaggccatggggctctgggcgctgctgcccagctgggtttctactacgttgctactggcactgaccgctctgcccgcagccctggctgccaacagtagtggccgatggtggggcatcgtgaacatagcctcctccacgaacctgttgacggattccaagagtctgcagctggtgctcgagcccagtctgcagctgctgagccgcaagcagcggcgactgatccgacagaacccggggatcctgcacagcgtgagtggagggctccagagcgctgtgcgagagtgcaaatggcaattccgaaaccgccgctggaactgccccactgctccggggccccacctcttcggcaagatcgtcaaccgaggctgccgagaaacagcgttcatcttcgcaatcacctccgccggggtcacacattccgtggcgcgctcctgctccgaaggctccatcgagtcctgcacctgcgactaccggcggcgcggccctgggggccccgactggcactgggggggctgcagtgacaacatcgattttggtcgcctctttggccgagagttcgtggactccggggagaaggggcgggacctacgcttcctcatgaaccttcacaacaacgaggcagggcgaacgaccgtgttctctgagatgcgccaagagtgcaaatgccacgggatgtccggctcctgcacggtgcgcacgtgttggatgcggctgcccacgctgcgcgctgtgggcgacgtgctgcgcgaccgcttcgacggcgcctcccgcgtcctttacggcaaccgaggcagcaaccgcgcctcgcgggcggagctgctgcgcctggagcccgaagaccccgcgcacaagcctccctcccctcacgacctcgtctacttcgagaaatcgcccaacttctgcacgtacagtggccgcctgggcacagctggcacagctggacgagcttgcaacagctcgtctcccgcgctggacggctgtgagctgctgtgctgtggccgaggccaccgcacgcgcacgcagcgcgtcacggagcgctgcaactgcaccttccactggtgctgccacgtcagctgccgcaactgcacgcacacgcgcgttctgcacgagtgtctatgaggtgccgcgcctccgggaacgggaacgctctcttccagttctcagacacactcgctggtcctgatgtttgcccaccctaccgcgtccagccacagtcccagggttcatagcgatccatctctcccacctcctacctggggactcctgaaaccacttgcctgagtcggctcgaacccttttgccatcctgagggccctgacccagcctacctccctccctctttgagggagactccttttgcactgccccccaatttggccagagggtgagagaaagattcttcttctggggtgggggtggggaggtcaactcttgaaggtgttgcggttcctgatgtattttgcgctgtgacctctttgggtattatcacctttccttgtctctcgggtccctataggtcccttgagttctctaaccagcacctctgggcttcaaggcctttcccctcccacctgtagctgaagagtttccgagttgaaagggcacggaaagctaagtgggaaaggaggttgctggacccagcagcaaaaccctacattctccttgtctctgcctcggagccattgaacagctgtgaaccatgcctccctcagcctcctcccaccccttcctgtcctgcctcctcatcactgtgtaaataatttgcaccgaaatgtggccgcagagccacgcgttcggttatgtaaataaaactatttattgtgctgggttccagcctgggttgcagagaccaccctcaccccacctcactgctcctctgttctgctcgccagtccttttgttatccgaccttttttctcttttacccagcttctcataggcgcccttgcccaccggatcagtatttccttccactgtagctattagtggctcctcgcccccaccaatgtagtatcttcctctgaggaataaaatatctatttttatcaacga

SEQ ID NO: 1027 - DNA, 1113 bp, Mus musculus
atggggctctgggcgctgctgcccagctgggtttctactacgttgctactggcactgaccgctctgcccgcagccctggctgccaacagtagtggccgatggtggggcatcgtgaacatagcctcctccacgaacctgttgacggattccaagagtctgcagctggtgctcgagcccagtctgcagctgctgagccgcaagcagcggcgactgatccgacagaacccggggatcctgcacagcgtgagtggagggctccagagcgctgtgcgagagtgcaaatggcaattccgaaaccgccgctggaactgccccactgctccggggccccacctcttcggcaagatcgtcaaccgaggctgccgagaaacagcgttcatcttcgcaatcacctccgccggggtcacacattccgtggcgcgctcctgctccgaaggctccatcgagtcctgcacctgcgactaccggcggcgcggccctgggggccccgactggcactgggggggctgcagtgacaacatcgattttggtcgcctctttggccgagagttcgtggactccggggagaaggggcgggacctacgcttcctcatgaaccttcacaacaacgaggcagggcgaacgaccgtgttctctgagatgcgccaagagtgcaaatgccacgggatgtccggctcctgcacggtgcgcacgtgttggatgcggctgcccacgctgcgcgctgtgggcgacgtgctgcgcgaccgcttcgacggcgcctcccgcgtcctttacggcaaccgaggcagcaaccgcgcctcgcgggcggagctgctgcgcctggagcccgaagaccccgcgcacaagcctccctcccctcacgacctcgtctacttcgagaaatcgcccaacttctgcacgtacagtggccgcctgggcacagctggcacagctggacgagcttgcaacagctcgtctcccgcgctggacggctgtgagctgctgtgctgtggccgaggccaccgcacgcgcacgcagcgcgtcacggagcgctgcaactgcaccttccactggtgctgccacgtcagctgccgcaactgcacgcacacgcgcgttctgcacgagtgtctatga

SEQ ID NO: 1028 - DNA, 22990 bp, Homo sapiens
ccctggagtcgggagatgactaagagggagtccctgaggtctttgaagatgtgtacaaccgagttctacatctgaaagccttagaaattcccccaaccctgcagggagcttgggtgggtgaggtgggagcagagcctttgtggttctgtttttttgtttttttttttttaaattcacttcagggttaatcagtcttttaaccaacctacctaccaccatcctagcacccccaaagcactggagctatggagctgcccttccgcttcccaagatgtagttttatatttgcccttcaagactgccctttttatgtttatcctaacctgctattaccctataaaacactgagaggaggagagaggttggggagtgattttccctaaggccctcttaaaaggttggcttctttgttatgttttgggggtcacagaagctcaggctgccaagcctttcccagacttaaataaacatgctcaccatttgggtgtccaagccttcccctacaccaggccctgtggggaaggagggggaccctcacttcattttaggcaggggctctccggagccctgagaagacgagagacagcacccgcttagagaccaggcctctgctaccccaggatctagggctcctgggccagccttctgatccccctaactccaaccctccaggggtgaagctgtttgcacaagtcttgggaattcccctgcagatggcagctgcctattaaccccatagtccccagagcactgcccccatctctgggctgagcccccatgggtctttacacctcagggagtgaactccagtgggaaaccaggagaggcagccatgcctcccagaccaggccagcagtgacctgttctctgcctctccagccgttcttcacctgctcaggtgagcaacacctggagcccccacagcacagaggaggggactggctccccagcttcaaagtcatcagggtctttgttcccagctttggctcctgggaaccccagcaattaggggagcagatttaacccttaaacggttgggggcgtcaccccacccccgctgagacactggggacaccagcctgggcttgtccagccaagatggggggagagaaaatggtggagggaataggggggcgtttgaagcttccaggactgggggcatctcttgttcacaggtgcaacccagattaagctgagcggaggcaggaaaggggggccctagggtaggagagcagggacccagctgcctcgctggcagcacgcaggtggaagttaggcgcgcaggggcccagacgagtggccagacctggctcagagcggctccggggggggcggggaattccaggagaggcccctcccggagccgcgaaaccatcccttcccgcctccgcgcgcctcgccctgccgcccaccccctagcctccgcggcagcgccgacccgcccagccaggctcaccgcgcttgaggatggcgctgtggtgcggcaggcggccgccgccctcaagcgcggagcagttccagcgctggtcgcgcagctggtgctgacactcgtggaccgcgatgtgcagaccctgaagcgcggacgccgtcacgtcggggttgcgcaggcacaggcctagctgccgcttgctcaggccggacagcgtcaagcacacggtgttggccgtcagcggcggctcgccaggcaacttcaggcccagaatctcattgcttagagccctgggaaccaagaaggcgtctggggtctgcggtccagacccctccaactctccccaccccgggtcggtgtttctatggcctgggagacaaggggaactgctcaccgactgcacaacgccaggaacaggagacccgcgaggcccgagggcggaggccgcggccggggctcctccagcatgtcgaagcccggaggctccggtgggcagatcgatcaggacctgcgggacgggagacttgatgcgggttcaggaatagggcggctcgcttggggaaccaagtgacgcccttcttcgggctcctaacccaccggtgccaccctactgacccttctcattcctcctcaaacaaaacaagaagaaacaccccttgattcccagagtccctgaggcttggaggtcttaaagaagaagagtcaaggcgttgtcccagctcaggactcaagcgagcacccctggaaccttgcccaatcagacacaacgcccggcacacagacacacactcacttgcaaactcagacacacagactcacaaacacttgctccacaacctcgcctactgctcccttttccagggccccacgactagcttccccgccctcacagggctagggagagggatagggaggaggttccccaccacctaagggggtgtcacctccaggtgtcatcaagggcaagtaggctccatgagaaaggtctaagaatgagttccccactcacactgccccctccctgagcagcaaggaaagaggagaggctccaggtgcaggaaagatggggaggagagcctggctccctcctaaaagggaccgtggcacagactgagtcctcttccctatcccccaccttgcctaactacaagctcccctcctccatagtcgcccgtctggtcctcaccccttggctctcacattcattgcattctaaatctgggggcactcctttattctctgtgtctttatctctagcaatatctctggctctctatgcgtctctgtgcttctgtgggtggatgcgtgtctgtctgtctgtctgactacacacgtgcctgtctcttcctcgtgtgcacgtccctgccctccctgctttcccaggtctaattacctccagtggtttgggtgcggggtccgagacaggcacggttgggttgcctgggcttcactagtgctgcttaaaccgtggggagactgcgctgggttctgtccccttgtcagagccgcattcttccagggccgggccactcctcttcaccgcttccccagcgccgccgcggccgccgggaggaagggcgggaggaagggagggagtgatcgagagagctagcaagccggcgagcaaaggactgggggctctggctttgctctcaccgagctcagggtggctctgccgggctgacggagctgcagcccctccccgagcctggggcttccccaccctaccctccactcccagccttgaccaggcgaatgcagcctccccctcctcccagcgcgcgcgcgcgcgcgcgcacacacacacacacacacacacacacacacactctctctctctcacacaccctctcccccgacgcctgggttcaggcttggccccactgaagaaggaggtggccagagttcctctcacctgatctggggtcgccaaggctgcagggagggtgtagtaaccttcctagggagccagaatggggcccagatggccacatctttcatcactcctctttgcgtcagtttctccaccaagatcagggtggctggaaggtgcctttgacaagatgaggatggagccagacagtctttgggcttctcggtgtgggacagtcacatgtggcacccacagcctgagcgcacccggggtactcagagcgggcaggagaagcacacgtctgggcagcttggttcccaccctcctccaagccctgcgcctgcccctttggaggggacagctttggcctcagagtttggccctagcagaggttcaagtagcaccaaagattgtcagcctgccccgatgcttccttgcctggcagggatgcttgccaacagaggtatcctacccttctcgggattcccccggtctgcactttgggtggcctggattcctgctccaagctgtagacttgcttcttatgggatgaggagggccttgggatccaaaattgagccaagcccaagggcagccgggaaagagcctggtcttggggtgcacaggcaaaggcaaaccgccttagggagacccagtggcagcgaacgggttaggcgccaccgtgctcccgcctgactcaccctcgaagctctaaccactgtgggctatttttgccagagaggggccccaggctttccagccgccccccgcccctgccagaccgcagcccaaggcacggctggccccacgcgccccaggcacattgactcagactgcccccaagcaagcagaggaacagggatgatacccacaaccacagtcacctcttccttggtggtggcgttgcagctctgctgggcagccagcctccagtctgtgctgctggaggtcctgcccgtgctgcaggggtcactgttggatagcgggcacagcagtctgagacaggagatcgagcaaacttacatctgttgggatatttacagatcacctttacgtgccaggctgtgagcagtctggggaggtgaaagtgccatggtccctgacactggacagcctggaccagactgcttttctctgattccctacctctgggatggggaagtgggagcactagagttcctgaccctccttcccatttagaggacaagagccaaaccatgtgtggttttggaggtcaccagaatctgcaagccccatctcatagttttcatccttacacctggattcatgatccccaccagtgtccttatcctttttcttgcagtcaccctgggattcctgccaggtccttggaagaggggaatgaggttgcctaagcctctcttctccatggggacctcatggacatttgtatttctccatgtgtctctgggtcccccttaggtttgggattattttttgccttctgattctacccttgtcaggctccagcatacagccaggtgccaagaaggggcgaggggcagaactactacaataggtttcaacttcctggtgaccctaggtctccccaagcaggactgttccaaatccaaggacccagagtcctgctccttctctctactgaagcccaactctgggacaagaggccacaggccggcagactgggtggcctgagctggcccgcagtgccctcagcccgaccggctggcctgagcactgacccgcaggcggctagagggcggtgggacaggcggggcctggagagggctgtgggtgcacacccattgcctaataccccaagcacgcggccagctccaagaaaggggagggacgggaaccagagagaccttgacgtgggtcagggccaatgacaggagggggaaagtggggggctttcatcactgcagggagggactaggagcaagctggttccccttcccctcaatgagaagagtggagggctgcccttcccatcctagggatggagggtgtaacgagagcaatgtgggaagaacactggggccctggagggcgggggtcaaagaaaagagtgggggcccctggagattgggggatgtcgagcaactgaggcggtggctaaagcctcagaagcctcctcctcctcctccccccatgtttgccttggcccggggtcccgggtgactcatctgttgctgagccgctgataggggaggccagacccggggaacccaaattataggcccaggagggatggatgcgcccgtggcggtgagctcagctgcgctgcccaccctccgcttaatgcgccttctgctgcagcaccgtaggccaccacctggaggcaccaaagggtctgcgggccgactgcatactggactctcaggaaggccccactttcagcagtccactccaacaaatccatgggattaccttagacagaattttgcccccttctgtactcaggcctaatggatgggctgtgccttcccagcccaagggggcagtgctgcctgcgggtgcttcaaaggagggtaggctcctctgcccacaaactctaaaccctggagccctgcttcctccccagatcccaaagtcaaggcaaagcccctctcccctctaacatctcacctctaaccctattccaggggggtggtttgctactgattttcaacttcaagcctttaaagtcatccacggtcaaaactgatacagagaaaaatgaagcagggtaaaggagattagtagtgggattctattttataaagggggagggaaaacaaactgaaggaacaaatacatggagagatctgaggaagagcattttagaagacagaaaagcaggtgcacagacccttagaaaggagcatgcttggttcaaaggattagaaaagaggccagtgaggctagtggggagaaattcgcaaggaagagagtggtaggcaatgaagctggagggctaggaaggaggcccctttactttgagtgacatggggtctcgctggaaaattttgagcagagaaatgaactaatcagacttctgttttaggaaagatggctctgggctgggcgcagtggctcatgcctgtaatcccagtactttgggaggccgacgtgggcagatcacgaggtcaggagttcgagaccagcctggccaacatggtgaaaccccacctctactaaaaatacaaaaattaggtgggagtgttggtgggcgcctgtaatcccagctactcggtacgctgaggcaggagaatcgcttgaaaccggaaggtggaggttacagtgagccgagatcataccactgcactccagtctgcacaacaagagcaaaactccgtctcaaaaaaaaaaaaaaagaaagaaagaaagaaagaaattggctctagtaattaaatcaacccttttgatttttgcagtaaaatggagcactgaaatggagcaatcttgggcagtaatgtggggtctaatgaagtttttgggtttttcagatgggtactattgcagcatgtctgcatgcttatgtgtatgttccaggagagagataagtggatgatgcaggaaagaaagaggggacagttgatatcatgattatttgatctaaatagaaagttgggtgcttgttttggcagcacatatactaaaattggaatgatatagagattagcatggcccctgcacaaggatgacatgcaaatttgtgaagcatttcatattttgaaaaagaaatgtcagccaggtcataaacagtgtgacccagatctaggggccttaccctcttgccccctactcctggtgtgtggaatgttggaacaaagcacagtggctcctttcctctcttcccacctctgcttgacaacagtcgtcaaagacagggcttccatattttccagccagcctcccaccctcacggtgttgtatcaatccaccaggccaaaagatgtgacccaggccccagtgggaagaaactcataagggataaaggacaggctccccgtgatacattgtccatttacttgagctatctatgctgggtgctctctgcagggactactggcttttggatctacggagggtgctggaccactacaccttttccctctggggtggatccttggaagggccagatatactaggctgggcaaaagggaagaaaaaagggaaagaaggacatttctttctaaaataacttccatcaggcttcatttgggttaatatgcatctcatttaaaacacaagtgcccgggaatattaatgaaacttacctggcatttattccttagagtgatttccctgccttagaagggaatcctagtcatttctgggacttgagactttaggttcaggcctggggaaatttctcagtcagaaggcatcctaaaagacaagggagatgaaaaaaatgagagctagaactcaaaagggaggcagaaaggcccaaaaaattatttttacccatcaattttgagaagggttcccagcctgtaattgctgcacactggcaagcagctggtaaggtcgaaagagcatgggctttgagtcaaattggtctgggttttaatctggctctaccattgattcatttattagacgtggaccttggacaagtgcctgatctatttttaattctgcaaaatggggagagagaagagatcttccctccttccaggggccatgtgtgtggtggtggggcatgataaccaggctggcagtgccccctattccccatatagggaaaagcagccactttttttttttttttcagatgaagtcttgctctgtagcccagactggagtgcaatggcgtgatctcggctcactgcaatctccacctcccgggttcaagccattctcctgcctcagcctcctgagtagctgggactacaggtgtgcgccaccacactcagctaatttttgtatttttattagagatgggattccactatgttggccaggatggtctcgatctcctgacctcatgatccacctgcctcggcctcccaaagtgcggggattataggcatgagccaccgcgcccagcctgtcacttcttcaataggaggcctaaatggccttgaagctgagtaggagtccctgggagagaagagaaaagtgtacaatggatgagatggtcacaggcactctgggtatcccagtgtggtgggaactagagctttagggaaagacagaaacttggcagaaacatccaaagagaagcaaacacatggaggcacaagtttcctcatctaggttcaatgtagccagcaacccttgtcttcccagtcctctccatcaccatacatacagtggacatccgcaccatttcccatcctttctgagcctaggcctcagagacttagccactccaggctgggttcacctcaataccatcttggttgtaggctcggctctctcccccaatgacatgcactggttgacacataccacagtgtgacacgccataggatgccacgaggtacaaagggcaacagaatgacgcatacacacatatttaatcttcccatgcacatgctcatccacccactccacacacagtccagacactctgcatccctcaatcatgcttctgagtctcctgtcgacagttgccacctccttcctgacacactgccccaggcggtgactgtgacaaggtgactccatgaccttttctgacttgagctaaattccaaaattctttggaaagtttcctaacatccttcgtcagaacaaggagtttctggcacgtaccaacacacagggaggatgcaccctcagaacacagcacattctcactcccacccatattcacgttgttccacttcacacacacacacacacacacagccacttgtgcgcttcttctggcgcacatgagcaaactgcctgttgctttaggtttctctccaccgctaggctccttttggttagctcacccccacaactcatccccgggatttccctgaccacagccgcactcacgcccccgtctcccctttttccttctctgtccagccatcgggggttcctgggcggttaagcatctccccggagtcgctgcccagaaccacagctttccttccgacactcaggatgggggagagaggggacgtcggaggggcccggggtgacgtcgaggggacaaccccaccgcgggcggcgaggcgggctgggcccctggcgggctctccccgcagcacactctcgccgcgccccctggcggatgctagtcctcgacgggctccggacgctcagctgagtgaggcgggcgcgcgtgggagggtgtcccaaggggaggggtccgcggccagtgcaggcccggaggcgggggccaccgggcagggggcgggggtgagccccgacggccaacccgtcagctctcggctcagacgggcgggaaccacagccccgctcgctgcccattgtctgcgcccctaaccggtgcgccctggtgccacagtgcggcccggaggggcagcctcctcccgtcacttcagccagcgccgcaactataagaggcggtgccgcccgccgtggccgcctcagcccaccagccgggaccgcgagccatgctgtccgccgcccgcccccagggttgttaaagccagactgcgaactctcgccactgccgccaccgccgcgtcccgtcccaccgtcgcgggcaacaaccaaagtcgccgcaactgcagcacagagcgggcaaagccaggcaggccatggggctctgggcgctgttgcctggctgggtttctgctacgctgctgctggcgctggccgctctgcccgcagccctggctgccaacagcagtggccgatggtggtaagtgagctggtgcggggtcgccacttgtcccgcggcacagagccaggggccaaccctacccagctcccacgctctgggatccgtctgccgacaggctccctccccgctctgacttccctccgcgacaccgaagggcgatctggcatgaaactgccccagactccagctctgtacaagtggggcgaatgatccgcccgcggaggcctaagataccccaggcagggagcccactctcatctagcaccgcccttcccctttgagcgccaactccagcctcacggcggtggctcaccacaggtttccccacctcgggaagtgaagggccaggagttcgcctagaaaggaggggagaagagggtgggactcctaagcatttcacgccttgggtgggcaagaactgcaggccatgattatctcgctcaggctgaccggaagaggctcggagatccaaggtagacactcggtctccgggtacctcctctgtccagtctccggacctagggctcaggcgagcagccctgggactactgggcacacacaagtctggacgcccagttctttcaaattagtgagcctgggagagcgggtattattaatctcccgccattctctccagccacatacccccaggaagaggaccgggtggcacagtttttatggttagggtgcggatccccttcctgagcctgagctatcatacgtcccaccaggggtattgtgaacgtagcctcctccacgaacctgcttacagactccaagagtctgcaactggtactcgagcccagtctgcagctgttgagccgcaaacagcggcgtctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggtgggtgcccaggaaggcgacgcttccgggagcaggggaaacgcggggtcacccccagggcatgggcgggcgagttcagagaaggtgtcccaggcgcctggagggtcacacaatcaaccttgccaagtgcctcgtgcccagcgccagctcggggccagacttctaccaggcgttttccagccgtgcaccctggaaacgaagcttaacttttctgagctactgccccagataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacggtgagctttgagaggctccgcaccctaagcggagcggcaggggccaacctcgggctggggaagtgacggtcggtgagataaggcaaggggcaccaggagagggcgtcctgggagagccggaggcttggaacgaagacggagaatagaggagacagtggctgagggcaaaggtatgtctggcccgcggacaggtagaagaggttgcaaatcaagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcctcgagccctcccccaaacagactcgctagcactcaagacccggttattcgcccacccgagtacctccagtcacactccccgcggttcatacgcatcccatctctcccacttcctcctacctggggactcctcaaaccacttgcctggggcggcatgaaccctcttgccatcctgatggacctgccccggacctacctccctccctctccgcgggagaccccttgttgcactgccccctgcttggccaggaggtgagagaaggatgggtcccctccgccatggggtcggctcctgatggtgtcattctgcctgctccatcgcgccagcgacctctctgcctctcttcttcccctttgtcctgcgttttctccgggtcctcctaagtcccttcctattctcctgccatgggtgcagaccctgaacccacacctgggcatcagggcctttctcctccccacctgtagctgaagcaggaggttacagggcaaaagggcagctgtgatgatgtggaaatgaggttgggggaaccagcagaaatgcccccattctcccagtctctgtcgtggagccattgaacagctgtgagccatgcctccctgggccacctcctaccccttcctgtcctgcctcctcatcagtgtgtaaataatttgcactgaaacgtggatacagagccacgagtttggatgttgtaaataaaactatttattgtgctgggtcccagcctggtttgcaaagaccacctccaacccaacccaatccctctccactcttctctcctttctccctgcagccttttctggtccctcttctctcctcagtttctcaaagatgcgtttgcctcctggaatcagtatttccttccactgtagctattagcggctcctcgcccccaccagtgtagcatcttcctctgcagaataaaatctctatttttatcgatgacttggtggcttttccttgaatccagaacacaaccttgtttgtggtgtcccctatcctccccttttaccactcccaggcttggaagcttacctctctcaaacaaatagaatatgctgttgggggactggtttcctaaccttgccagaggaccctgagattctgacccttggatgaccctaacgaggccactgggaatccagctctcctgagagaggaacctggtcagtagccaaacaaccctgcagggttcttcttcctcgtggaacagcaactggctgtgtgatatggacaggtgcatatacttggtgaatgggggttaaacaacctcagtgcctgcttttcctgcctggaacagctgttcagaaaatagctactattgaatgataactgtgaccatcttccaaaaagtaggaagagaaactaaagcagagtgctgctgcccctaatgtggagctattggtccctgaagcttggcttcttcagctgtggtcagggcattggacaggggtgaagcccttccaccaacagaaaagtaaatactggcctggggcagtggctcatgcctgtaatcccaacactttgggagaccgaggtgggtaaatcgattcagcccaggagtttgagaccagcctgggccacacaggcagccccacctctacaaaagaaaaaaaaaaaaaaaaataatatatatatatatatatatatatatgtgtgtgtgtgtgtgtgtgtgtgtgtgtgtgtgtgtgtatatacacacactattaggtattatatatgtatatctatctatctatctaataaataccttatcaggagccccactcccaatcttgggctcagggagatccagataataggtgatgagcctggtgctggaccgagaagctcagagatgctggtgggagagaagggagcaggtaggctagaatccaaatgcaggctaggcttaaaccgatgtaaccaaaggaaaccctaatgtggtccataaccaaactactaagctagccattcccataaagaaccagaatgaggattttgttactaacaccaccagtgtgatacctctgtgtgcacattcaccagagtcagtgggagttctaatcctacccacggccctaaacctatctctaactctaaccctcttcctgttcctaggtctaggttgaaccttagccttaaccctaacttcagacaaacactaaccccttctaagctctaatgtctgtccctaatcctaacccctccccacaggggaggatcagaagggcaaggggagctgtgaaacacccaacctatcccctaagagcaacaactgctcccagccagcttgagaatttccccttctcccctattccctcctctcctgttcaggcctcttctgctgttggtgcctcccaccacctttgggatatgtgtaggggtaggggaatggagccaggaactgctcagtcctgcaacgacatccctttcccttcctttccacctgccaagctagcaccatctcagttctgattcctcaccctaggggaagaaataaaaacctattgatcctggggaagaggcacctgaaaagctttgggtttccataaagagcaccctgcagagaatgcccagtctataagccaaagggctattagatccctcaactccccaaataagaagttaataggctgccagaggtgggagggggggcttgggcccctgctggacagtgcccagagttgagatgaagcagcagggtagagtcaaagcattggcagctgtctccaactacttttgcctaaattcaaactctaagaattggagtcagtatcagctttcaggcttggaagctggggcactctgaaccaggttgacaaacaggagctggaggaagagcaagggaaagtggtgaattcttttctgcccctacccagactttcagcaaatctcgtactttctcagactcagttgccttgcctatcaaacagggatggttattgttacttaacctttcagggaggtgatgaggttcagatgagatgatgtacatgaaagcctgggtcatttgaatactcactgacacctcttctataccaggcatctgccaaatgttggcaatacaatgatttataaaccatagtgcctgcttggaggaggttgacagtctggccaggggatcaagcacatcctcagatattgttagcatatggagggagtgcaatgaaggctcaatgaagtgtaaagccttctgcacataaatgaagtttaagggcagactcccatactcaagccctcggcatggaggctcttctcttccaagggctggaatttcaaaggtgatggtgctgggaagtgcagaattaggctgggccctcaatgggcactaataaaacacaaacacacatacacacacacacaaacaagtaaaagggcagagggatctgcaaagcactacataaaagctaatcattttgttattgtgatcatctatgctatcctcacacagggctggagcgggtacatcctgaggagaagaacaattatgcatagaaagaagactcacaaaggtctcaggagccacagtaggctcagggtggtggccataggatggtgtcatcaggactgtgcttgatgcgccacctctcaccacctctgatcttcaggtgccagggcgctggatacacgttggcctgagcaagtgagggaaagactagtcctgaaatatcctggggggagtggaaaagctgagaagaaaggcaggctgtgcacagtccccagggggtcagcaagccagcaccacacacactctgccacacgcaccctggaaaaaccctgtcagtggggctgcaaataccctagggtccagcctcccccaaagcctcccccctcgccccaggctggctcagtcctcctctccagcgcagagggagaaaaataacaaaacgaggagaaaataagctgtttggctgtggtgtgagcaggaatatccatgcagggctgcccaccactcacccttactcactctttccacacccagccggggcgcccagcatgagacagaccacccccctgccccctcccccgtctggtctaaaagcagacgctggtgagcgagcagcaggttataaatatgcccagggaactgccgccaactcgctcccttgtcatcccctgggaggggcagggtggggtggctcccagggaggagccagggctgccctgttccctgaggcccaggaggaagtggggcttcctagaggctaccatattttccccccttttcaaggtgaaggaaccactgccactccattttccctgaacatttgctcatctcttcagatatgtggtccctaccctccctgggccctggctggaggctcggaatgaaagggcccaaagtactctgtgtcatggcacagcccgctgctacttctcttcttcacatgcatttgctctcagcaaaacagaagttcattcattcattcaacaagcattaactgaaagccagctgaatgccagaccctgtgcacaggcccacctgtgtgcacagtgtctgcacacacaggtgcaagcacacacagctgcccctactccatgtgctcacatcacctccagcccccactaaggacttcctggcttcaacctgccagcctcatcaggaaagcaaagcttcaagctcctggttgtgcctcagagtaggttagggggcatggggtagggggtggctgagaacaggaccccaaacacttctgcttccactacttcccctgtaaatgagggggtcctttctctccttcctgcccaatcatcctccctaagtaggtgccatgtgacgaagaaagagccattcttgggatgctgagggtacctgtccaggccaccagagcctcccacctcccagcaacttgccaactaggtgccaagctggggcaagagggggcacttccaccctgtgaagctcccagctctcctcccccagggctgaacccctcccttttccctcctccctattaatcctcggaagttaaggggccgtccctggcggcccctcagccctatcgtggcccctcaccctcctcggctggcgtctaattaactcctcctgcccctggttttgtatgccccccttaccccaccttgtcggccccgcccctctgctcggccagctcccccccacggacattccagccaggccgggccagtgtgccagggcaaccagggccggaccgaggcctaatcctcccgccgcctggcccggctgggggagccccactcacctccccactctctgggggctgcccggctctgctgtggcggagacacacaatcgggacaaaggcacagcccccagggggctaactcagccttcacgcccaggttgtgcggcatttggggagtttaatgaattgtccatcacgcctttcagggcccgcccgtcagcctggattaatcttcggagccctggtggggtaggagacactaagcctgtatttattactctcccattgtcactaattgaggtaattatctgtgactctggcctggccaacaatgaggcattcactcctgggacctcgatgggcctggctcccactctcagcaccagccctccctcccctcctcttccaaacccgccaaggactacgatgggccctggagcatgttgggaaagtggacagcgtcccacaatgcctcacctccccaccggcgtctcccatagccatcactacagagctgtctcctggtccccccagagaaggtgagaaaagaaggcagcctctgccaggggatggatttggctggcagagccctcaggccagagagggacctgtttctgaggactttggttttctggactctccaactcctcatctccagatgcatgacaccagggtctcacaaggtgcttttgcagatccatcctcatgtccctatagcctctagggtgttaagaggctctagcctgtaccaggcctactctggggaggtccctaaacctaccagtgctggcagagtggctgtggatgtgatgggagatgttaagagagacagcaggaaaggttctgtcaggggaagagcaaaaggagccaagtcaagaaggagcagtcaagagtcacagcattcccgggggtcacactaatgtggccatgcagcaacttcagggagaaacttggatttggaggggcaagagttccaaagagcggatttcacgtggagacagctttctgggtcaaggtggttggccctggggagcaggtatgtgtgtacaagaaagacagagagagagagagagagagagagagataagaaaggaagatttaggcagaactagattgtgaactccttgagggcaagaactatgtctttgtgtcttggtcactgttgcttttatgagagcttaacattgtaccttgcacgtaataggcaccgtcaagtgaatggatgaatacagatgaagccggcacttgctttaaaactgggatctgtgagctattctcttccacagctgcactcaggctcctcattctctcaggacttgctggaaggagatgtctagaccatccctggacggtcagcggtgggcacttcaccagctgttgacacgacagaccctggccgaactcagagcggtagtggggatagcgccaccttgtggtgactcttgggagagctcctggagagacgctagccaagaaggcagggtcatctctcaggagcagggtatcaccccgggctgcagccatccttcttcctgtatgtctgaactgcattgttatgccagcggtcctgtggcacagttttatcatttgttccttctttattccagcattttctgagagcctgctccacgccaaacttgtcgggtatacagagctaaatcagctaaatcacctccagcagctcatggtccagcaggggattccacaaggtaacaagaccaacgaggttacgatcaagccgcaggaaaaaaaattatccaggtgttgaggaggcactagaacattcccagctcaaaaactccatcattcacctctccctcaattcctctcaccgaagtgcaaatggtttatcttcattaccaagaaacagtctgggcatggtggctcacagctgtaatctcagcactttgggaggccgaggcgggcggatcacttgagatcaggagttcgagaccagcctggccaacatggtgaaacccgtctctactaaaaatacaaataaaaaattagccaagagttatggcgcccacctgtaatcccagctactctggaggctgaggcaggagaatcgcttgaacccaggaactggagcagagatcacaccactgcactctagtctgggtgacagagtgagactccatatcaaaaaaaaaaaaaaaaaaaaacccaaaaagcaaaaaagacaagaaatacttcaagttctggctcccacacatctttccaggactcactcttctgccccactgcattccctaatgcctctgctccctgtgaaagccacgtgttttcctacctctctgcattttcccacctctctgcattttcccacatcctagaatgtcccccttccctgtatcccactgttggaacccatctcagatgttccttcctccatgaagactcttctgatttcccttggtagagtggtcttgcctgttctagctcctgaagcaccatgtaggtaggtgctttcattagcagcacatactgggtgtcccattggtggttgtctgtgtatattactcatcctcctactaggctagcccttgcagcactgacctgggcatatcatatgcctttgttaaatggtgaatagacggatacatgaataaatggatgcacggacagaggaataaatcgatggaagtataaatggggccaggcgcggtggctcatgcctgtaatcccagcactttgggaggccaaggcaggcggatctcctgaggtcaggagtttgagaccagcctggccaacatggtgaaaccctgtctctactaaaaatacaaaaattagccaggcatgttggtgggcgcctgtaatcccagctactcaagaggctgaggcatgagaatcgctagaaccctggaggcggaggctgcagtgagcagagatctcactaatgcactccagcctgagtgacagagtgagactctgtcttaaagaagaaaaaaagtataaatggccagatagatgacaaataggttggtggatgggtggataagtggatgtggaatgtatagatggatgggtgggtggatggatgaatagatggatgaatggaaaatctatccataaaaggactcacaaaaggctatgtaggctgagtgcagtggcttatacccgtaatcccaacatttggggaggccaggatgggagaatcgtttgagcccaggagtttgagatcagcctgggcaacatagggagaccccgtctccaccaaaaaaaaaaaaaaaaaaaaattagcccggcatggtgacacgtgcctgtggttcctactattcaggaggctgaggtggaaggatcacttttgctggggaggctgaggctgcagtaagttgtaatcgtgccactgcactccagcctgggtgacatagcaagaccctgtctcagaaaaagaaaaaagaaaaaaaatggccagatgtggtggcccatgcctgtaatcccagcactttggaagggtgaggcaggcagatagcttgaggtcaggagttcgagaccaccctggccaacatggtgaaaccctgtctctactaaaaatacaaaaattagctgggcgtggtggtgcgcggctgtaatcccatccacttgggaggctgaggcagaagaattgtttgaacccgggaggtggaggttgcagtgagctgagatcgcaccactgcactccagcctgggtggcaggaaagaaaagaaaattttaaaaaagcccaggtagcaccagaggcttcaagggagggagcacaccccatgctaggatatgcagaggcagaggcagtatccaggccaaactttccttcactaacatctgcaccctcagcaacttgtctcccagaggcctagatacattccactccccataagaagtcatggtctgggagctgctcctcttttcatcctccctggtccctcaggaatgctttcattaacatatattatgccatcttcctgcactgcaatgactgtgggtttcctcttccacatctctttccctatatcatacacaccctagcttgagagctccctgaagggaggaagcatgcctgagtctcttttgtgtccctagcacctggcatatatgtttaatgagtgagtaaacaaatgaacaactgagtgagtgctgcctcttccccatagacacattttatacacttcctgcgtcctcttgttcagttatctctcctggccctctcctccttacacacatcacactcacactcctgaccttgacactctgaaattccagagttatatgctggggctcggtttccttacctatttgtggctgatctagggaagtcccagccctcccctgagagtctgaaagagacggctcttgactcctctaaagccatattaactgggtcccatggagggcagaaaggggcttccctaggaagaagctctctattgggagggtagcaggatcctgcactaacctgaggtctgctgccccaaattgaccacatcctcctgtgtctgctgtccctactcctgaccagtgaggctgtcccaaggtagggggtggttgtggcctctgtctcaaggctggctggcagacacagccagatttagaagtcattttcgcagcagggagcctccagtgtgccacccacagagccctggaaggtcagtctgagatatggctcaccaggggctggcccctagacctggagtcactcctccccttcttgtctctctcctttttttgcccagaattttggcagctggtgctgactctatccttaggcaaagatggagtaagttctgggggaaggggtgtgctgcactgacactctaaccgcccaagcactgccagggcac

SEQ ID NO: 1029 - DNA, 1113 bp, Homo sapiens
atggggctctgggcgctgttgcctggctgggtttctgctacgctgctgctggcgctggccgctctgcccgcagccctggctgccaacagcagtggccgatggtggggtattgtgaacgtagcctcctccacgaacctgcttacagactccaagagtctgcaactggtactcgagcccagtctgcagctgttgagccgcaaacagcggcgcctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgagcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtga

SEQ ID NO: 1030 - DNA, 1113 bp, Homo sapiens; identical to SEQ ID NO: 1029

SEQ ID NO: 1031 - DNA, 24652 bp, Mus musculus
  misc_feature (5051)..(5259): "n" at positions 5051 thru 5259 can be any base
  misc_feature (7564)..(7664): "n" at positions 7564 thru 7664 can be any base
cacttttcaaataacatgaaagtgaaaacctgttggcaagaccaaaagaagtctggggtagtggttcttcttaggtcattttagagattcttagatcttgagacagagcaaagaactgcttgtaaatgagccaagaaactaatctccataatgctcagggtagaaacttgtagcttacaagacacttcagaggttagcaccgacaaccatctatttagaatgcgttacgcgtccctttttctcacacagtactttttaatgactgatggctgagaagctcaaatgtttttggatacagaatctaagcttgtcacaaaggcgtagttagcttttgttccagatttgcttctcacaagctgtgttcggacaagtgactcgacccctctaaggcttaagttcctcatctacaaagcgagggaccatgacaactgaaaaccaacacagtgtgttgtgagggtgaatgaggtcacaggcatggcttcctcagaacaacttctggtgtgcacaagtcatttcctcagaaggaggctggagaatcggaaaacaaggaggtacaaataaatattttaaacaaagtactaatgagtgaacattcctttttaaatattctgctccatcccagcacccagatcaatgcaaattagcatgaagccagactttgcggtttatttgtttggttggttttgcctcctactaatcttgcctgatggtgtaactgacttttctcagggatccagagttgctgtgtcctttctgcttggacctctcaggataacagctccaagtgtgacctgggacataggggacatgttatgaaccaggacaagcccttgggagttgctatgccagcagctagttatggggtatgtatggctctttgggcctctttaaatgagagtctagttttatcacatcttgggcctctaattcgcttggattgagatgggagttctttgtttacacgttgaggtcaggactgtactatgtaccccaagctggcatcaacctcactatatccctgcctcagcctttttcaagttagggtttttatattttatttttaagagcagttttaggttagaagcagaattgtgttgagcatcatcctgtcatctctacatgtgcacagtacccctctccagagtgacacatgtgtgacatctgatgaacctagatcattatcacccagaggccatggttgacattggagttctataaatttgaatgaccattcactgtctagtgtccccacacacattacagtgccttacaaagtagattcactgccctgaaaagtctgcgctacagctttactttaaaaaaaccaaataccaggcctattttccaaatttgttatcatagcatttgggagatgatggcagaaaggagacaagtttatgatctatattgaatccgaggccagccttggctcatgagaccctgtcttaagaaaataaaagcataaaaataaaaagaatgtgtatttaagccccctttccacctcatataccactaactgttctcctccttctccttcctgtgagtccaagggaccaggaaatggctcatgtctaaatccacccatgacaactaactcttccaagaaggtgcaagtctaactgccaggtgccgttgccagtgggtcccaggctcgggactcatagcaatcacaatatccacaaagcaggtttcaatttcactacttttataatcagacaaaacacatatttagggttggatagatgacttggtgaataaaccacttgctgtctgagcataaggacctgagttcaagtccccagaacccttaggaagatggtagcgtttatcttcagtcccaactccttctggcaggatgagagacagagacagagacaggtgagtccctggaagatcaggagccatctagctcaatttacacaatagagagcagcaatgagaactggtctccagtaagctggagaggaaggtgtgacagccaaggttttcctctgacctcagatacatgtaggacacctgtactcacacacaaaagcatgcacattacatgcatccacacgtcatgtacacacacacacacacacatgcacatgcacatgcacatagacacataggcatataggcatatttaataatgaataaataataataagaatcctctagattatattcacctttttgccactgcagttacaaaatgtttttttttttaatttttatgaaagagaaacaattctgctgcatttaagagcagggtcttaagacacgcaaatcggtgacgttatcctctactttgcctctactcttccgatttcttcctcttccattaccaggcaaaactcacagcaacactgggttctatgggcttgtctaaaaaaaaaaaaaaaaaaaaaaaaaaaaaaaaaaaaaaactccagcaacaatcacaccgaacttgtttatttcatgtgcctatcataagccttccccagatttttcacaccctcctcccagatacaaactaacaatgtcacagcaactaacagcacagtggggtcacacctgcatgggccaaattaagatccgccatgaggtgactgtcctctgggagcggctctcgcttcagaggctcttgtgaatcacacacagcagcaccatcacacttcccacagcaggtggccatgtttttcactgactaacgagcaggatcaatgactgaacacttcactaacacctggtcgagggctgatctccatccaccctgggaagctgaaatgaagtcttctctagcatttcctatctaattcaatacagaggaggggaaaaaacattagagaaacaagataaacaacaacaaaatgacagtatttctattacattgaattttgtgtgtgggttgatactgagagattatttccaccaaaatgtttgagccagtttgccagttagcaaactaggcagtcatgcaaactaatctagatccatccttgcaacaaactgtagctcccatccggcattgtgtccccctaaacaatgcagttgtgattggcacaatccagctcacattgtctctattctgtctaaaacatgcattgcatgtggaaaatacagtagcctactctctgctaactgcctgccttagtctcacctagagttttctctctacttctcaagccagagggcacagaagacgcagacatagaaaatgatcactcaaaccctatgtggattttcatgggaatattgtctgcccttaagaatgccaccctctgctctcacgacagtgaatcaaactgaattgaatgagaaaaccttaagcctgtaaaggataggtacgcttggtgcaggaatggtagaaatggctattagaatgggaaggtcaaaatcaagtcatttgtggttgtgtctgaagttgattcctttaggtttcattaaataaaaagagtgagggttatggagacatgatccccaccactgaagtaaaagctgggtgaaggcacataggtacctgcgtcccccgtgctttagggtggacattggagagtccaggacgtctctggccagccagccaggccaaaagagaaacatcagggttagtgagagaccctggattgaggaaacaagacagctgtcatcctcttctgatcacaaccgcatgtgagcacatgggaacacacacatgtgtatagtacaaacacagcaaacctacacagagacagacagacagacacagagacagagacagagagagacttcccttttaaaaggaaacgtttccttccgaagcttaaggatacatctgcccagtctttgagaaatctctccccacattgatttgccattattttctctgctactcccatgcaagttggactacagattttcaggagtttttgtttcaatgctgtgtttatcacagcacttttttgaatgcatattgaattgagcagtttaagggtttggttttggtttggtttggttggctttgttttgtttctttgtttttacccaaaaaaaatcacgtctgttttttttttttttttttttggtttgtccagatgtttggatctttctataaactgcaccccaccccagcatttacccatgcacctttgcaggtgataagtgattaagcagaatgagtttactgaggtatacaatacgaactttataaatagtgtttgtgtggccaaactggttttaactttggaattggtgctggtagactgtactgtcggcctctggaaagaggcccagtattgaattttaatctcttcagccctctttttagacctacttgtcccaggcacccactggcaaacctgagggtgtgtgctaattggatcacacccaaaggggagagcaggtagaaggagctggagcagacttcggagaaccagaacctccccgccctgccaagacaattgagaggcaaacagactgatacacaccagtgggtgaggggagggtgtgtcgccccagtattgtggttctgctctaactctcccgaaccctgcatatcccttctcgttagcatccctcctttgttctcctctcccctctggtccagctctctgttcctgtgatcctttgtatccatagcctggcccttatgtcctctgaaaagctggcccttcctccatgggtgtgaacacagctccaggggtgttcacacaggatggagcatccaccctgagcatagaggaggcagtcagagcattaagagtcctgcgtctggggcaaagttcaagcttcaggctctgattctttaaaactcttctgagataggcattgagcccattttttaaaacgtcttggggctgagaatcaaattcagtctaatctaaagtgagactttaagtcactgactgagtccatcctgtcatccaaatgttggtaagaaagagtgatactgtctgttacccttgaacaaagtagacttacccagttagcatcaagacgggcaattctcacacatcctctcacctgtacctgtagaggggtgtgtgtgcctgctaaagcaaaagtcaggtcccagccctcctctgttatctcccttcaggaagctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgtctccaagaataaacatcatgagaccttttctatggcttggtatagtatgggatggggtgggatgggatggggtgagatgatatggtatggtgtcatgctgtgtcattctctatcatatcatataaaatcatataatacatagtattctattccttatatttagtacagtttattacattatcactacttgtctatcctgctagcatcttaaaagatgcagaagtcaaatgtgatgccatttagagacactgtttctgcctatgtgctctatagggtaaataaatacaattctgccaggctctggtaaagaaagtcaaagaatcagacagcaatttccaagcagctaacaacaagaatgtgttttcacaattaggatctgtacttggagtggtctaacataacacagtgtaattaccttcataaaaatcccctttgaagacttggggatagatcagttagtaaaatgactgtctagcttgcttgagccctggataaaccagcgctgcataacccaggtatatcagtaggtacctgcaatgccagcagcactctagaagtagaggtaggaggagcagaagttcaaggtcaaggccatcctcagtgacatagaaaatttgaggccagttggagttacacgagatttatttaaatacaaacaaacaaatggacttctgtgaagatacctcagagcagtggagcaatgacaagccctcctccagacagatactccctgagagaacttcaatgtacacaaagacagagtccaattctaaccccaggtctgaaagacagaagcaaaggatcacctctcacagagacatgccctcctagcctgggtctgaggtgagtcacagcaaagaccatatttacaagcctatgggtttgcagatgacaatgtgcagagagaaagacactttggaacattcaggcctaaattcaatgttattgtcattgttgttgttgttgttgttgttagtcaaaagtcctcctttcatgactcagagatgtatgaaagaagaagtggaaagactctaagagccaggaacactgatgactccagagaaacagtgtcttgcagacacacacacacacagctgatgcacgtgtgaacttaagagactaggacagtacacatagacctgtacaagttcaagccagacacaatcccagggcagagacaaggaagtagctacaaggacccatttctaacacagaagctatttgctgttaatacctccttgggagacggaaaattagtttataccactggaatccactgggtatattaaccacgctccagggcaggtctcatgctcaggagcaggtggccaacacaaaatagactccatgatttgtgtgtgggtcactgaattttttggtttgttttgtctttctggtttgttttgctttttttttaagagaggaagaatatgaattcgggtaggtgggtgtagtaagatctagaatcagttaggggaggggaatgaataggatcaaaacagatcatatgaaaaaaactaagaggcccataaataaaaccaaaacccacggttcaggggctggagcaaaggcacaatagtgaaaggcacttactactctttttttttttttttttgtctttttttgatttttttattttaattaggtattttcttcatttacatttccaatgctatcccaaaagtcccccatcccctcccccacttactactcttgcaaaggacctgtgtttggttcccaacacccacatagtggctcagaactactcctaactccagttccaggggatccaacaccctctcctgacctctgggggcatcaagcatgcacaagctacatacacatacatgcaagcaaacaaggaaaactgtggagcaaccagccacagtcacatacataatgaggccacgtacccttgcctcagagacagaaccatggtcagcaactgggccataatctgaccccgtttcaccctctgtctcttcactctcctctagagcccagtgccccatggatgctggctttttcttacagagccagcaacttgacttggatacagaccatgggggggggagctcatcttggacatttcaaggaggatagtggtgtcctagcactgaaggggcaatctctagatgggagagatttttaaagtcacaacatatttatatgttcatttatttgctgccttggttactgtccatgtactagacatgcgagctcatgaacacaaggaccttgcctgtcttgttctctccaagactctcagtaacaagaacagcatatgacactagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacggcaggagtgatgagagtataatgtgagaagtcaggtacccagcagaccacggctggaggccaaccagacaggagggtccatccatgagagtacacaatgctatgatatctaactctcattttctaggtaattggaggggagggtggttcctaaagtttggaaacagagaaagaacacagtagtgcaaccatgcagtggtgtagggggtggggggcggtccagagaaaggagatgtcaaaattagggaatgcagtctaccccatagatccaggtgggggatgatgggaatacacacgggtttgtggctttggagacagaaaggaagtgacaatacaagggaatgatggagagaaatgtctctactagatgccaagtgtagatactcagcggacccctgtgggtcatgttgaagccatgaaagaaaaacgaaaccacctcacttaagcctggatcatatagaaaagccaatgacaattaaaccattcctccaagaaaaaaaacatatccagaaagtagggctgcggttgcaaaggagtccctcgggtgagcaaaaggtctgtggaccttcgttaagaacccgattgagaagaggaagaaagactgagtggatcctggctgccacagagacatgggctgtaccagtgagaagggaagaagcagcaggaaagggggcaagatggggtgggaagaaggagacagttggtgcccagttggaagtgcttcatatgcacaggagactgtgcacaggacaggaggtgaagagggaaaggaagctgacatgagttttagaaggttaggggaggcaggttgctgagggaggagtaggtgaagctcacgggaggtctcaggtgagtactatctggatctatcacaagtattccatcattttgggaaaagtaaggggggctctcacctcatccaaaactgctcccagtgacgccaccctgcataccgtcttcatctctatgtttgcctgtatctgttctgccctcatcctgcatgaccccgaggtgacatcactaatgctcgggagtatcctcaggagaaacgtcttttcaggctctgtgacaagaacctcggatcttttaaacattttttttctgtttctttttgttttcttccttttttggggggtgggggtgggggtgtctttcatatgtaaggaactgaactatgtagaccttcctcttgggcttggctgacccctttgaagcaagtgtgtagtagattctgttttccaaatgtgtaagcatacattggtatgtaattttagactgctctccacttctggccccattttatcggccttgttttgttgctgttgtttctcatacttatttttgtaggttgtgtattcttgtaagtgatcctgaattcttttctaggacaacattgcacataaacatgaggaaatgcacgcgttatagcagaaggaggtcttaaagtccagaacgttgtggctgggaagatcacgggatgtgatagcaataacgagggtgttattaggccagtccagcagggacttagagacgccaggcagagctcagtctgggccacctctcttttcggtttactggctgtgagagcctggtgttctctaaatcttacgcagtgccctctttgcgtttggaggggtggcttaacgaggtaacatgtaggaaacagcactggatcagcattagctgttggtattaccgtggccatgttccagacaagtagcaggtaggtctcccctcttggccaggtctgctggcacgctgacattgcaagaaagcccctcccctagccttccactcccacttggctctcttggtctaccacacccacaaactcccaagcagcagcctctaacctgacagctcacctccacacccaccgcctcctccgtagtgcagtgcacacagctaagtcttctctttttttaaatatgccaaagagaactaagtgcgtagtagtttaggggggttctgccttccttgcccagacccgactgtgtaccctcactgatacatacaagacagtcctgccatccgggaaagggtctcagcagagcccccacccccacccccctaggggactcgtagccttgggtggaggcaactcttcgcaaggctctagctttgtcaatttcggggcaactcactctgcacccctcggacctaactcttgggctgggagagatgaatggcaggcggggatgaagggagacgctagggcggcgcaactcctcggggcgctaccaagtaatgggggcaggattcgaagaagaactgagggcgccccacgtttcctccagcctgatgataacatcaacgcctgtcaggtggttggtgcgagagagtgtgtgcgcgcgcgggagcgagcgtagggagcgcgctcgcacaaactttgtgcctgcgggtgagcctgggtcggctcgccgggctccaagagtggtcggctccgggctgcgagggccagcggcggccgagggatgcgcggcgcccggccgagccgatcccaccgctctaggtgagacggctccaggggcgcagagagccgcgaccatgggaaccctgggcaaggcgagagaggctccgcggtgagtagctgcgtctcctcggagagcgctgcacctctactggggaaggatagctgagcggtgtgccctgtggtcctctccagtgggtaccaggagggactagacgaccagggcgcctccctcggaggagagttgcctacaggggtagaccatgatcggggacctgggagccaggtcaagataggcgtgatacagacaacctcagagtccagcacaccaggtcgggaagaaagagttggggttgctggggtggcgaggccacaggtcacctgggcagatctggagtggtctgagcccagccaaacctttcacctacccagcgcccacaacagtcgacctccctggatgctctcggtctgggcaccccccgggaactcccactcgcacactttccgtgcccttggcacccgctgcgggcgcgggtctaggacagcgccaccttgcggactctcctggcctttcaggagcgactggcggcaatggctgcaagcggaggtggcagtgcttggctgccctttgaggaaaaagaagtttccaaatcaatggtctatgagtctacacccctccccttatactctacagagatgtttgggagacggaaggtgaaggaagaatggctatgaacagtctatctcttgggcagcaataaggagcctggggtgggggttggagggatgtcaagaaatttagtgtttgtcctcaaaacaccaggaccccgtaactgcctggacaccacttagcctttgttagggccgagaacgttgtgtccttcacaacgccattcacgtggactccgatatgacggcaccatgcctgatctgtaactatgcccattaaaattccctgttgggccatatcatcccctgagtgttctcaaccttaccttgcgctacactataatgggttagtccattgaattaactctgcattattggcggtgtggggcaggactggaagctacactcagcagaaatggccctgtgaaagctgccttttcttataaacaactatgagatgtcccggccctcctctgtttcctcctttgccctgtggataactgtgcctggagactaagtcccccaaatcggttcatacttcgaaacctctccccaggctctgtggggtggggaaggcagacgctaactactgcagggctgagaaaacatcttgaagttactgggtttctttcaagcttttgtttttgctgttattgttgttattttgttttatttaattcataagtttaactggaaacgtgtggctactgccctttaaaatcatgactttgtagaattagaggctgttcactcttcagatggttaaagcactctcaaagttgcctatcataaagcactgtaaaaatccttacctacaaccatctcaccaagaggtggagggaggggagagggcagaggacgtgaagcggggatctagcttggtgaagagtgtttgcctggcatgcaacaatcctgactttggtccctagcatcatgtaagaaagaaattaagatatttcttttaattcctttggttgcatcttggtggagtgataggattgttcgttttcaatcaggtatgatgggggcatatttgcaatcccagcactgaatagaaaagactaatacagagtttcaagccacatagtaagacccctgtctcacaaaaagaaaaacaaaacaaacaaacaaacaaaaccaaaacaagctaaaaaaaattctttttaaaaaaaatgtaaagaaagaaagaaaaagagaatgtgacctgagagtttttccagggcaagcagtcaagagactagacaaagcttacatgtgcacagagtgctgttggcttttaacactttgccttccctagtttctcatgccctctgaattgctcctcactgggctaggtttaggtagttgtcttttttctaggaagggaagggagccaagctaggaagtgtggcttggtgctaaggaagctggctgctaacctgctgtgcatctgtggccaatatatctctattgcatagctgtaggtgtttgggaaaggactgtggagagacgactagccagctcttgggtcctggtgaccatttcaggaacctactaaacaaggaagagctgagacgctgcctctgcatcaccagccatctttctgaagcacacggttgttatacattgaataagcccttttgggctcttgacaatctactcaccaatttcagtgcaggaataaacacacagtttcatgtaaaaaaaaataataataaagcctactagatgaataaaagcaagagggaccccagatactagtccctgagatagcccatatgaacagcctcagtatgtgtaggactcagtttcatatcacaaggtcgtatctttctagactgtagcttcagacacaatgcaaattcctgcacagtatctttggaacatggaaacttcatgcagactgttgctgttttcaggttatcagtttattctcagacactgatctgacagtctcagggtctggataaaagacggtggtggtcaagagtttagtggatttctgcagcaccaacctgattctttgggagtcgttggcttgggttagcatgttccaagtcaccagggtgactgcgctttattggtcctagcttggaactgagctccatgcacaccacagcccgatgctctgaagttggagcagaactggaagggccaaggtgactcctggagtctggctgtgtggtgtgtcctgtgttcagggtactgtctttgtgcaggctgatttctacaaacccaggtgtgcccagggtgggggcggggtggatttctgtttgtttgtttgtttgcttgcttgcttgcttgcttgcttgcttgcttgttttaactaaggatttgtttggcctcttctgagtgaggtttagaccttgtcagaggagctcttccacccagcccctggaagtgctttgccctctgctttgccctcgacaatcttgagacattcacctagaagttacgtggttacactcgctgtcttggtcagattcccctactaaagctttgtgtattagggaactatgagatggctttatacaagagtaactaacacgctatggacatgtataatttacagagaaagttacagaagccatctcaccacggtctcccccctggcccactgtaatatcttactcatgggaataagtatgcggcgaatcgatgcagacttgtgtttctagtatgtgctatgtttctagactgttaactccttctcttctttgacagttaaactatacattagccaagggtgcaatgagaaaagaactaagaacatgcaaaaaaagctaccagcaaaaatgcctatcattattaaaccttcaaagattatagacgtgggtctctgtgtggtttttaataaagaggaaaataaaacatactgcatgagacactttgcatggtgacctgtatcagccagatcacgccaagctaaggatgagcagacgaagcgccaccagactcctaagccatttccagatccaaaatggttactttatattcggttctagagcaggcagctcagctcagagccaacccctccccagtttctcttcgttgaggatcaatgtaaagacccgatggaatactgtttactggtctaagtgattcatagtggttccttgtgttatcaaaaatgaaaccatttattaaaaccaaccaagatgtgtaagaaatgcagagatgactgaaaaatctaaatgtcacccccctgcttcttcaagattctcaaagctagttcaggggacctcctgcccttctgtatctttggcattgcttaaatgaatgaaactatccaaaaaggatgctaactgaaccagtccttcagaccctgggtccgtagcctagcaactagaagctaagggctcccaaggaagcttcttccctctgcatctccccttctggaagagagacggcagcatagagcagtccttacaccaatggggagaaggctattgctgccctggaatctcaccttgccatttgctggggagatgtctctttaacagccaaccagtctgttcagtgcttttgccaagtgggaggggtatgccttctcccagcccagcttcagagactcactgtcctatctcctctttgcttggtcttcggagcctggagctgccattgagacccccagctgctctgtctatcctcacttgagtctctctttcccccaggaaaccttgccatggctccagagctggccccaaagcaagactagaggccaaatcaaccaacagccctctccctgcccagcccagcttggcccagatcacccagttccgaatgatggtgtccctgggacatttggccaaaggagccagcctggatgatcttattgacagctgcattcaatcttttggtgagttgggcaactgcccacctatatagagattgctgtgttactttgttctgtgccttaaaaagtgtcttatacaagagcaacctagattgtattttgcctttaaaaatagctttagagcttttgaaatgttggagacagtctgtagcgcttacggcacatgactatgtgggtggaataggtcgtgatgagaagtacaatttgaagtgagaacttagtgagcgaagttggcattttcctcgcatggtggtttgtctcatggtgaggggaaaaaaatcacaaattgatattgggtattcttctcctctagttcttgtggtcgaaaaatcctaagcctgtctcacaccgccaaatacaatttgaaaacttttaggtcatttggacaaataaggtctcgacagttcccccttacaatctggacttgtgctgtgtttgtgactagaagatgaggagcccatgtgttgcaggtcgaggtgggaggacctgagcacatgggcacataggccggcagcggtgtatggtccaggtgctcccctctgtactgccaacaagcagtgccctgaaaagatttctttttatccaaacattttcttttgatggttgcttatgaaatggtgacttgaaagtagtactaaatattgggtttgcttccaaaagggcaggattaaaaccgacagatttcagtgaaacccattaattcagagatgtttcagtgtccccacgtccccttttctatgctcatgcatctccctctgggaaggagatggattggtgggactcggctctgaagcatcagcccaccccagcctgatcctcctggagagcagaggggagttgtgctcagctctcagaagtggggactgttggtgtttaggcccaaacaaggaccttatttatagacttggggaagacttggcactttggggagattctttttgtgcaactgcctcagttttggtttaaaacagtgcttcttaaacattcttgcacacacagtttgggggttttgatttttttttttttttttttagtaatgcagatggctaggtcccacccccagagtttctgcctgagtaggtctggccagggtggggtccaaaaatttgcatttctaacgaggtcccaggtgaggccttgacagctgctcccagaactccactttgagaatcgctacttttaagttctgttggctgtagacttcttgactttgaaagaaagcagattgggtgtgtgactcaggctcagtgtttacctaacaggcaggggcttgagtgcaggctccatccctgaaaaagaaaaggccattcattctgctccctgttttatctttacccgaaagactaattcaagatgaattttctactgctaagctacatcttcacctccagattgaataactttgtgtctcaaaatcatcatagacgattttttacattcaaggagacagctagaagctggtggagaccagtggccatgtggtagtcattagtgttgttagataagctccttgactgctaattgtattcagtagacctgcagagagcatagtgtaactattgcatgaacaaggacctttactctctctttcactgctgagaacgctggggccatcaccgtgtttatcatgtgaacgctcttctttttctaccaatcatccaactacctgatgagttcagcctgttttcttacccttcaaatacctgtagcttcaacctcaaaaatacatggccagttctggagtcctttccagaaacaaccaatcagaacccactcccccaaccagccctacaaaggcaatggtgcattgtttcctgcaatatgtgaaggtaaaaagtggtgctttaaaaaacaggagctgagtaagtgccactgagactaaagctcctcaggccactaccaagaagcatttattaagtctgtaattatgcctgaccctgcactgggtggcacccaagaaagtcacagtgaccaagtgcctgtttcattagcacttatgacacctgtgaaatacccggttcaagaacacacacacacacagagactcacacatgcacatacctgtgataataagttaaggtgtggtgtttggaaaacacacacactcacacacacagtcacacactcacacacatacactcacacacacatacactcacacacacatgcacacacacttgataataagtgaaggtgtggtgttcaagaacacattcacacacacacacacacacacacacacacacacacacacacactaacaaatgaaggtgtggtgttcaggagcaagttccttgtactaggtagggtttgaatcagggcacttattgataaggaccagtcatcacctcacataccctgggccataggcatgctgtggacaaaaccccgagctttctgtattatatgttacagaatttcccatcacagagtttacatgaaagacacaaaacagccaaagcagggaagaattagaaggctgcctttgtgagtggcctcctcttgttatcagctgacctagctcttgtgggaggagctacactctgagccgtgaaaagccggtttgaagattaaggcaacttgactaattcctttctttactttttcctacctgctcatttcaccttcatgatgatgcctaggaagtatttcaggaggctgtgtacacagcacccacagggcccccccccccccgaacacaggggccattgtcatacacattttaattagttaaaacaaaaccaagtgtaaagtttagttcatgccacagcagccagccttccgagtgcttgatggcctcaggtggtgactcctgtgaaaccgagtaagcagacaatgcctgtggtcacagagtctgacttgggtacttgagagggaagacaactgacctgaggagacaaacggtaggtagatttttctggaaactgaggttttattcatgtctcaggtacacctaagggacaatctagttactgtttaaaacctcatgggcattgagacgtgtatactgaaagctgtctcttgagcataattaagtgttagttgtccatcccttccagcaactgctctcttggaaggctggaatagaaggcctttaaggatacgaatgcaaatgaaggtactgtggacggcccccagcaaacctctctgtatcagaaggttacagatctgtgattagaaacaccgagcctccattccgtggctttacccctgcaccagcccactcccaccttctgttttaatccgagggcatgctacccatcccgactgtggctgctagttaacgctatctgaggtagatcatcacagcaggtgaaacataccgtccgctaacaggttaaaggcctatgagaagcacttaggcttttcgcttcttcctcactttgcaagagggctctgagcattggggccaagtggaaaaatggaataccccaagttacaaggtgctttcatgtctcctctctgggcaagagaattctgatagcatcagggaacagttgcactcgtacctcagaaagcacggtagcaagcagttcctctgtgtccagatctggatgtcagggccgaggacagtgcatccaagtggcttatattatatggagtgttacttttttttcttggtgttctgtatgtattaatttttcttctatattcaaaacaaccctgaagtaggtcaagtattattatctccattgggtgaacaagaagaaaagtgggacatctgagatctgaaacaacacaccctgtacccaccatctaaatagaaaacaggctgcctttttcttctgcctctaccaccagcagctatttgtaccctgagctcgtgcagatgtgcctcacttcccaagacaggcctcatagcctcagaagagatttcagattttgtgttgcacaaggtaggctggcaacctgtgcttgctagtctgcaggcctggtctccctcagttagaaaccacattccgttcagtgcaagaaatagtcagacttcacctttataccatcaactgtctggttgaagttaatcgagtcaaacttatatttgtaagtttctatgtgtatgcattgtactaatgtttcccaaactagaaagaccctaaaaccagtaagagtagtttctgtactatgggctagttgaatactaagctccttatagaccttaaggaattatagtctttgagactggagctgaggaagggcaaacacgtgcttgctggaaccgctgtcccctccacagcaaagtgaaggttggatgttcctcatctcagctttaactctgcacactgaggcaaggtgtacaggagacaggcaccacaccacgctctatgacccagatgggtccttagcactgacacctgcaggcaccaagccacatatataaggtcacatatacaaagccttacctagggctgataacaacccccgagggtaagccacagctgtccctgaagcctcctcatggaattccccagatttacaaggtttctcgtagaaaacagcaaacagccatttgcggggggcaccctaccctaaacacctgggcgtgtcagaagtgcccagtatgtggagagaactggcattcttcgttcggtgtgccacttaagctaaagagccctttaccatgtctctgctggggtgatatcaaccagtgcccctgcaatatcttccctttcatgtgtgtgagttctggtgactcttgggtctgaggaaggagatggtttaaccctcttcacctcaaactttcctgtgtggcattatctccaggagccctccctgtgtactggggcaaaatcaggccttcagacgatgatgcctaagagccacaatttctcaggagttctgggtacttttcttcagtaggtggacccagaggaatgaatcttactgctgactgaaagacagagggtgtggagtagctgagcacttatggctcgtgggtgcagtgggggcgtgggcctttccctgatctgaccctgctgggcttctgaacagcactgtgccttgttagtttcctctcttagctgatagggaactgggactcagaagacggaaaggacacatgcctggcccagctcattactggcccagctgctgagaccaaagctcaggtcggctctctgaggcttgtgttctctctgctggaatagagtctcatcctgtgtgagtttgtcagacatgcagcccctcatgaactgataccgatcaccacttccctgtagcccgcttgctccttggacatcccagaacatgttcttaggctttctaggaaaacaaaaccaactacaaacagctctgagaagcaatggagccagtaggcttttcaatttataaaccgataaagctctcggggaagccagaaagcatgaaagcggtccagcaaggtttaattagagacactctttgcctgggagcatgttggaaatcccagcacaagctagcagcaaaatttacaacctgtcagccttacacttgggacttggggatgggggcagtacttcattgctctccaagacttttcttcaggcttacatttgctgctgtggggagatggtcagatccattcctgatgctacagtaaggtctccattcttgtctccagccagcctcctggactcacaggccttccagaagaggctgagctgggaggagccagagggaagccctgaacaaccagccagatgaacctgtttgccagtagattctttaaggctttcattgggaaataataggaattccacagctgtctgttttgttatcagaacaggggctggccctctgagagcctcggagaagggcatcttaggggcaaacttacctcctggccctctaattgttgcctcatgcctgaagcacttggtgaaactaggtacttcaatgccaaacagtcttgacatccttaataatccttaataatttaattaattattaataatttaatgatccttgctgattcaactataatgttgaaaggggggcatcttttcatacctattggatcttaaaaaccacatggcctgtcatgagcgtgagaatactaagaatggatggcggtgggtgtcttgccaaatgctgacgatgtcgaggagatgggcctgtaacatattatattttttatgaacatggaagtgtgagtatgagagtggagggagatgatagcctgatctgccagctgtggcatactggatgattatccagcacacaagatctaacctgttctattttgtctaattttgcaagccagttgttaaacatagccaccattaaagagtctgttatttacatgtgtgctgagtaagttcatagaagacaagcattggaaattggtcactttctaatgcgtggtcatgtttactgttctgtgtgcttaggagggtgtgtccatcatgcctgtatggtgaaaaacactgcagaggcttttgctgcagtgtagtgcagtgcagtgcagagcagggcagcgcccccactggtccatctgcagcaaggcaggctgggagcttggctttgccagtgtagtcacaccttggaaataagcaacattactgccagcccagcctcctcaaacccaaccccctaagagctcgaggttaaaggcttaccagcataacaccattgtcagtactaaaccccggggcgctgtcagagcagagtctagagggaggggaccctcaaagctgacaatcttgttctgtatcactcagttaggagtaaggctaacatagtttttgggtctttcataccctaagtaaccaacctccttgtctgtggtcaagacaagacaaggcaagatgaagaaattaaacatcaacaaagctgggattttcttaaagacgttattatggaacaaagataaatccaagagatttcatttgtaattgaaccaattacatatatatatatatatatatatatatatatatatatatatatacatacatatatatatatatattttttttcccccttaactcacctccacacattctgcaggattaagcgtctcttactttttcaatttcttatacttctgacctccacatgtatgacccatctctatctgcttagggctccgtctgcagtgttcatttgcttttattccctctgcgtgttgacagcttcagtggaatgaacacacgagctttgctaagcaggtgtttttttttttgtttgtttgttttttttttttttttgtaatgagtttgctgtgttcctgatcatgaacagtctcttcatacctgtttgttatctgctgtttacggttctatattgctagaggtttggacctgttttcttggctagcatttgttgatgcctttctcctattttcatcccttcattatttttactcttacaatacgtagaaattccatggttttatgtagttaaatttgtcttagccttttaaccctttattaattctaaacttaaaatctatacttcacccacttggaaaatatcttcctgtcattttaattaaaatgaaaattattttaattcattcagtgtatataatatgcattatacagtcttgggaatgatcagtaaagtttgcaagttattgctggaggagagaaagcctttggctttatttctgggattagcttaaagccggtctgggtcctactacacactagactactgcacacaggtcattttggcactcagaaccctgctctctctgactctgtcacagatgattaaaatcagttctaaaaccaagcagtgtctggaggaagaaatagcgtgatctcaaatatgatattgaatgtgaacttgaaggaaacccttcagaactgatgtataaagtgcttttaactgtttatagaaccaatagccttagaagactaaaactctcgtcacatttaaatctcatttttctaagttatttctgtagagtgaacctatgttgctcctaagtaggccgttttgtgacgagatacataaaacattaacagtacttatctatttaaatattcactgttattttagaaataaccagcctttggataattattgtgaacagtaccgtgtttatgttaatattatatatatttatttaattcacactcttatgttcctataactacaaatatttaactaatactcaaaattcatatttttaaaaaattttaataacttttaaaaaccatttgcttcactctgggaaacttcagaaatacagtttaaaaatgaaaagcattggggctggagagatggttcagaggtcaaaagcactggcagttcttccagaggatcctggttcaattcccagcacttacatggtgactcacaacgatctataattccagttccagtaaatctgacaccctcacaaacacacatgcaggcaaaacacgaatgcatgtaaaacaaaattaaaaatcattttaaaaactttttaaaaggaaaaaaattacagttctgtatcctacccccacaaacagtgttagctatgaacattcttggatttgtctcagcgttctcctatggatatgcacggatactgtgaacatagtgcatgtcttgtgatagattctccatacctctgtgtgttcaatattcacatcttaaccaattgtgatcctgcgatgaacattactacgtgccaagaagcgtgctagcatacaaggtttctactctatcctaaaattgatcctaagaaaataatgctggcataattccatcaaatatgggacataaaattgagggttgcttggcaaccaaaatgacgctgatgaagaattaaaggcatttccagagaagaagaatactgatttttccaatgtaaagtgctaattataatagcctagggctgattacagatagaatgaatgaaagggagcaatacttaaactaactgaaaatccaagaggcaagcattcttcttcgttatgtgtggcgaaagtgagttaaaggtttactgtcagaaacgaagaataaaatctcttgccttcattataacttctctaagttataatgaaggagcagtgaggtgggatttatagcagagcctagaagaggctgaagtctgctcagtccagctgcttttgcagtgactgtgaggtggcgggcagcatctgaggaggccgtactgtttccttcctttttagtgcagaacaggccagggctcaggcactgagcatcttgctaaatggttgtaccgtttggcagaaccagctgccaagatggagcttgaacaaggggcacaccagtgattgactgaaatgaacaaaagaacataggtactactacaggaggaagaaagagcagagagtactaattttatcctgaaggagaacacggattcataggagcaagatgggtgttgagtataaaatcatctgaaggctcagatggaaagtgagaattcccaagtagaagagcagagagttcttctgtctcctctcagtgatctgccgaactgtagtatggacttgtttatatgatcttttgaacagccccattttaaagaggaactgaagcactcaggaaacgggtgtccccctaattatcatatgtgagtgagtgtacttgttaacatatagtcacaccctacagagcacccttgagtctgttgagcagttggctaactctgcgttgcttgcttcctgcgtgagcatagggacttttccatacttccttcctttctttcacaccttggattccaactttacttcatccaagagcttcgccatttacctccaggcctgggccactccaaccacacaataaagcagttagcatctgatacagttctttccagaggtcagccacaggagccacactgctggctacccagctatcttcagttcctgctaaggatgagtcctcactctgtaataacttgtgagttggctctactctatgaacatactccccttacttattgtgcctatagtctcccgcactgcctgcgtgcccaatggcttagagtcctattaccttgtcaccaatcacaggtagatttagctaactgaggaagtggaccttcatagtgtcacaggggaaaatatgaa

SEQ ID NO: 1032 - DNA, 2451 bp, Mus musculus
ggatccgcggccatgggaaccctgggcaaggcgagagaggctccgcggaaaccttgccatggctccagagctggccccaaagcaagactagaggccaaatcaaccaacagccctctccctgcccagcccagcttggcccagatcacccagttccgaatgatggtgtccctgggacatttggccaaaggagccagcctggatgatcttattgacagctgcattcaatcttttgatgcggatggaaacctgtgtcggaataaccaactgttacaagtcatgctaaccatgcaccggatcatcatctcctcagccgagctgctacaaaaagtcatgaatctatataaggatgccctggaaaagaattctccaggagtttgcctgaagatctgctattttgtcaggtattggataacagaattctggatcatgttcaagatggatgccagcttgaccagcaccatggaagagttccaagacctggtgaaagccaatggtgaggagacccactgccacctcatcgacacgacccaaattaattctcgagactggtccaggaaactgactcagaggataaaatcgaatactagcaagaagcgcaaagtgtccctgctgtttgaccatctggaacctgaagaactgtctgaacacctcacctaccttgagttcaagtccttccgacggatatctttctctgattaccaaaattaccttgtaaatagctgcgtaaaagagaaccccaccatggagaggtccattgccctgtgcaatggcatctcccagtgggtacaactgatggttctcagccgtcccaccccgcagctccgggcagaggtcttcatcaagttcatccatgtggctcagaaactccaccagctacagaacttcaacacgctgatggctgtgatcgggggactgtgtcacagctccatctccaggcttaaggaaacaagttcacatgtcccacatgagatcaataaggttctgggcgagatgactgaactgctgtcctcctgcagaaactatgacaactacaggcgagcctatggggagtgcacccacttcaaaatccccatactgggtgtgcacctcaaggacctcatatccctgtatgaggctatgcccgactatctggaagatgggaaggtgaatgtccaaaagctcctggccctttacaatcatatcaatgaattggtccagctgcaggagatggccccaccattggatgccaacaaggacttggtgcatctgctgacgttatccctggatctatactatacagaagatgaaatctatgagctttcctatgcccgggagccgaggaaccacagagctccgccactgacaccttcgaagccaccagttgtagtagactgggcctctggagtgtctcccaaacctgacccaaagaccatcagcaaacacgtccaaaggatggtggattctgtctttaagaactatgatctcgaccaggatggctatatctctcaggaggagtttgagaagatcgctgcaagctttccattttccttctgtgtgatggacaaagatagggaaggcctcatcagcagagacgagatcacggcctacttcatgagggccagctccatctattccaagctgggcctgggctttccacacaactttcaagaaaccacttacctgaagcccaccttctgtgacaactgtgctggctttctctggggcgtgatcaagcaaggctatcgctgtaaagactgcgggatgaactgccacaaacagtgcaaagacctggtggtgttcgagtgcaagaagcgaatcaagagcccagcaatatccacagagaacatcagctctgtggtaccaatgtccaccctttgtccactgggaaccaaagatctgctccatgcacccgaagaaggatctttcattttccaaaacggagagattgtggaccacagtgaggagagcaaggataggaccatcatgctcctcggagtgtcctcccagaaaatttcagttcggctgaagaggactgttgcccacaagagcacccaaacagaatcgttcccgtgggttggtggcgagacgacccctggtcactttgtgctgtcttctccaaggaagtcggcgcagggcgctctttatgtgcacagtccagcatctccatgccccagcccagcactggtccgaaagcgggcattcgtcaagtgggagaacaaagagtcccttataaaaccaaaaccagaacttcacctccggctccggacctaccaagaactggaacaggaaataaataccctgaaagcagataacgatgctctgaagatccaactgaagtacgcacagaagaaaatagaatccctgcagcttgggaaaagcaatcatgtcttagcccagatggaccacggtgatagtgcttaatccagaatttcaaggaccagaatctgcagacgggtttactgggatgtcgac

SEQ ID NO: 1033 - DNA, 2451 bp, Mus musculus; identical to SEQ ID NO: 1032

SEQ ID NO: 1034 - DNA, 94810 bp, Homo sapiens
  misc_feature (10318)..(16791): "n" at positions 10318 thru 16791 can be any base
  misc_feature (32104)..(32123): "n" at positions 32104 thru 32123 can be any base
  misc_feature (44534)..(44553): "n" at positions 44534 thru 44553 can be any base
  misc_feature (67856)..(67875): "n" at positions 67856 thru 67875 can be any base
  misc_feature (76152)..(76478): "n" at positions 76152 thru 76478 can be any base
  misc_feature (83364)..(83433): "n" at positions 83364 thru 83433 can be any base
  misc_feature (90138)..(90268): "n" at positions 90138 thru 90268 can be any base
ggtgcttgggagggcatggctggagaggtaagatccagtcatgcaggtacatgatgttaaaaagtttgcactttattctgtaggcaattggagactcctaggcagtttagaagcaaaagaattatgtgaccatgtacatgaaagaagcaacatgaaagaagaatcagagaaaaggaggttatgtaattagggacgccagttacaaagctattacacatgtccaggtaagagatgatgggggcttagaccagcatgtggctttaaagatggagaggaagcccttgggaacaatgaaaggaggtggtggttgaaaatgtgggtctaaatgctaggtgacaaaggtggatattcggacagaagagtcatataggtcctgctgaggccatgggagaaaattaaaacacctactttgagtaacggatcatttagaaaatctgaagaaagctaacaacccttcccccagaaaaaacatacacaaaaatttagatatagtttcagaagcttcacatatagtatagtcccttctccccagttaatctcctcatggacattaattaagagtccatgattgagagaaggaagaataacaaagaaagcatccagaggaagggcctcacccaaggggtgagaagaggaagactccccaaccagacacctaggaaaaatagaagagagggtaaatgagggtacaagataacacacttgggtggctggcaagatggccaaataggaacagctctggtctgcagctcccagcgagatcaacacagaaggcacatgatttccgcatttccaactgaggaaactggctcatctcattgggactggttagacagtgggtgcagcccacggagggcgagccaaagcagggtggggcatcacctcaccagggaagtgcaaggggccagggaacgccctccctagccaagggaagctgtgagggattgtgccatgaggaatggtacactctggcccagatactacacttttcccacagtctttgcaactcgcagaccaggagattccctcaggtgcctatgccaccagggccctgggtttcaagcacaaaactgggcagccatttgggcagacactgagctagctgcaggagttttttttttcataccccagtggcacatggaatgccagtgagacagaaccattcactcccctggaaaggcgtctaaagccagggagccaagtggtctagctcagcgtatcccacccccacagagcccagcaagctaagatccactggcttgaaattctcgctgccagcccagcagtctgaagtcaacctggcacactcaagcttggtgcggggaggagcatctgccatcactgagacttgagtaggccgttttcccctcacagtgtaaatgaagccgctaggaagttcgaactgggcagaacccactgcagctccacaaagcctctgtagccagactgcctctctagattcctcctctctgggcagggcatctctgaaagaaaggcagcagccccagtcaggggcttatagataaaactcccatctccctggaacagagcacctgggggaaggggtggctgtgggcctcctcctggctctgaagagagcagtggatctctagcacagtgtttgagctctgctaagggacagactgcctcctcaagtgggtccctgacccctatgcctcttgactgggcgacaccttcccgcaggggtcgacaaacacctcatacagaagagctatggctggcatctggcaggtgcccctctgggacaaagcttccagagaaaggaacagccagcaatctttgttgttctgcagcctctgctggtgatacgcaggcaaacagggtctggagcggacctctagcaaactccagcagacctgcagcagaggggcctgactgttggaaggaaaactaacaaagagaaaggaataacatcaacatgaacaaaaaggatgtccacaccaaaaccccatccaacggtcaccagcatcaaagaccaaaggtagataaatccatgaagattaggcaaaccagcacaaaaaggctgaaaattccaaaaaccagaatgcctcttctcctccaaaagatcacaactcctcaccagcaagggaacaaaactggatagagaatgagtttgacgaattgacagaagtaggtttcagaaggtgggaaataacaaactactccaagataaaggggcatgttctaacccaatgcaaggaagctaagaaccttgaaaaaaggttagatgaattgctaactagaataaacagtgtagagaagaatgtaaatgacctgatggagctgaaaaacacaacacgagaacttcgcgaagcatacacaagtatcaatagctgaatcaatcaagtggaagaaaggatatcagagactgaagatcaacttaatgaaataaagcatgaagacaagattagagaaaaaagaatgaaaaggaatgaacaaagcctccaagaaatatgggactatgtgaaaagaccaaacctacatttgattggtgtacctgaaagtgacggggagaatggaaccaacttggaaaacactcttcaggatattatccaggagaacttccccaacctagcaagacaggccaacattcacattcaggaaatatagaaaatgccacaaagatactccctgagaagagcaaccccaagacacataatcatcagattcaccaaggttgaaatgaaggaaaaaatgttaagggcagccagagagaaaggtcgggttaccctcaaagggaagcccatcagactaacagtggatctctctgcagaaactctacaagccagaagagagtgggggccaatattcaacattcttaaagaaaagaattttcaacgcagaatctcatatccacacaaactaagcttcataagtgaaggagaaataaaatcctttacagacaagcaaatgctgagagattttgtcaccaccaggcctgacttacaagagctcctggaaaggaaaaaccagtaccagccactgcaaaaatataccaaattgtaaagaccatcgacactatgaagaaactgcataaactaatgggcaaaataaccagctagcatcataatggcaggatcaaattcacaataacaatattaaccttacatgtaaacgggctaaatgccccaattaaaagatacacactggcaaactggataaagagtcaagactcattggtgtgctgtattcaggagacccatctcacatgcaaagacacacatagactcaaaataaagggatggaggaatatttacaaagcaaatggaaagcataaaaaagcagggcttgcaatcctagtctctgataaaacagacttgcaaccaacaaagatcaaaaaagacaaagaaagacattacataatggtaaagggatcaatgcaacaagaagatctaaatcgtaaatacatatgcaccaaatacaggagcacccagattcataaagcaagttcttagagacctacaaagagacttagattcccacacaataatactgggagactttaacaccccactgtcaatattagaccgatcaacgagacagaaaatgaacaagggtattcaggacttgaactcagctctggaccaagcagacctaatagacatctacagaactctccaccccaaatcaacagaatatacattcttctcagcaccacatcacacttattctaaaattgaccacataattagaagtaaaacactcctcaccaaatgcaaaataatggaaatcataacaaacggtctcttggaccacagtgcaatcaaattagaactcaggattaagaaagtcactcaaaaccgcacaactacatggaaactgaacaacttgctcctgaatgactactgggtaaataaaaaaatgaaggcagaaataaataagttcttcgaaaccaataagaacaaagacataacataccagaatgtctgggacacagctaaagcaatgttaagaggaaaatttatagcactaaatgcccacatcagaaaggaggaaagatctaatattgacaccataacatcacaattaaaagaactagaaaagcaagagtaaacaaattaaaaagctagctgaagacaagtcacaacaaagatcagaggagaactgaaggagatacagacacacacaaaaaaaaccttcaaaaaatcaatgaatccaggaggtagttttttgaaaagattaacaaaatagatagcccactagccagactaataaagaagaaaaagagaagaatcaaacagacacaataaaaatgataaaggggatatcaccactgataccacagaaatacaaactaccatcagagaatactataaatacttctatgcaaacaaactagaagaaatggataaattcctggacacatacaccctcccaagactaaaccaggaagaagtcaaatccctgaatagaccaataacaagttctgaaattgaggcagtaattaataagctaccaatcaaaacaaaagcccaggaccagttggattcacagccaaattctaccagaggtacaaagaggagctggtaccattccttctgaaactatttcaaacaatagaaaaagagggaatcctccctatctcattttataaggccagtgtcatcctgataccaaagcctggcagagacacaacaaaaaaagaaaatttcaggccaatatccctgatgaacatcgatatgaaaatcctcaataaaatactggcaaactgaatccagcagcacatcaaaaagcttatccaccatgatcaagtcagcttcatcctagggatgcaaggctggttcaacatatgcaagtcaataaatgtaatccatcacataaacagaaccaatgacaaaaaccacacgattatctcaacagatgcagaaaaggccttcaataaaattgaacaccccttcatgctaaaaactctcaataaactaggtattgatggaatgtatctcaaaataataagagcaatttatgacaaacccacagccaatatcatactgaatgggcaaaagctggaagcattccctttgaaaatcagcacaagacaaggaggccctctctcaccactcctattcaacatagtattggaagctctggccagggcaatcatgcaagagaaagaaataaagcgtattcaaataggaagagaggaagttgaattgtctctgtttgcagatgacataattgtatatttagaaaaccccatcatctcagtccaaaatctccttaagctaataagcaacttcagcaaagtctcagcatacaaaatcaatgttctaaaatcacaagcattcctatacacaaataatagacagagagccaaatcatgagtaaactcccattcacaattgctactaagagaataaaatacctaggaatacaacttacaagggatatgaaggacctcttcaaggagaactacaaaccactgctcaaggaaataagacaggacacaaacaaatggaaaaacattccatgctcatggataggaagaatcaatattgtgaaaatggccatactgcccaaagtaatttatagattcaatgctatccccatcaagctaacattgactttcttcacagaattagaaaaacctgctataaatttcatatggaagcaaaaaagagcctttatagccaagacaatcctaagccaaaagaacaaagctggaggcatcacactacctgacttcaaactatactacaaggctacagtaaaaaaaaaacagcatggtaccagtaccaaaacagagatatagaccaatggaacagaacagagccctcagaaataatgctacacatctacaaccatctgatctttgagaaacctgagaaaaacaaacaatggggaaaggactccctatttaataaatggtgttgggaaaactggctagccatatgaagaaaactgaaactggacccctttcttataccttgtacaaaaatcaactcgagatggattaaaggcttaaacataagacctaaaatcataaacaccctagaggaaaacctaggcaatagcattcaggacatagacatgggcaaagacttcatgactaaaacaccaaaagcaatggcaacaaaagccaaaattgacaaatgggatctaactaaactaaagagcttctgcacagcaaaagaaaatatcatcagagtgaacaggcaacctacagaatgggagaaaatgtttgcaatctacccatctgacaaagggctaatatccagaatctacaaagaacttaaacaaatttacaagaaaaaacaaacaaccccatcaaaaagtgggcgaaggatatgaacagacacttctcaaaagacatttatgtggccaacaaacatatgaaaaaaagctcatcatcactagtcattagagaaatgcaaatcaaaactacaatgagataccatctcatgccagttagaatggcaatcattaaaaagtcaggaaacaacagatgctggagagaatgtggagaaatgggaacacttttacactgttggtgggagggtaaattagttcaaccattgtggaagacagtgtggcaactcctcaaggatctagaaccagaaataccatttggcgcagcaatcccattactgggtatatacccaacgggattataaatcattctactataaagacacatgcacatgtatgtttactgcagcactgttcacaatagtaaagacttggaaccaacccgaatgcccatcaatgatagactggataaagaaaacgtggcacatatacaccacggaatactatgcagccataaaaaaggatgagttcatgtcctttgcagggatatggatgaagctggaaaccatcattctcagccaactaacacaggaatggaaaaccaaacaccgcatgttctcactcataagtgggagttgaacgatgagaacacatggatacagggaggggaacatcacacactggggcctgtctgggggtgggagctaggggagggatagcattaggagaaatacctaatgtagatgacgggttgatgggtgcagcaaaccaccgtggcacttgtatacctatattacaaacctgcacgttctgcacatgtatcccagaacttaaagtataatgatttttttaaaagcacgaatattatcctcattagctaccttataagaatgttatattaaatgatgtattttgtgaaaaaaaaaaaaagtttgttcttgaggtcagaggtgcctcatataacaccaggcagactaatcacatggccgatgattaaaagagacatagacaaacttctcattttttagatgtttggaaaagacttattgctcaggtaggagtagccagaaaacctcaaaaaagagctcgagggggcccagaagcagaatcagatgcaagtgaagtgcagagtactcagaaagtccaagagaaaaacactcgctgggcatatgtaggcctctttctttagaaaactcagcaagactcatgtattgaatgaattaataaccttggtttcaaccatttgtatatatgtggactgtaggtgtgcagatgtgtgtaactgcctacatgtgcacttagtattatgcatatatgtatatttacatataaatataatgatgcatttacataaaggcatccatttggcatacatacctatgcatatgcagtataaggctggattattcccctgccacacacaaagattttgctgtccaaagactcagtgcaatgaatggcatggaaggggctctattttcaagggtgaagcaatagagaaataccgaaggcctcggataacctgtgatggggatcccacgaaagccaccggggacagtgccagtaagcttatcactcctgccatagacagcggacttcaaagaaaaactgaaaccctttctccggaaataatcaggaaggatcttattttcttctttgaggtcagcacattttgcttttcaaaatcaaatccacagcagttcattagtaatgtcccacaggtactgcctcaagttggcagctgtggaagctaaagaagcataagacctgattcttgacctcggacaatttacagtttagctgtggaggtaagacagggacacagaatattatgtggcaattgaaagtgtaaatattatagatttaagtagggtaaagagctcattctgtagtagaggggtcagtgaaaagtaattgttcacctggtaataagagaagatctctgtgaacaaagtctaagactgcaaacttaggactgttgggagatagtcagatagattcatatatagatacaaatctttaccatcctcagacatccgccaacttggttgtttaggttgtagggcttacatgaggaagggtgtataatagataactctaaaaatgtttgagccttagacccagtgagtgagaaagagtgtcatcatttaatattctcctgacattcacctgccccttctgcatctgtggctgtgactgaggacttggttctttatatcacccagtgttcatgaggattctctggagaaatttcttgctggtctcagtatcaagaaagggggatcttctcttgagcaattttgtttttggtcttgcatgtgataggaattgaactttagacaaggcctctctttaaacttgactgctagaaatgcaggagacaaattttggtcccacctgtagcaagggtatttgactctatgagatgcatttatttcaaatgatgttcatttttggctccatcttgtgtgcctcatttttcatttcacacacttctttttgtaggttatgtgctcttgtaagctatctcgaattctgttttaaggacaaggtagcatataaatataaggaaatatataaatgaaacagaggaaggctttaaagtccagaacactatggccaggaagacaactatgactgtggctagagttatggtctgtggccgtgataatgagtgtgttattagggcagtccagcagtgattacagggagtcagacagacctcagtccaagtcagaggtctctctgctgtttattagttgtatgatctaaggcatagcattctctaaaccttcattttctcatctttacaacagtgatctctttgtatcagggagagtggattaaatgaggtaatgtatagaaagcacttagcacaaccgcactcaatcattagctattgagattatcagcactatcacctggacaagcagcggatgggccgcccctcttggccaggtcttctgtgcgcactgacgttgtatgaaagttgtccccacatctcctacacccaccgacgccaggcggccgcgtctgggccagatatggatcacgcctgtggagcgcacctccacacaggcagccctcgtccaaggtgcagggcgcagggcacagggcacatgtctacggcccagtcctgcagacggctacctagagaccccagggcacaggttaaggcaacttcacaactgtctttccgttcctttcccctgccggactccgcgctctgatatatacaggagaggccctggaggggagaaggcgtcctcactgcagtgctccgagcagcggccgcaggaagaggcgtggaagctgcgggtcggctgcgggaaagggggtcccatgggagccgctagcgcagcccgtttcccgagctgaggtggaggtcgaaacgcacaggtgccctgcaaggcgcgggcgtggtagccgggagcccgctcctctccaactcccctgagacttaaccctttggccaagagaggtcgaaggcgggcaggggtgagagaaccgcgaggcgcaggccgggcacccgcggaaagggggcaggtttcggggaagagcggggcgccgcacgtttcctgcagccgccagcatcagcgtgtcaggtggttgccaggcgggtgtgagcgcgcgcgcgaggcagagggggcgcgctcgcacaaagtttgtgcctgcggtgcacctcggtcgggctcgccgggctcgagggctggcgggcgccggggctacgaggcccgggggggagagagccggcaggcggcggcggtggtggcgggggcgatgcgcgcgcccggccgcgctaggtgagccggcaccgggagccggccgcggccatgggcaccctgggcaaggcgagagagctccgcggtgagtagaggcgcagtggccctcgggagcgcctgtgtcctttcttgggaaagaggcccctgcccgtcgccccaacaccccgagggaagttgagggcggaggggggccggggtcggccggagtcccgggacaccagcgcgacgggcggacgtgtccagaacgcccgcgcgcccggggtttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggctgacgtggggccattgttcatcatgtactccactctcacttccttcccaacctgaataaactgcaaagttccttacaccatttcagcagtcagatttactcggctttagcaggccaccatgactatttcctgaataaggatttttcttctttctgtttcactattgaaaaaagagggacgagaaacatgtttatcacaccaccttccttccttccatacctgttgtgcaactgccggccgagttcaagactgtttttctaatcttcaaagaatcatgttatcaacctgaaaaatacatgactgattctgaagtccttcccgccaaataaccaagcctaattcaatccccttaacagaccttccaaaggcaacgacaatatattgtgttctggaatatgttgaactgaaaacaatggcttaaaatcccaaagctgtaaaagtcccgttgagtctaatagtcttttatccattatcaagcagcattggttaagcccttaattgtatctgacactgtgctaggcagtgctcaagaagaattacagcgaccaaactctcccttccattagagcttacaacacctgagaaacatactgttcaggaaatatatatatatatatacacacacacacacacacacacacacacatatatatacaaaggacagggtgataaataccgaaggcatgcaggaagagtaagtttttataccatgtagagtttgagtaagtgcacctcatgggtgaggacataggtcaaggagaacagccaccatttgttcaagtccctcacgggccaagggaatgctgcgggaagtcagtaaggtaagatctcagggttttgtgtattatgtactgcagagtttctcatcacagtacatgaaagaggcaaaaaagaaaagacgctctgtgtctggaaggaacagaagccagcaccttttgtctgtctctcttcttgctctttggttatcagttgacccatctatggggctgggacatggaaattgggctacagaggaaatggagccaggaatcagcagcagactttatgagggagaaaagcccatagcaaaatatatgcctgtgcttccgtaggtctctttaagaggtcatctgacagtagaacagagtgaggctaatgcttctcctgaagtttaccttactggttagtttctcaggtttgtagagaaaagtggtgctttagattaaagcagtctagctagctttttgttaatgagtttagatgtcttctcattttaaacccacgaaaaactgtacagaagtgtggaggggaaattattatcattattattattgggactcttttgcctcagaccgtaatttcagctactccacccagcaacttgaataaaagagggaaagaaactgttttaaagagaaagactgaataattgttaatttagtttctactgcctctcaacctcaccttcttgctttcaggaggtttgaattggctacagctgtgctgtccaatgcactggccacatgtggctattttcgtatacatttcaattaaagttaaatgtaagatttcatttctaagcctcaccaaccataggcgaagtgtgcaatagccacaaatggcacctactgttggacagaggagagagcacttccattgttgcaaaaaagtcagttggacaatgctggagagggtagatgtttgtcgcaaaggaaaaaagaatagattttctacaaactgtgggatttgcattttgctagcatttctagataagagtctgagtattgcttaaagcatcgtgggcattcagaagtctcactgatggctatctctttagcattattaaccattaattaccacccacactgttctcagaagaaggacttatattgcttttaagggcagtggctagtacatataaattaagagcactttcaaaggcctctagcaagcctctcagtgtcacatacaaggttacagatctgtgactagaaacttacggccttgagtcatagttcattgctttaaccatgaaacaacccactcccgccttctgttctaaccagagatcatgctttacattctcagcatattattgctagttaatcctctcttcagctgagcataataaggcaaatcatcacaacctggttacacttatgtcaaatatatgtgaatcacaccatctgtttcagaggtagaaaagacctatgagatcatctgggcttttattttttttccctttacaagagggctgccagcatttggggccaaatggaaggcttcaaatgtctgaattcacaaagctctttccttatctccctctcaatgcaagacaacttctgacagcatcggaaagaaaactgcacacctgcctcagaacgggcccccccaacacacatacacaactccaccccagcaagcagacctcctactcccagtgagacgtgggaagaaactccatgtttcatcttacctattagtgtgaagggaaatgcttcctaatatcttctatttatggactgacttattttttcttagagttccatttgtattgattttcttttatactgagaacagctctgaaataggcaggtcagatattactctctccattgaacaaacaggaaaataaacctttgagaactgaaagaatttgccttgtgcccccagtctcaagagaggatatgctgctcctgttctccttcccctacccctagcagccacttgcaacctgggttggggcaagcctggatctctctcctaagacaggccttcctacactcaggggagacctgcatgccacataggacagggctgcacctggtgcccactcttctgcaatcctggtgtctccccagttagaaatgaaactccattcaatgtaagaaatattgattgcacccaatctatataccaggtgtctgcctgatattctctattgagcaaagtgtgaatcagtgaattcttgtgtgaattgtactaatgctatccaaagaccttccaaactagaaataccccaaaactaataagtatgttttctccaccatgggagcagttggatattaaaagcattttataggcctcagcttattgaaagtaaaacattccgtctcttttcaaaatgggagccgcaaaaggcaaacacacactcagggccatagccctctccgtaacaaaggaaagattaggtatttcttaccactctgcaacttggtctgtgcaccaaagcaaggtgcccagagggcaacaggagcataagaccagaagccaagggccatgacatcattggggatgcagacctaataacaggcaacaccaaggaacaaagtcagttgtagtgtcaggaaggggccgaagccttagccactgttgatggcaggccctgtgtgaagaacacagctttcccagaagcctcctcagtggaacctcccagtcgctagtagtcgtggctacaagatttcacgtgtaaaggatggtcctcgggggcacttgcatcctgaggcttctagtcatcagagcagctcccaggccgctcttagccctctagaatgaattagcattattataagactggacactatttattccaaggaggcctttgctgcatctttgatgagcaggcatcaccagttctccacgctggtctgccttctcatgagcatgggtttcagtgactgccaggcctgagaaaggaggagatgggaaatccccttcattcatatctgtgctctcctgcttggcagtgtttgttgcaggccccgctgtagagaacagaggcaatgcttatgcgtaagttagacagtgtctcaggaattctgagcagttcaattcagtaaagccatccagagagatgagttttacttctgagagagctggagacagacagtagtttaacacttattgtggactctgtaggatcctgagcctttacctaacttgacccaattaatcctcccaacaaccctatgaggtggttgttattttgctcctttaactaatagagaattgtagctcagggaagttaaatgacctgtggaaagtggttcagctcattagtgagagagctgctgagatgtgaactctggtcagtcttcccccgaggttcgcgttctttctgctactccagagattctccaactttggcgtgaggaataatcagggagtgtgttgaacattcaaattcctcacagtcaaccccagagattgccattcagccagcagtcactggtttggatggaggtgacccatgaatggatgttgagaaatactgtcgtatagcacacttgcttcctgaacatcccagatcatttttctcagacatcctaggaaaacctgaagggcacaaatctccagggaagcaatagagcatataggtttttcagctatgtgaactagaaaagcacatggtgaagccagcctcttggagatctctaaaacaatccagccagatctaatgagatccctgcctaagagcaggtctgaaaccctgggagcacttttatcagatttttctgcattcctatctcttctcaactgcagtaagccccctataaaatgtacagcacgcctgtctgttggctgtgtaaatagaatgtggatgtctgttacaactacagtttgattcttgcattcaaaggccatattcctagtgtacatttccacctttattcaacactccagtttcctatggtgctgggagggtctactccgtaacttatgcccgtccccatgggtcagaggactacagtagtggcttagctggggaggaactggggagtgcttctcctgagtacttacccaaaagtactactttggcaacagattatgtaaggcaatatgttgaactgaagtttatgaaatctgtgatgaaaacacattgggaaactgtgtgaaagcaaaaacagtcttttcagtaattgacagaaacagctgtgttggaccctgagacccctggagaaggtcatctacagttcgggccccagccgcagcccacctgctgatgttagaacttgtccactcctgcccggaacaattatagctgctgtgtcttgttctggagttacagtgagctttggctacaacctagttgggcttgccctagagtggctggaaggaaaagaacggggaaagagtgagaatgtaagcagagccagcttcctgggcatgccacctctgaaggcccacaggttcccatgcttggtttaatgctgtcacagtcttgaaatttttaataatttttgaataagggaccatcatttttaattgcactgagtcccaccaactatgtagtcagaggtctgtgtaagagccacaagaccagagggcaaaaataatttgccatatattgaagacacatagaacgatgtggatttatgtcttaatttctttcttcatagatgcaactgtgaaacaaaaattatttcattatctcctagcagtggtgtgctgggctggctcataccagctcacaagagcagattgttaaattttcaggaattttgcaagctagttattaaacacagccatgattgaaaattaagttatatatgcttacaattaaattatattaaaaacaaagataagaaatactcaaaactcaccacttcctaattcatgactacattttactattatctttgcttttgaggttatgtctgttatgtctacctggtacaaacgctatataatggtatgctagcatgcatcttttcccagctccgtgttcagtgaagtcatgttagtagcttgttagtagtctgttgggagtatttacaccgtggaaatcaacaaacatcactaatcagggcttccttttcaatccctcccctggagagcccattgttaaacatttaccagcacaccactgtttcccagatacagagggtgcttacataacaaaatgttgaggtgggaagggaccctaaaagctgagacttctattttttatctcttaattaagagaaagtaataattctgctattattttgctttcatctatgtatcttataaaacaacctctctgtgtgttcttcaaaggaaaggaacaatggaccttagagataaggaaatcatgtatcagtgtggttgagaagttttcttaaagaagtgacaatggaacatgaaaacagcatgagagattctcattctgaagtcaaagttatttcgtgtttgtattgttttaattcacctctaaaatatctcttaagattaaccagcctcgtttctgaccaaccctcaattttgtgaacttttgttcttcatgtattatatgctatctctattttgatttctgattccatctgcttaatcatttgccttcattacccactgcatggtaacaggcactactggtgtctataaccaagcttttgttgagtatgttttcataagtttgtttgcctactgtatttccagttttatgaacggtctgttcatatcctttgcctatttatcacttgctgctcaatgcttttattattagaggcgtgcaaaagctttttatataaaaagctgttaactctttgaatatcatttactataggcattttttttcctgttctcattttcatttttatgttggttttgatattgtcatgtatagaaacttcggatttttgtgtttaaatttgcccatttctatttagctttttaaaattctaaaccttaaaaaaatccctattccaaagatttaattaatagtccattgtcattttaatcagttttacttaacccagtgtataattccatatcatacattgtcgtggatgatcaatacaagcttgtcaataagttattgctggcaaaaaagaagccttcagttttgtttctgagattgtcatttccttaaaaccacagcgcttggactggtcgctttgtaactcagagcctccgtttctcgctgtgataccattaaaatgatttctgagacttaaagtgtctggaagaaggtgtaatggggtatctccatcacgatattaaacttgaagaaagtccttcaggaatttgcatattttaagaatgtgcttttggatatatttgaagagtcaatattcttaggatggagtcttagaaacccaacaaatttttaactcagtctttaaaaattattaatttagactgtttcttgttcttacatagactttgtggtaagatatacataagatcaaccactagcatagacttttaaaatattattttagtaatagctaacttttgagcatttactatgaataacacagtgtttatgttaatattttacatatgtagtctcatttagttcccactattttataagttcttgtatttgcaaagatctaactgtccctcagcatttatacttactttataaatgttaataacttttaaaattattcatgttcaccatagagaacgtagaaaatacagactggcaaaaagaaaaaaattaccgtcactcattttaccatcaagagcaagataagcactatcaactttcatgggtgtgcctttcttgattctcttctatggatatttacatgtattataatcacagtaactttttggtgataaactcactataactttttgcttcccataatttatatcttaaacaattttgatcttgaaatcaatattattatttataaagaggtatgctagcacacaaggttgctcttctattttaaaattgattttttaaaaataattctgcttagtcccttcaaatataggacataaaagtgaaggttgcttggcaactgaaatgatggtaatgaggaattaaagacattacaagaaaagaagagtactcagttcttttcaatgctacatgctaattgcagtaactatggctgattacagttgtaataaatgaaggaaacacaaaacttccattaaaaattcttgatgtgaacttttttttattttgtattacagtgaaagtgagatggggtttgctgaagagaaactttactttcagaaacaagaaaagatcttttgtctgtattaacttttttttcttttcttttctttttttttttttttttggcgacagagtctcacccaggctggagtatggtggcatgatctgggctcactgcaacctccacctcctgggttcaagtgattctcgtgcctcagccacccgagtagctgggtgtgcaccaccagagccagctaatttttctatttttagtagagatggggtttcaccatgttgcccaggctggccttgaactcctgagctcaagagatccacctgcctcgtcctctcaaagtgctgggattacaggcatgagccactgtgcccagcctattaaccttctaagggaatattaagttagcaactgggtgagatacgtagcagaagcacaaagatttggtacatctgtgattcttcagcagcacagaagagatggtgggcagtggtgtgaaggaagccatgttaactacttgtttttttttccccaaagagtagtcaagggccctggagagattgctgaggttctcactagagccttcaagcagaagatgcttcctaggatggagatgtacttagaaggacaccagtgattcattgaaatggacaaagggagtagagactagagggggaagagggaagcagagggaaagagggaagcagaggggaagagggaagcagggattgccggttttgtaacaaagaatgcagtcaccagaaaagtaaggcagtttgggatgaagccatccaagaacttatcaaaggtatatctttgccagaaagtgaggatttctagttggaggagcaaatggagctatgtctgtctcctcttcactgatctatctgaatcatggtataggacttggttttgtaatcttgtgaacagcctcattttaagggggaacccacaatattcaggaagccaagaaatgtccctgttaatcatctatgagtctatcttgctggaatgtagttatagactatggaacatccttaaatctgatgagcaattaatcactggttaattttggattcacttattaaatgccaaatgcataggggatttttcacactctctgcccttcctccttcccagttcatgagcaccacaattggattccatatttacttcatccaaacctaccttggtgggttcaccatttacctccagtcctggggagttcagtccagactgtgaattactgccatttctgaggggctgcttcccagatgggagccataggaccctcgcctctggccctggactcagtcttcgtttattgccaaggatgagcacttgctctcgggaatggatgctggggtccacctgactgtttggcttgctttaatccctaaaggaaaagctccctacatttattgtgtctgtggtccccccaccctctctgtcccagtgcctaagagtctcattaccttgtcagtaactaccagtgtctacctgagatggactaagcttcatttaactgagaaagtgcaccctcaaaattgcaaggagaaatgttggaggaggaccctctggattaaaagagacttaaaagacatttcaaacagtcatagtatgtgaaccttttttctaaaaattatgtgtgtgtacacatacacactcataggagtatagatggatccacatctgctgtatgctgatcattgttgcagctggctgagtgcatggaggtcccttacgttgttttgctcactatggtatacatgcttataattttccataatctttttttgagacagggtcttgctgtgtcacacaggatggaacacagtgatgccatcttggctcactgcagtctctgccttcccagctcaagtgatcctttcacctcagccttctgagtagctgggactataagcatgtgccaccatgtctggctaatttgtgtgtgtatgcgtatttttttgtagagacagggtctcactgtgttgctcaggctggccccaaactcctgggctcaagtgatctgctcacctcagccttccaaagtattgggattacaggcatgagccactgcacccgacctctaacaatatattaaaattaaaagtgtcctcaaacctaggacaaatagatgatttaggattacaaaaattcaaacggattttaggaaatttctctaaattttcttaggtggcaaaatagagtggctgtgtctgttttaaagaagggagaggaaaataaagaatgaaaatggttactttggttacacatcatgaaaataattcacccgtgtcatgtacttgacatctcgtgtcacagcgcattccccaatcagcactgagatgctcaattcctgggtatccaaaaagaccaaaaaaaaaaaaaaaacctggaaacttgtaatctttaatgctactgtcagaggcgggagttggagttgagtaagtaagagaatgtaatactctcctccacaccccatctcacacacacacacacgcgcgcgcgcacacacacacagttttgagcagggaaatgtcatgactgtgccacagctgatttcagcaagcggtgaaaagattatggaggccacgtcacatggcagtctttggaatctgaagctgagtcactgagtctgccatttaccacatgtggggcttgtttgcccgtttttaaaatggagaataatggtaaaaaattttaaaggtggttttactttgggtggaaatttaacaagattgtcttagtttgagttttcccaggagcagatcctgagacaaggatttttaagtacaaatagtttactttggaaggtggtcctaggaaaaactggtaggggagtagggaaggcagctcttggagggtgcattgccaagttacaactctgggagtcagagtggaaggctcttttcagacctatcttatctgagggaaaggaactggagcattgatgtaccaagtcccatcggtcattggttgagggctgcttttagagggtgttaagtttgcagcacatttggcctgccctgcacacaggtgggggtgtgaagggcttccagaaacctctcaggctggtggaagttgagttggcatgcattacaatgggaaggtctgagagtatgtgtgtgggaacttacaggctctgctacgaagtcaaaaagtaaatgttagatgggcaaatataggctacatgaaaatccacataaacagtttcaaagctagtttatagtcgtactcaaagtgtatacatgtagatatgagtattgaaggatgtccttctgcaggtgaaccatttatgagtggctgtggacattttcatcagatttaaacacaatctgtgtttttggttagacacactgtgggaaatagcataattagcagaattcaggatgtgaataacatagcacaaagaacttagacaaacaggacttcaataaaacgtaaagtctcgcacttaagtttaaaaatagtgcttcctatatgttctggatggggggaagctgtattaattgtagttcttatgaccaataccaagagattttagtagattgtaaattcaacatgagtcagtagtgtcgtgtgtcttccccagaatattaactttccaaaagttaaaataattagagattgcctcaacagaaatagcctttccatgttaagggagtaatgcctccattctatcctgaggtccagtcctaatgctgacacatagtaactttattcccttagccggtgtcttaatgtttcggagactcagtttctatcaacctgaaagttagtagatacttcccctggattgtcgtgaagtaagcatcttaccagaaagttagaatttatggcccagcacggtggctcacgcctgtaatcccagcactttgggaggccgaggtggcaggcgaatcgtgaggtcaagagatcgaaaccatcctggccaacatggtgaaactccgtctctactaaaaatacaaaaattagctgggtgtggtggtgcacacctgtagccccagccgcaacagaatactctggaggctgaggcaagagaatcacttgaacccaggaggcagaggttgcagtgagccaagattgcgccaccgcactccagcctggtgacagagcgggactccatctcaaaaataaataaataaataaataaagttataatttatgtaaaatgttattaaaattccaatctgcagtacatactcaaaaacagtagcaatcattattagtatagacttgttaagtgttagtgtatggctttttcaggttaataatgcagcttgccagaggatccaaaatcacatcatggagatacaagatggttataatggctatgccaaaaaaattaccaggatggtgtcataatagacacgaacagctatgagactagaagagagtgttataatttaaattttcccatgaatttgagctgtattaatgcagtgtttagtaaggaagacctgaaaagtctctcatttttcaaaatattaggacaatgatggaaatccaaccagaactatctttgggaatttattagaaataatatggagtatttcatatatctaaaacacaggaagagtacaggatgcctgcaggccttaggagtgcctgaaattaggtactataatacttttaggagactattgcatatgttctgtgtatgtatgtgtctcttctctgtctgacttgcttctctctgcttgtcagctcatcattttctttcactgaagatttgttttctacatggcactaacagctgtaaatcatgcatctcttaccattagaaatttaatatttttttccctcaagttcagtgaaaaaaaaaaaactgtcagggaagaactttggttcagatttggccaggtggctactgcttgaatgaattgactgtggccacagggttggagtcatttaataatccagcatttctctctaaaaccacatgacggaatctggggaaggagcgtttcctaaaggaaggctattgtgctgggcatatgaagcagtatctgtcataaccaagatctgaccaaacactagagtgcagcatgctattagattcaagtttagtttctggattttaagatgggaatggaaaggctagagagagtgcagaggagataaatagttaagaaattatacagaaataacatctgtgaggatataagatggcagaacctgaaaagaagacaaataagtgggttttcccctttgttttcttaataatgtaaacatgtatgtctcaatagtaataaccatagaagagctagtatgagttatttacctccagtgggacatataaagggtaaacaaatttaaatctaccaaagaactgggacttcccataaaaaaattaaacatcaaaaggagaactttcatatctgaccatagtggaatactggatattagaattattttcctgctaccaacagctataaaactggacaaaatatctgaagcaactatttttgggtctcagaaaacaagacagacatgtgattgtggataaaataaaaagatgtgaggttaactcaaaactcctcttggctttctgcctgagagcactttacaaatcatggtacaggaaactggagcccagtgagcagcatcttgccttgcggagtatcttagttcgttttctgctgctgcaacagaataccagactgggtaatttataaagagatttatttggcttatgattctggaggctgggaagtgcaaaatgaagggaccacatcttgttatgtcataacatggcagaaggcatcacacagacagagagagtgcttgcaagacagagaagaagggggccaaactcccaagataactaaccctttcccaagatatggagttaatccattcatgagggtgaacccctcgtgacccagtcacctcttaaaggcctcacctcctaatactgttacaatgacaatattaaatttcaacaaattttggagggacattcaaaccacagcacagagagaacagtttgtgttcagggattctgggatggctggcatttgtggagtggcatacaagagagaaggtatttccaaagactaaactgtgcatggatatgatgagactctacgacccctaatagttcctgggggtctttgagttaaaggaggtctcatggtctgggaaataacgcagttccaaccagccaaaatggagagacataacactttgggcattcaggtgggatgagaaaaagactacaatgtaggagttgggctactttagccctagaatatgagctaatcttgactcaccctaatgaagcctaaatctgagcttcaacaggattaatttaaggtcccatgaattaaataccaccataaaggaacatattaataattcaaattatcaatattgcacttacaatgcccagcatgtaataaaaattataagacagaaaaagaagcaggaaaatgtgactcataaccagaacaaaaaagatcaatagaaatgaactcagagatgacacaaatgttggaattagtagatagagaatttaaagcagctattataaataaatatgttggaggatttaaagtaagatgaatagatgtaagtaaagtaagatgaccttagcagataaattgcaacaattaaaggaaccaaatggaattctagaactgaaaaataaaatataccaaaaagaaaaattaactggatgggcttaatactatagtggatgcaaaaaaaaaaaaagaaaaaaagaaaaaaagaaaggtcagtaaagtcaatgacaggtcaatatctcagagagaaaatgctgaaaaaaaaaaaaaaaaaaaagactagagtttcagatgatgtaaccagagtttaaatggacatgaaaggacctggaataaccagaatcttgaaaaagaatgaagtggaaaatttacactacctgttttcaagacttaatataaagctatagtaatcaagtccatgtgatatacatataaggatagacaaatatatcagtggtacagaatagcacgttctggaagaaatctacatatacggtcagttgatcctcagcaaaggcaccagggcaggttaacgaagaaaggagtatcctctcaacaaatggtgatggaacaaatgacagtcatgaaaaaaaatgaactgtgacctgtgtctcacaccatacacaaaaaatgagatgaatcaaatgatgtaactgtaaataatgttaacctgaatgtaaagttaaaacgataagtcttctagaaggaaatttaggacaatgtttttgcaaacttagagtattttttagacaggacacaaaggactaaccataaataatatatttagcaaattggactttataaaaatcaaaaacttctcatcaaaagataccattaaagaaatgaaggaagaaaaatactggggaatatatatatgtnnnnnnnnnnnnnnnnnnnntatatatgtatgtgtgtatatatatatatacacacacatatatatacacacatatatatgtgtatatatatacacatatatgtgtatatatatacacatatatgtatatatctgacaagaacttcattttatgctagtatacaaaggaaaattccctgtggcccagatgaattgccattattgggaccctctggctcacaccagattgatttctgatcatgcttttgaaattagaattaaccaagccccatcaaggagtctgtaatataggcaggcaccaaatcagctgtgttaagtacttcccttgcatgttgccctgagaacaggcgaaagacttcactgccgatttctgaaattggaagaggtcttcatggggtcatctagtatagcttgtagatctactccagggcaaggatgaactcaatggtctaaatcagtctaatcaaacttgatctgatcccttgggagctttttaagaatgcaaattctctgctccatccctggatctcttgatggagtaggtattaggtaaggccttggaatctattttgagttccgttggtggttttttgtttgttgttttgtttaggccagtcaatgaagcagtgagagtggagaagaaacaaagaaacctgtaactggttgtgatcaattagttgtaaacaccacttcagtcagaccagtttttgttctgcttttgttgttattttttagtttagtgtgttgtttgtttgagacagggccttgcctctgtgtcacccaagctggattgcagtgacagtatcagcttattgaagacttgaactcctgggttcaagtgatcctcccatctcggcctcccagagtgctgggattataggcacctaatgggtaagctgccaccccaggcccagccttagttttgttggtaagctaatcaggaggtcttgaaaagtctcacctgcctcttagtctatcagaatctgacccttccttcaaggtccatctcaaatgctaccatctttatgaagctttagccatttcttccagtcaaatctgactttccccttcctctgaactgcccgtgtttacctccctctaggccctgactgtaccatgtactgtagtattgcctgtagcttcttcaggcttgggacagggtgcttattatatctgcaatcccacagtacctatcacagtgctctttgagcaaagaactctggtcttgtgatgagaaaagccaagtctaggatgccagctctgccacttgatggtattatccgtgggttagtgatttatccaggggtgacattcagaatatttatgtgtgtgtgtatatatatatatgaatgaataaatgacagggtcttgctctatcacccagtctggagtgcagtggcacaatcacggctcagtgcagcctccacttccctggctcaaatgatcctcttacctcagcctcccaaatagctgggaccatagtcatgagccaccatgccagctaatatttttttattctcagtagagatgaggtcctgctgcgttgcccaggctggtctcaaactcctgagctcaggtgatcctcccgccccagactccccaagtgctgtgattacacgtcaccacacctggccttcaaaatatttaaccagcatggcacatgtcccttcatttagacgcccgctggccaggctggggattagccctgtctttatgcttttattgtcggtaaagtggatacagtccctacccacctcaaaaggttgttgtgatggtcaaatgagataatgcatgtgaaagtactctgtaaagtacaaagtgctatacaaatgtaagtcagggttgcctggtggtatttctagtgcccgtgtgtggggttggttgcccagccctcaacatggtctcatggtctgctctgctctgctcagagcagtctcccaggagcaaaccaaggagttgttgagtaattgagcaggacactgcaaatctgagaaatcctggaatcagcctgttaggtcctaaggaaactcagaatatcagctccttcaaggatggcccctttttaggcctgaaaaatatcaatgtttcagtacatatattttggaaaagctaaataaaacaaaaacctaaaaaggctttttgaattttaacctaagttttccttatttgaggacaccttgttctattgcacaatgaccttaaaattcaggatccttaaagatatctgggcatctcagactcatctgattgtcaccatatggcaaggagctgctctgcctagatctgtaaatggagttaaatgccagagacattaacatagattaaagggacagtctaaatcttagtcactgctttgtctttatagtttcttgcctcctctttttacccttttacttccttaaaaactgtcttaatttcctcaccatcgccttcccacatgccctcaggtctgcagatcctggggatacaaatccttagccacttttctcttccaaatgcatttcactctttcctcatattcagtgcccagttactgttttgtgtttatcattagttgccagtcaatgttaatgtttgttcttatatgctttgatttaaatgaaggaaatggccccagtgtagtgtgtacagcagagaactagagactgtagggaacagacagaaaatagacacaacccttttacttactcttgaaggattcccatttaaaaggcaatgcagggatggccacagtgactcatgcctataatcccagaactttggccggccgaggtgggaggatcgcttgagcccaggagttcaagaccagcctgggcaacacagcaggacctcatctctacaaaatataataataataaaaaagaattagcctggcatggtgatgtgtgcctatagtcccagatacttaggaggctgaggtgggaaggttacttgagcccaggaagtcaagtgtgcagtgagccatgattataccactgcactccggcctgggcaatagagtgagaccttgtctcaaaaaataaaaataaaaacaaacggcaaagatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtgggaggagcggggagggatagcattgggagatatacctaatgctagatgacgagttagtgggtgcggcacaccagcatggcacatgtatacatatgtaactaacctgcacattgtgcacatgtaccctaaaacttaaagtataataataataaataaataaataaaaacaaaaaaaaaacggcaatgcaggactgtggtagatattaataactttaaaacataatgataaaataaccagggtgataatttgtagccccttcttgctacttcctagctgtgggacattgactagatatttttacctctcttgactctgtttcttcatgtgtgaaacagagaaaacatcgatcatgcagaattgtagtaaatattgagagcatgtctgtaacatggcctagttcactcctggcacatggtggatggttcagtatatggtggcatttattatattctcatttagcatgcaggccagctctgggaaaccctcaatacccaggtagactatgtgctttttatctttacagctgtcagggtgagaggcagtggtatctggtggaaagggcagggtttacctcagaagactggaactcaagtcacagcactgtcactcataagatgggtgactttaggcaagtcataccaccttactctctgtttcctcacctataaaataatgcaaataatacccatctctcagagttgtgaggctcagatgaggcaacgtgtgaggagagtggtcattcataaaacgctaataaatagaggttattagtacttcagcaccagggtgagggtttcatgtgcctacgtgacaactgtcaggcaccgtaactatttgggacccacaagttaaccagacatccgtggtgtgaactcagttcagaaccttgttctcctcaaaagatattaacacttttttcttatcttgagtgccatctctggattatctctctgttggaaggggtgggcgtaagacattatgaagctctcattctgcaaagagcaaattgaggctcagaaacaatcagggccatcccagagccaggcagcctgggtttgaatctcaggtctactacttactagctgtgtaaacttggacaaattaccttacttccttgcctcagtttcttcatctgtcagatggcacctgtctcacagggttaatatacgtaaaggctgtcttgaaacagtgtctggtacacaggaagtgctccaagtatgttagcaaaaagagaagacgggggtggctaaaccttgaatgtagttcatttcttctggttagatgctgcatttcttccaacaatctcaaatatttctcctggtctcccccatcttccaataagtaacaacattgttagtttcagtgttgcattttggctatttctgtaggacagtgatacaacacatcaattcatgacttaggatgttctgaagcacattcttttttgtttcattttgtttatggagacagagtcttgctctatcccccaggctagagtgcagtggtgcaatcttggctcactgcaacctccgcctcccaggttcaagctattctcatgcctcagcctcctgagtagctgagattacaggcgcccaccaccacacccagctaatttttgtatttttagtagagacgaggttttgtcatgttggctaggctggtcttgaactcctgacctcgggtaatctgcctgcctcagcctcccaaagtgctgggattacaggcatgagccaccgtgcccagccccttgaagcacattcctattcagctcttgactactgaatagagaccagtttctttcctttgaatagtaagagattcctcactcaccggtgcagttctcacttcagagtggctctccaggtcctcctgctcacttctctctagcacctctgtaaactcttgagggttctggcgttgggggagtgcgcttaaaacctaggattgaagggaagcttggaaggctactaatatagttgggatgttgttcctgcccaaatctcatgttgaaatgtaatgttggagatggggcctggtgggagatgcctggatcatgggggtaggtttctcatgaatggtttagtaccctcctcttggtactgtccccatgatagtgagttctcatgagatatatgtccctctgggaagctaggacagggccccactgctcctgcttcccttgcctggctcatgtctatagtgctgcatgggaatggtcaatgtctatgagccatggggttgcgtgcatggcagctcatcaaagaatcaaactgtagcataactacccagccagatgtgtggcacttcctccctctccctcttgctcctgctttcaccatgtgacgtgcctgctttttcaccctctaccatgattgtaagcttcctgagggcttcccagaagcaaatgctgctatgtttcttattcagcctgcagaaccttgaaccaattaaatttcttttctttataaattatattttctttatagcaatgcaagaatggactaacacagccaccaactaactgccaaggaggaccccatgcttgaggggtccagtctcgctggcacagtgatgaactacagtggacagccactccttgagtagtggtcatagttaagggacaaaaaaatcatggttccagtctggaatagccaaacaaagaaaaaaaatagccagaacaaaggaaaaaaaaacaaaatagtgcttaaatctagcaagagaaataagaataattcatcactgttatagtgcttcacacttttctaagcatttttatgtatttaatcaaacatcatctaatcctaaccacaaccaaagaaggggtgaggaaactttcagaataatttctatctgatttcaaaagactctgttcagttactttttaccctacatggtgatgtgatgtttttttgtacgagactgttcattgcagagaattataagcaattaaagaacagtttctgtggtgaaaagcatattttacaataagactatggtcagtggatttctattttatgtcagcatacactgtttcccacaattccatcatgcactggaatgaggttatctattatctaggcttgtgggtctgatgggaccaagtcactcattgagaaaaattgtctgaggaaggctgaggtcatggctaaccagtaattctcagatgggccttatattattttgttgtgtaagtatttgggaagttctccaagttgcttcttcgtgcctattgggcatgtctgaaaatatgcaaaaaaggccaagaatttaatagataagaatgacgtgatacaaatatgctccagtgagcaaggtaagagcctgacccagattttcttcccagtttgtttatttctttttctttgggtccactggccctttgccagccctcctcccagcaagctgctggcagctctctgtgtccttctgggaagctaggacagggccccgctgctccttcttcccttgcctggctcatgtctatagtgctgcatgggaatggtcaatgtctatgagccatggggttgcgtgcatggcagctcatcaaagaatcaaactgtagcataactacccagccagataattcaattgttcctagagagtttgatgggacccagaagaagtagccaccaggtatattcagtcggcactgacttcaacaaatgctcttagagtttgaagtcatagcgttgtcccagagtcagctcactgggtctgctcgggacttgcagtacctcttccctgctcttctgtttatttcctagccccagtccccaaaccccacccacagacttgtgtccaatttccagaactgaagaggaccaacttccctcctgacttctgagactcatgattcttcagacatgacaagtccagatcgagactgcaatccccaaggaaggccagctgtcttgctcagcagagacaatacagctaaaagctctttctcactttaggcaattcatgcacttggttagacatttatagacttcaactgctcatccaaaaaatctaggtcattctttacatagagcttcacactttggaaggaaagccaggcccagggaggagcgtttctgttgatgtctggtttggctgaggcagtagagagtgcttctgctgtgggaagagggagagatggaccagcgcaggcactgtgggcccttaggggacgtgaattttcaccccctggccactgactcacagagtctctgagtaaatggtgccaataatagctgccttgtgttgatgtcatgaaaagtggtgggtttaaggattaggctttctaaggacatttttaaagtatgtaccataattccagtgagaagggctgggtgggtctgttgggggtgtagggcttcctggggaggaagaaagaatagaggtgtgggtgagaggtttagccatgtaacatggatggccaaaatggtagagctcttccaagtatattcctacctgcctcctaagccccgaggagaaggacatgccaaagaaagagccttgggctgggagtgagagggcccttcttgtggaggttcctctactcaccatggctgaggcatgttgcttcagttttctcatttttaaatttcagctcatggttctgctgctgcattgagctgctgtacaatgcaaatgttcaacacaagtgaagctgtttgttgaacctaagtgccacaaaaacgtaacatatcattatcaggtgttctcacccagagagaatagtgtggttcttcagccactcgcttgcttcagggatggtttgtgtgggcatgtgctcattttgtacaggtctgttcctgtgtacctagatgctgtgcaacttgaaaggcctgctcctccttcctgctctactactctggccccagcaggacagtgaatatcaatagaacagaggcaggaagcatgggttcttttccttcaagtcttttccacgttggcttctctgcaacaggagttgagggaggcttggttagaacaaatcacctttgtctgggggtgggttaaccagatttttccctcttctgtgtctgtggccttggttgtggcaccagctgtcatcactgccccagcagttgggtgggagagaagagatgagcctggccagcccctctcctgctttagtaagactccgcttaaaggcctgttgtaaaagtttgaaattgcaggtcagggttaatttaaagcttgtgtattgtccatgttatggtgtcccccagccattacaagtaaataattaaaagccaattgtaaccaagatattcagagctccataaattcctggacaccataatatgacaagaaatagacactagtctaactatatggcaggctgtcctatgtgggccagggtatgacataccaggttatcccagaaagaagaacaggacaagctttacaaggaactgagcttcccttctcccaaattctcaccttatattaacatttttgttcttggtttagagcaccaaccacttcaagaaactgctgttgcaatgtggatttctctgagaggattcacccttgaagtccttgtctcctgcagaggaatttgttgatctggattaactgtccagtcattgggcaaggcccagagggcatgagattaggagtgagatgaggagtggaatgggttcaggaacacctggggagcaaggaaaccagacaggaaggaatacaaaaggaagcccagcaagcaccagccctcttgaggaggcttgcagctgctgtgggtgcatgctggaggtggcccacacctgtcctgagagctgactgcaagcatctcttcctaggtgcatgttcagtgacttcatgttggtagcttgaaactggccatagtggaagtatttacaccatgcaaatacgtgaacactacaaaccagggttcctctcacttctctcccaggagagctttacattaaactcttgcaagcatcctgctggtggcaaccataatggattctcactttccctgaaaagcaggacttaatccttagcagatcacttgctttctcccgattgttctcctcccctgagtcttgaggggctggggactaacagagaccaaagtggccttggtgatatgtatgaagtggctcaggtcatagacggtatacaagttcaaagtttgtatcaccacattgtttcttcacatgcacttcctgcctaagttgctgccgtccgctctaaaaaactaaacaaacaacgaccagaaaacaaactctactgatcttattttcagcttgccaatttttatacagtctccaaacaggatttaatgaatgtaataatcttgctgacaaataggttttacttctttggaatatttatcacatagttatttatttagaattctgtgtgtatacctaccaggttcaacctagacccagcctaaccatgtttctggagatactgacctccattatcaacctcagccttaccacaggctctgctctaaccttgcccctaggttttctgatcctagctttcccattaccaccctctggcctctggttgtggcacacctgttatttcatgttaggccctcaatgctgacagcttgcctatccttcatatgctgatctgtctctggtacactcaaaataccttcacacatcaagagatttccttggaaaccaaaacaaaggagaagaagtgactgttccggagttgctgcctggtgctggacgtttgttttcatgtttcatgttcatcttgcagcaaggcatttccatctcatcccccagacaagccttcactgtaggaaagctggcccccacctcttatcagcaaggagcagggtctgcatcaccaccctttgccagttttctctcacgagactctgatcatcagggagcaggtcttctctctcagaggcaaggagcttatttcaggcaataacagcagttttcatatggttcttcagatctcctttagtacctaggacagtgctttccatagggtagattcattatcaatgttggttagtggtgtcaaaaattatttctacttgaagtagaatgaacagttgctatatagaatagttaggaagccatatcctgtcattggaggggtccaagtagaggccagacaaccacttacctgtgatggttttaggagggaataatgcatttggatagaaagaagaggtagaagatggctagccttttccaccctgattgtgatctcataaactatgggatgccagcactgagtctaacggtggaaaataggctgttggcccagagacagatgactctccagaatccgcttagtttttctgttttcttgagcaagtggtctgcaggttgagtgagtctttaattaatatgcttctctagcagcttacattactcccctagtcaaatggcagagtatgtaagatcaacattgtgtaccccactgaggcttcaaccctttaaagaagtcttttcctgtaagtgtaaggagaagcagatggtaatgaaaaaatacgcacattttattatgcgttgcacattttacttattagaatttttagtatgacaccctgcattttaaaaagcctaaagatgaaaacaaaatggaattattctttgaaatatttaaatcagcttgcagcaattatctcaaaatatgaaaataaaatctagcagcctggaaggtagatcttccttgaccacccactttgaaaatctcgtctttcaaagggaggctcttcctctcaaaaaggaagaagagcatgctgtacagaatgagggcaggaagggacgtatccccgatgaggttgttcaaaaaggaagaagagcatgctgtacggaatgagggcaggaagggacatatccctgatgaggttgtatagagctggagcttatgtgtgggagagctggtggtgggaatgagggcaagtgactacactgaaccattctctcgttgaaaagtagaaccaggactggagaggagttacctcggagttctggactgggtgtagagagagagtgtttctgtctgctctttccctaaccacatctctgcctcccttggctgagtgagtcatcctctgccagccttaccatttgccagcactcactcccacagagaccatgtgaggattaacaagccgtactttgggaacgtcactgaaactgtggaaaagcagtgcaaggtaaaggtgaagtgtgaatatgattgtgaatcttaagcacagaaccctgagttcttaaaggcaatttttaagattagtatccatcaaccaaagttcacaagagtttttcagaaatcaccagagtacaaaagctatttcacgaaatgtgcagtggctgtgaccttagtgagatttcttagacttgtagccataaggactggaagagttcgtaaagctcagctcccactttattcttgaattccttatcctgacgaatggtgattcagcatgcagccaggtatagtggaaagagaaggggctctggaatcagacagaccttgggccaggtcccagctcctccacccattgtccctttgacctagaacaaattacctaatctctctatgctttgatttcctcagctgtgagttgtgaacaatgcttgttgttgagagttagaacatggttaaagtgtttagcacagctcctggtatttagtagggcttcaataaatgatagctgctatgctaattacaataatgcttattaagtgttgctcttcaggctcttttttaatatctctgtgatggcaatgcttccatcattagacagtgctgatggctagaattttctgccacatgttgtgcccaatcctatttcctataatttctatccatctactctggtgctgccttttgtggccccatagaacaagtctaaaccaactcccacaaagaacacttcagatatttgaagacaattttaatctcttccccaagttttcttcatggtaaaccctttagttcctggaatccttccataggtgacttagttttgatctcacccaggacacgtctaagtcccttttcctcacatatgagtatctatgggaagatgctagccagccataaagggaaagttgagatggcaagttttagatgccatccatactgaataagctggcttttgtccatggttcttgtgaacattctaatgcataccctacaagtatatttcacagttccttcttttcactgtagtttcaccagagtgttcaggaatatgaacactgctacctgtgaggaagnnnnnnnnnnnnnnnnnnnnttgcagttcctgccctttgactttatattcagtagtgtgacttgctttggccaacagaatgagtcagaagaaacagcacgccagctccaaacctaggcttcagaggccctgggtatttccagttactcttcagtgttctgccatcatcatgagataacctacccccactagcctactggcccaaggaagcagggaggcatgtaggctagggcccccagcagcacccagcctgcactagctgattgtaaccaactcacagaaacttgagcaaaagtaagtgattactgttttaaggcactgagttttggggtggttggttatgcagaatttttgtggcaagaaataattattatggaaattatgtggggccagaaaacataaagtaatactaaccctacctggacagagtacaagtttagaagaattaatgaaagatttacaaaactataaccaagctagatgaacactttttaaaaatgatttaccaaattgtaactttgaatttcttttgcaaactgtgaccaggaagaagataaatgtgtatattacatttcacgaatgaaataggtaatgacgaaagcaaactcaatttctaaatatctgtgaaaagttaacgtgtttcctattcgatatagttcactcatttactcaagaaatgttgaatgaatcatgtgtcagtaccattctaggccctggaaatatagttgtggaaaaagtggacaaggcccaggtctcatgaaacttgtattctactggagatttagaaaataaaaaattaaataaataaagcagataacttcagataatggtaagtaccatgagaaaactcaggcagggtaaggaataccttaggtagtttagaaaagacttctctgaggatgtgacattgaaactaagaccaaaatgacatcagtaattcaagggaagaaagactacattgaagaaaatagcaaatgcaaaggccctgaggtaggaataagctgggagtgtttgaggtacaattagaggtgtggagaggagcaatgtggtatgaaatgaagtggatgatatttaaagaggccaggacatgtagtgcttttttggccacagtaaggagtccgttttattccaagtggaatggaatccactgaagtgtactaagtgcatgacttgatttataggttttaggagtttgtcctgacttctgtatagggaatagattgtaggtggacaagagtggaagcaaggaggtcgattaagtcattgcatcatggtggctacaactagggtgaggccaaggatggagagaaatgaacaggtttgagatatatattggaggtagaatcaagacttcctgatggattggatgtgaaggaacatgagaaataaaggataatggctaggtttttagttggggtaactgagaggatggttggtggtgccatttctggagatgaggcagatgcgaggaacaatgaactcaggggagggagagatcaggagttttgtttgaatgagttaagtctgaacttagacgttgaattggatttgccaggtaggctgctggacatactaattgggtagcgaaggctgaagataccagttgggcagtcatcagcatatagatggtattttagccaagagactaaatgagttcatctagaaaatagtagtgaaagtgttttatttttaatttaaaatttaagaagttttaaattttaaaaactgtcaaaaaataaataaaagaaaaagcgggaggactcaaccacagagcatgctgacatttaaaagcttagcagaaaaagaggagacagaagaagagcctgagagagaggctgagagagtgtgatgctatggaagccaagagaagaaagtgttccaggaaagagagtcatcaacttgggttgtgttgggttgaatgctactgagtcataaagtaagataaggatcaaggagtaactgttggatttggcagtgtggagctgattggtaactttgaaaataaaagatttagtggaataatggacacagaagtcaaatggaatgattgaaaagtaaatgggagaaaagaaactgataacagtgaggttttgctaaaaatgggaatagagaaataagtagctagagaggatgagagtttaaggttttgttttatttggttttgaattggagatgcagaggcatatttcaatgacaatggaaataaacccacagagagaaaagttgatattgtgggagagaaaatggacaaatgcaggatcaacgtccttgagaaagggggagacccagagcacagtgaagtgttggccttccatgctaacaggagagggcaggggataagggcaacagagtaccagtgaaatggtggatttggggatgggaagatgaaagacactgtcagtttacatatacatatatatatacattttaatatatacactttaattattgagatgggctcatgctctgtcacccagacagagtgcagtgatgttatcatagctcactgcagcctcaaactcctgacctcaagcgatcctcccaccttgacctcccaaagcactgggattacaagcatgagccactgtgcccagccacttatattttctcaatgagatatgactttagatcgtcgtttgaggagccaagacttctgaatcctgagcccaaaagcactgtgtccttcatttaccatttggtacatttgaagcagagtgaatatgataacccctttaatataactttaaagagcaatacagatgacaaaacaattcatgtatattctttcatttgatactcttgccttgaataattgaagttcccagtctggaacagaattcagttcgtataaatgaagacattgtaatgaagggactatttacagagatgagagtggaattaagagatgtatccagaaactatcaacactcaggagtcattaccacccttggggccagggggccaaaggagattaatagtattagatccaacgagagctggtgccatgaagggaggaccaaccagcatgatcattcattgaaaagatatgtagtcactgtcaggggagtggtgtcaatgcagagagggaatgaaaaacaaatatcctgacttccctccactcccagtctcttgctggtgcttcccaatggctaaacccaactggaagccagctggcaagtgagtgggctgatatttttcatggtgaaagaatagatctggcagagaataaccagcagagctcctaacacttcatgccataaatgttgaaaagattttgaaaaccactccaaggggaatctttttacccaatgccagtgtataaatgcatcttattattttgtgccagctgggatttagaaaacctagctaaccatgttctttaatacaaatcatcatgagtacttgtaatccacttgcaatcttaaaatgtaatgtttgcccatagtcttcttttatttccatccagaggcatattaaccataaaactggagaagcatatatttcagggctcctcacttgcatgagccccttccaaggccatgggacggccctagaaatgtattcatatggtcatttgtttttgtaaaatttgtaaaggtaagatattttaactgcaatctattaaaaaccaacttttctcactctgaccccagagaattctctccctgcccaccccccaaccagttatatgaactttaggccccacaaaacctggatctgcttctgctttcagtgagactcaagtgtgctgatgcagattttatccctttcccgattttaccactgtggagaggaaaaggggtagttaatgagcatcaaaatggacattctgcaagggaagaatgtagcaggaggatgagaaaaacagaggggggctgtgctaggggcagtggaagaaaatcactgtgcctgaaggattgcacctgagtcacagagggtttgcaggtgtctaccaggtgactagtttccctccagggcctaactcaggtgctgctctttatattttcagatgcagatggaaacctgtgtcgaagtaaccaactgttgcaagtcatgctgaccatgcaccgaattgtcatctcctctgcagaactgctccaaaaagttatcaccctatatcctttaacatagtgactggcaatcccaaaatgggatccacccaaaaagtagcttgaaatttgaagtatgcttttatttttattggtttggaataaccctgagtggcaaataggttcatatgtcctttcaggggtatgggtgcatgtgttgggggtgtgttcatgtatcctctgttgggtggggcaatgttattgatgctgattgctctggggggtggtcaaagaaatcaatatgcaagcacaatcttcaggctcttaatagtaaaaaatattttttctgtagagtgtgcaaaatagatattcatcctgtgcaaattgacaaaggtgcaagcatgactcaaggataaatttctttctggccttcctgtccaattcttcaactttctccaggttctgaagaaagattcccagtgccacagcatctggagaatctgctggtgccttattgcttcaggcaggaggactgactatgtgccaagcaaaacctgctggactttaaccttattacgggatatgaatcaagtagggaggagaaagctcctgcttgctttttctcactgatgacactgtaagcagcagcccccacaaaagaagagttgtaggcggagtgagaccgtttagcacccaaggcgcaggtccctggtactgtgtcatgacttgtagctgctctaacacttttccactctcctaattccccgcgtttcatcttacagcacacagaaaaaataaaaaccatcaggactgaatcccttctctatacctactcatgagtctttacctctcatctcaaaggaggtgttttccagtagcacacaaagtgggggagcattgcgagaagtgcacataaataagaggtgcaggtaataagtgggtgcctcttctacagagaattttaaaccatcatgaaaccaactcagtgtctactttttattaatttcatgtaccagtgattataaacaatgtcagtgattaaatattcctccctaaaaacttatttgttggcctagggactaaattgttcctggggtgtctgggcacagtagctcacatctgtaatcccagcactttggaaggccaaagtgggcagatcacttaaggtcaggagtttgagaccagcctggccaacatggtgaaaccccatctctactaaaaatatgaaaattagccgggcatggtgacatatgcctgtaattccagctactcatgaggctgaggcaggagaatcacttgaacctgggaagtggaggttgcagtgagctgagatcacaccactgcactccagcctgggcaatgaagtgagactctgtctcaaaaaaaaaaaaaagaaagaaaattgtacctcggggttcctgcccttagtgcactactggctgcctacatattggggcagaccccccctccctttcccatggtccctcgtacttctcacagaatcttactccaccagctatcacccctcctatacttttaaactctacctcttcaatggcacctgcccctcagcctaaaacacattcaagtctcctcatctaaaaatcaactcttaaccctacctccccttcattccattgttagggttaaaaatttgatgtgaaagcgtcttaaaatagtctacactcactatctccaatctctttactactcctcacttcgtaactgtgttaagttggcccccagtattcgaactttcctctgatgtcaccagtaacctcctgattgcaaagcccaatggctttttctcatccttgtttccattgacccccagaagcattaggcatgactgacaaccccgttctcctcccagctctccctccaaggctcccggaacgacaccctcctggctttcctacctcttgggttgggccttctccagcttttcatctagaggcttcttcgagctctgcttacatatggtgtaatgtcctggttttcctcttactcagcttcctttctgtgggtgatttctcaccagaattcctaccactgtttccaccattcttctgtgctgatggtgactttcaagtctggatttctctaacttaaacctttccttttttttttggaaattggtgcggggagaggggtctcactatattgcctagtctggtctcaaactcctggcatcaagtcatcctcccacctcagcctcccaaagtactgggattccaggcatgagccacggcacccagccatctaacctaaaccatttttcttaggtttataccagtttgtcctgctaacacttaagactttaatatatgcattagcccactgtccccacccacagccactacctcattaattctgcttcgacaccagtacagccttgttttgcctaagacacattctgagaaatacatcattgggcgactctgtcattgtgtgaacaccatagagtgtacttacacaaacctagatggcatagcctgctacacttctaggctagacggtacagcctgttgctcctaggctacaaacctgtacagcaggttactgtactgaatactgtaggtggttgtagcacatggtaagtatttatatacctaaacatagaaaaagtacagtaaaaatatggtataaaagattaaaaaatgatatgtataggggggcacttaccatgaatggagcttgcaggactggaagttgctctgggtagtcaggggtgagtggtgagtgaatgtgaaggcctaggacattactgtacataactgtaggttttataaacactatatacttaggctatactaaattgataaaaaatatttttctttcttcaataataatttagcttactgtgactttatgttataaacttaatttttaaaactttgactctacacagtgtacagctgtgtaaaaatattttctttatattcttctgtaagcttctttctgttttaaaaatgtttaatgtttattaactttttaaactttgttgtcaaaatctaagacacaagtatacacagtagcctaggcctatattgggtcaggattatgaagacaggatgaggcaataggaatttttcaacttcattgtaatctcatgggaccactgtcatatatgtggtccgtcatggaccaaaatgttatgcagcacatgactgtattttcatggtcaatttcagttaatagtgttagtatctattcttgcctaaaccagtaacatcagaagcactcttgacttctcccctgctttcacctcctacagtctgtcacctgatcctagggtttctacttcagaaatgactcttatctggtctctgctctccattcccataccatgccttagttcatgtctccgtggtctctctcctgaaccactgtcccactccagtctttgtatctacatggtccgcctaccccgtctcatggtagctacccttgaaattctttcctacaaagcaaattgggcaggccattgtttctgagcctctgcagactacggagttaatgtcaactccttagcttgccagcaaaagggcctcctcagtctgttcccagcgagtttttcctgcttcattccgtagctctctgagaaaccctttcccttcctcactgaacttctcaatatactggatgtaatggggccttttatcattcctgtgccttgaaagcctttctaccctctttgtttagaagctctttcaagacccttctgggaagcttttctagacttttccagcccttctccccttttaaaaatacttctaatgttttaaaatagtattattgattgacaatctatttaattcctttgattttagttttgtactgcttaagtcaaagtgcgtttctcatatctctggcctggatgtaatctgcattgaaaaactcacagaaagtgtgaagtgtttttattctgttagctaaataaatgtatctacctaaacttcagtccgttttgcaatgtagtgcctatgtactctggtctttatagatgaccgtttcaagtaaagtacagaacgtttgtgtctagctgctgtgatttcaatttggttaataatataaaagattgcaagggtactgaaaaattgattgaattacaaattaagaaagatatatttttgtattttaaaagtatgtacactgtaacttacctatttgtgtgtcgtctcccccgctagactctgtctttcaagggcagggagcaaggcttatttatctttgtatctagaacttagtttagtggctgtttcatggtaggacacaataaatgttgcattactatgggtgcaaacattgggatactttttatatttacaagaacttttacctgtgatatctgggctttgctcaggtgaagatgtaacctggggtagggaaagggattctgagagtatgaaataatactcctgtaatgaaagccaggttaaacattgaaggcaaaattattttctttctttacgcttagtttccctgttctctgacctggaagtaatagaatttttagttaaataagctcagatggtctcctgattaccattgtgaaaagaagagagggataaatttgaaaatgtgctttgaatagtttaggtgcctgaaaagtacagtcagaactgtactggtactttatagccacagtactagctatgaagaaaagaaaaaggtatggggtctgagggttccagcaaacactgaagtttaccaagatcagcagatgcctgagcctcttactatttagcctgcatgtgctggtgtttgcttcagctcctgaatgaagtgagaaagagggtgccctgctccctgtggggggcagcctttgccatggcataggggctctaaggacctctgaatgatgcccaggctcagcactcacgtgtagactgactggatttacaacactgacgctgcaccacatgcagccaacgtgcactgtcagaatatacttttgaagggaaggataaggagccactgggagaaggtgaatgacacggtaaaagtcaccatgtcgatttaatgtatctacttagctttaaaacagaagtgtggtttttgtgccttcccctttaaaatggaagaataaaaatttcaacaagtagaacaaatgataaaaatatagaatctgagaggtatttatctatgtgccttttgcctgaatctctttgcattgaagtgatgcattttcttagtgatgtggcataaagaaacataaagccatctcattctcacttctacttttccacccaaagaaaggcaggcataaaaactttctacttcatgaagtttgccagttccctgcacttatttttatgtcaattacctttgttgatgtgtagggttttttgggtttttgttttgttttggtgctctgatctaaagggcagattttataggcagtatatgtattaaaatttaatttttaaaactagaagtcattttattaaaattacaaattttataaccatagttcttgtttagggtttcaagtttagcttgcaaatcttactgtttccataagtctagcatgtttcagcaagcatttttaagggactttgaaaaatgtttcgttaatttgaataatgttaattaaatattcccaatgattttaaactacagttctgcattttatatcttagataatttttaagtgcttcagatacctccctgaattctaaatagttttttataactctaatagattaaatttataaacagtaaagctatcattatcttagatgttccaaagctatgcataaacttaataaggtttcaatttaaaaccacaagtgtaaagcacttaattatatattgcaaattgaagtttcaaggctatcattctaatatgcttttaaacattacaagcatatacaatttcaaaatgcacagatctccttcctgacaaaaaagatcagtactatgactttgactctcttttgcttttctttatttaactctaaattttccaaaggttaaaatatatacacccacagaaggaagaccagtcctgtcccagttaattaaaatgtttgctgggttgttcactggattcctctcatgggcccagctggaattcactgaaccctatattgtagtcattatgcacagcttttagaaggaaaacaaggcatggcctttacgggcgggcacagagcccacatagcctgatgcctcagtctgttgatgggaaatggcaggacctattcgggctcatcactgcattggagttctcatctctttgactcttaaaatagatgaatatttttttccatttatctttaaagacatgtgaacttgatgagatcttgctattctttcatattcttggaatgctcagaatgaaaaggatccttaaggtgacctccagttttgttttcgattattcacacggtttatctgacttgccgttacaatctatgaggtcagtctactgacatcctctaggtgtatatattgtaactttcatattattgttcttcattatcatgacatatctgaatattgaatatgtattttttcctcttcgaattcactgcatacatgtgtatcagttaaaagaaacattgtaaaagataaatggggctgctgttttttcttttttttctgcttcatttttccttcataggggctgctttttgagcacaggcaaggagtcatttgccccttcttcactttttataagttacctgtctcaggacctctttacatgattcatttcttagttctgcagtgctgctgcttccttccgtaagccaggtcgacgtgggctggagagaaaattaccatcatcgcctttctaggcaataatatgcatacagctgtacacatcaagttggtttttatcctttggccagaaagataaagcatcacattttcattttttagaaaaaatattttgggaggtagtttcagcaaatacttccaaagatgaaaagtcgtttggtttctgtaacagaggtctccatttcccttaaccacagccctacctataaggatgctttggcaaagaattcaccaggactttgcctgaagatctgttattttgtaaggtaatgtttctttatgtatttcaagactttgtggagcaaggtgaaatgaaaggtgaagcaagggactttccctgcctttcctgacctctatagaacacctttggacagatggaaaagggtagtccttcataacagtgaattttctctggtgtacttgagcttaattattttataccaaccttttttcagtctttggtatcaaatgacatgaaggagggaatacagaaataattaaaggtctgttattttctttatttttgttcttaattatacaagtaatatagctcattatagaacatttttaaaaatgtagaaaagaatataactataataatgatcactcatatccagttacctattttggtgtatttcctttgtcttgttttcatgtcaatttttttgagatgaaaatatatatacggttttatatcttatagttttcacttagctttatagcatgagaatcttctctagtcattaaagactttttgtaaacattctttttaatagccatgtaatattcgaatatgataaagcataatctatgaatagattgtctcattttggacatttggtttatctatagttctctcccttataattatctccaacccacatgattgtgcctgaatctttgtcatggctcctttgattatgctatgccttatcctaccacagcatttgtgtggagggacagaagattttcagtggatgggttttcttccttccctgctcccaccccagctccttcaatatactaatagacgaatcagactttgtctttttctgagttctctttgtggcagtaaattccttttggaacccaacaaattgtgagtccttggtatcagttttggattgtgttttttaaccccctccttgtaggtattggataacagaattctgggtcatgtttaaaatggacgccagcttgacagacactatggaggagtttcaggaactggtgaaagctaagggtgaggagttacattgccgcctgattgacacaactcaaatgtgagtgtcaaggtcttgactcatctttcgaaaccacctccctcctgtaatataatcccagttgcttgttgggcttctgacccccagcggtgactgctgctctctttctccactctgagaagcccctcaaatacacaggttcaaactgcctcaccaaagtgaaggcttggcatttaacagaaaagcagagaggcctcatggtgataaagcagtaggtgacatatccaggagcagaaaaagtaagtcccagtcaaaaagaaatcaggtagcaagatattgactaaaattaatccagataatgaaaaactgaaagtgcaaatgactgaacccacgcttaatgccaggaggcacacctgaacttgtaaatgggacaggactaaaaaatgtattcaggagaaggcttataacatatatggatgtctatgaaagacacttagacttccagagctggatgggattccaggaatgttttaaattattccttggaattcttatttataagactgacccattctgggaaaatgagtgcctttcctaattagggggaggggaatgtatgctttgtatgccagggttttcacagtgtggctgctttattttgaaatagtacaaatccctaagaaatagaattctagaactgatatatattctagagatcatttcatccaacatcctgatttttctgactgggaaattgaggctcagcaagaatgtgactcatctagggtccagctagttaagctagtgacagagcagcagctagcctctgaggtcctgtccatgatgcactgtagccacgtagaaatgatttcaagattacattccagagccccaaataagtctgtttatcagtttggattctctgtacttctctgcttaaaattacacaacttgaaagataagagattattcaaagtaatagtttcttcattttaaagatgaaattagagcccagggcaattctcaaccccagctctccttgtcccagtatttcctagctgacttttcttgaccaaaattttccacattatattctgtaggaattattagtctgtggggatattacttggccagatataactgaggaataatgagttaaactttccttttgcagtgcttttcagagtgtgtaatatgctcactggccaaagaggctacagaatttatagcacttcccaagctcattgaccacagaacccttttatcaagagacaaggttcccaggaataccagtttggaagacaggcaacctgctgtctttcaaaatggggccgcttccctttgcttgtttagtgaaggaaactgaataagaaatgcatgggttgattacaagaaaataatgggggcagggcgcactctagggtcagctaggcttccttggtcatttcagtagctgaggacatttgaggaaaatgacacaactctgccaagagtgaccatatgtttctacgcgtgattccctccctttatgacatcttgctgtggttctttgagctctctttctggcatgaaaactgtttcactgccttgggatttccaaccagatagagagtccctatcattcacacaagaatgaaggaacacacaagcagaatggagggagcagacataccagatgatacacaaaggagccaggaccaaaggcaaggaaactgaccgatacctgagactccttccttcccactgccttaaagtaaactcatttatcctgtacccaactgcacacttaaaaggctcactgaaaaccagcaagacctcctggaggctgccatggaaaaaaactgatttggagaaactctgtgaatgcactgttttggcattcacaaggaaagttagctaatggtgttttgtatattcttgtgagaaatgttaatggatttacttgcaaaaagcgatttattccttttccctgtcttctccctttcacatttacccacaaaagcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcggtatgtatgcaaggggcaggagaaaaatcttccctgggatatttctgaaaataagatgataattcaacagcccatccgcttcataaccttagaggccccctcaagtcgtggcaggctttcctgccagacatcatagagtctgaaaaaatcagtaccatctgaattcctttgattgtgactcctgtgcttctcccatctctcttcttccatgcccccgccccataccatcccaccactcactcaagttaccatactgtgggcacacatcacacacacacacacacacacactctctctctctctctctctctctctctgtctctctcattctaccctcatacccctgataatcctcatacccctgataatcattaggcttcaacaactctttttaaaatcttcctcaaaaaaaaaaaggggggggggtgcgggggcggggagaggatatgtcctctcagagtttgaattcattctggggtaagctttgaatggctctgggaaatcccaaaatagattctactgccctagcccagaacatacctaaatccttgaagtggtcctggcccagaagtcactgtgattctagagataagctgtgctgacccaaaacctttcaactggggcaactaagcagagtcaaagggagagagatttcagttgatcatcaggtacagaaagagtacaggttcatcctttcctcactgcaatccatatgtgatcccaaagaatattagttctatgcaagagaacttgtcaacatgtcagatgccaacagaccctcactggctaatgtgctttcctgagaaatgaaacccttattccacttagcccctacccctaccaacagatacagtcttcacctccgtgctaaaaatagtgaccacctagttgctgggtccatttattaaaatgaccagtattctcctggtgaggggatggaggcccagagggctgacttgaacaaggtcgacacagctgattacagtcaaagctggggctaggactacatgcctctctcagtcactcagcaccaatttgttgagctcagttgtgtctggaaggagacctgcaaatcaggttacaaaggttattttacattttcattcataatattgacagcccttctgttttcacgcagctgtttggtcactcagccaggaagctcccagcttccatttggaaataacttctccaagcattaactctccattctctgcacccctcagtaccccagacccaaattgaaaagctctgcctcaggagttcccatttggcagtgcctccccgtcacagggaaggacagcagtcagagctgagccactgaaaaaagccatttatcacacaggaaatctgagctctgcaggggtcaaactggcaggctgcttggtcaggcctgcaggatgtctgcttgatgccaatgctcacatcagtggaggcagaagtgaaaaatcagtgcagaacgaggaatcccagccagtgtccccaggggttgaacagtgttctatttgcaagtgaaaacatcagtttcaaccttcatttcttttgagtggcttggtcccttcatagaagactatctcagggtttttttgtttttcctgtacagtgctaaacagttttaccaaacacaagttttctctccaacatgaggttggagggaaatttatctgtgctgtgaattgaaaggcatttgatatcttctgtttattacaaaactttaggggtagtgaggatgttactgggataattgttttaaaaaaacaagtggatttaaagttatatttatagtgggaggggggtattaaatgtattcactggaatatattaattgaatgaatatattcaaaatatatgcaatgagttgtggctactttcttttagaaccagtaagatgtttgctttatatatctctcttaaggagcgattttggtcctactcataggttttccacccatcagcagccatatagcacagtaaaatggggctcagttaatttgcagctattttatttgggttgtgacttctcatctatatatttactacttaggcagaactaaggtgtactgtagtaataaccccccacccacccacctcctgtacaatctcagtggcttaattaagcaaaagtttatttttcactcacactgcatgtctaacatgggtcagcagaggctgatcagagttccccaggaacccagatgatggaggcttcatcttgccaggaatttccaagatctctgcagcagtaggaaggcaacatggcagaccactcactggctcttacatctttgcctccaaagttacatcgcttccactcaacattctgctggctgaaccatgtcatatggtcacaccttctttcaaagggaagagttgagaagggaagagttggaaataattggggaaaagcaccaaagacttccataggaaagttgaagagaaacagactgtgatttgagcagagggattctttgtgacagggacacaatagctacaaacatcacttagactagatcttcaggggacatttccagttttacacatgttgtttcattgccaactgtagtcaatgctattgtcaacttgggaaaccatgatcagcaaacatatagctaaccaaatttttaagtactccatttgcctctgctccagttggtgagtagaaggaaatacaaacaggcttgtattagcataaggttcataactactccattagcgcaaccttacatatatgtaacactttaaaaagttaaagctttcacacattatcttctttgatcttcataacaattctatgtcctagatagggcagattttatgatcacatttttaaggtaagaaaacagctggggagagagagatttgtttttgtcaggggaattaccttttattcccttaaccttagcagcaatactgatctttattctgtactgtattctttagaatttagaatagtcagtaacaatatctactgaaatacagcatttggattaactaatgtgtctacacatccacttattcctaataactttcgatgtagagaaatcatgctgtgggtagaataaggaagatttccctcccatcatgcttgttggcaagtggccaagatgcagaagagcaccaggagctcctctgttccatggcagttcccagccatcaactgagcagactggacttgtcccttaaatcttctggaataccagagtacagtactgataggttttttttgttgttgttgtttcttttcctgcagttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcaggtgaataactggtttaagacatttggcttgggctataaggtaaactttctatccccttttcctccagcttagtctattaattagagctgttttttccctcctgaaccatggcgagggggtggagaggtttgtgtgccttcaaccagatctagatatggtgacttgtctcttcttccatacaaggacagtgtggaggggagggggccatacaggccatatcaggggtcaggatccagttttagatctgtttagacctttaacatttttcaaaagatgcttaccagcctacattattttcccgagtctggcccacatggcaaaggaaagggcaattctaagatttactggagctggaccatcctggattgtcttaggtctttaagcccatgcagtgctgaatggctgcatttaatgtttgaggggcattttataagaggaaaacaagtactatgaacccatatttgaagttccccagagattctagcttctctgtcccagttactgtcctatataggcactggcattgcatgggaaaataagacaaagtccttaccctcaaaaataaaagtctggtaaatttggaataaataaaagattacacttaataatatctttctccaactctggatggtctagaccagtgtttctcaaagtcaacagctctgactttggatcacctgctctgatattaactaaaggtatattaaaagtacagatctccaagcctaaccccagatccaggcaatcagaatgtctgggttaggtccagaaaccattgtgttaaacaaatacttgaggtgattctaagaaagcactgatctagaaggtggtccacagatcagcaacaacaaaaggagagagatgtaatgcctcccagatgtggaatccaccagtctgaataaagcagaaggggagacatggacaggaaattgcaatgcctcgtaactagtctttaaccagcgttaagggagactcacggcacagagacaagaggcagcctctaagctccccatataactgacatgtacagtgactctgctgtcatctgtcttctgtgtcacagaagctccaccaactacagaacttcaatacactgatggctgtgataggtgggctgtgtcacagctcaatctcgaggctcaaggagacaagttcgcatgtcccacatgaaatcaataaggtcagtgctactgtcttctctggggcccttagcagcattctcaagatgtgtgccaacattttctccttggtgggcagcccagagagcatttccaaccacaccatcccttgtcaaccaggctaagtggcagggaggcaaaccttaaggaaatccataggatggagaagtcacattttttagagtaactgtgattttgtctggcctcagacagtgtcactgcaaacattcctgctggaccagttgaaacaatgtgtgcctcttcccatgttcataggccatggaatattcagttaccatctttgacactgattccctcgctccagctccttgctctaaaatgtgttctcaaaaggaattgtggttcggttgaccataggtcagtttgcacattgagtgtagttatatagtgatatattaaaaacttagctatccagaacccttgaagaatgacattccggatagttgaattttaccagataattggatatgagttcttcagataccattttgtaatacataatgttttattaatgaatatttttcttaaatgtcctgtacattttcctacattattagattttacagaatatacttttatcttttatgacatagggctgttttgcttgtttctcttttttatagaaacagggtcttcctctgtcatcaaggctggagcacaggctggcacgatcatagctcactgcagtctcaaactcctgggctcaagcaatcctcccacctcagcctaccaagtagctaggaccatgggtgcacaccattatgcccagctattttttaaaatttttgtagagataagggtctccctatgttgtccagactggtctccaactcttggcctcaagcgatcctcccatctcggcctcctaaagtattggaattacaggcatgagccactgagtccagctggagctgttgttataaatataaaccactgtaatataccgaggatataaatgtatggcatgggttagataatgactgctctttgagcactttcatgtaagaggaccttactatactcaagccccgatccttccaaactagcatggagaggaactctctttttagggagagatacctaagctcattaccccatctgtttttcccaggtgttcagctcccttttggggagtcttttattatctctgttatcacaatgctgggcctctggggaggccccccacttcccagtggtctgatcaaaagggcatcatctttagtcacctcttcattccttaacggttctgctgaaaccaggtggaacagttgaaaagattgcccacatctcagaggtgacagagagaaatagtcacagagattaagaagccttcatgtcatttagcttataagagagagcttgctcctcttcagcttggggtccccccacagcagtgcttcctgtcggtagctacttgaccctcagggtggtctgcatagtgaattagtaagtccagggttgaagcaaaagtccccaagttgttgatttcaccttcggaggggaataaaaatatctttatcatttttgctgttacactcttgtcttgtgagccccttccatgcctagggctcacctgcaccattggtagaggtttatgaagaagaagctctcttgccatctcccagtgatttgaaggggtctgactccaagaactccaagttcttcattgtggagaaatggtacttcgtaggccacaattttattaagtttgggcacagtgtctaaaagggttacagtagtcccccttatctgaggttttgtctcctgtagtttcagttatctgaggtcaactgcagtccaaaaaaaatttaatggaaaatcccagaaataattcataaattttattatttatttattgattgagacagtctcactctgtcacccaggctggagtgcagtggctcagtctcagctcactggaatctccgcctcccaggttcaagtaatcctcctgcctcaggctcccaagtagctgggactacaggcgtgtgccaccacgccgggttaattttgtatttttagtagagacggggtttcaccatgttagccaggctggtcttgaactttggacctcaggtgatccgtccacctcggtctcccaaagtgctgggattacaggcatgaaccaccacgcctggccaattcataagttttaaaatgcatgctgtgctgagtagcatgatgaaatcttaagccatcccattccattctttctgggactccttcatatcagtcactaagtagccgtcttggtcatcagattgactgtcatggtattgcagtgcttgtgttcaagtaactctcactttgtttaataatggcctcacagtgcaagagtaatgatgttggcaatttggatatgccaaagagcagccctaaagtgtttcctctaagttctttacttaataaggaaggaaaaaaatcatatgctgaggttgctaagatctaagtaagaaggaatttcatctatgaaattgtgaaaaagaaaagaagttcattctagtttctcttttgtacttcatactgcaaaaagttatggccacagtgcatgatgggaatggcattacatttgtgggtgggaaacatgaacagaaatgtgttccacttgacagcaatcgggtttgttactatgcacagtttcaggcatcaattaggcatcttggactgtatccccctaaggataagagaggactccttatgttgtatgataacatgattggcagacagtcacttcatgtctttgcttctgagaaagctggttatcactcatggggaatggattctgtgaactgcttgctgacttgaatgacaagtgattgaaaagaaaactagatctggctgctccctttctgtgctggtgagcagccgttcccacttccaggtttgaagcagggtgtaacctctaatgtcctctctcctgtcctttgctcagaattgatctagtctattcagtctttttagttcaaggttttagtctgtgaatggaatgtcacttgctttctagtcataggcccattctgagaatcttgaaaggcccatcaagcacctcatagagaataacacacaatagactactgaagctccactcttaaaatacatgctcttccccatgccagcaacatagtcagcatttcctgacatcacatttcaactgttaatcaatgcagtgtctctggaagcattcagaagacaccaaggaagggaatcacatggcttggggacaggagttagagggatagtgttcactatatattcttgtacctttttaatttttgtatcaggtccttgtttttgaaaagaaggaaattttaacataaaaatgataaaaccccgatttataatgtttaagttatataacagattcaagcatatcttgtgtttataaatatattctgtgatatttgacatagctgaggttttaactggggagtcataatctgtaccttttacatgaattaccccctgctcaacaaattctggatggggtgagatcatggcacaggatgcaaacatgcaaggtcctcattacagacaatgcacactgcctagcgggtacctgtgattggtctgttctgctttgtaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacggtgaggctcacactggaggacaattactaagcactttctgtgtgccaggtgccattctataccccttaccaaatattagctgttagtcctcataaaggctctatgaagcagatcctattactatctccaacatatagctagggatactaaagcacaaagatataccttgccaggagaccacacattattaagtagcagagccttgattcagacccaggtggtgggactctagagactgtgcccttcagacttctaggactgtttcactacctctacaaaagcagtcctaagctctctgggaggagctgatggcaaatcaggatacaagtcttggtaacagatggagagaatgaatgtgctctcataaaaagggcaggcagtaatttaaaaaacaaacaaaaaacacccagggttattatttggttcctggcttagatctttgctcttggagatattcaagtgaagatgaacacttgtcaatggtgtgggagaccaggatttgcattttgcatatggggtgagatcagatgatgaactcccttccagacctgcaattccgtagtttaccagctgtgtgactatggacatataaccgtccaagattcctctcctcaaacgaattagnnnnnnnnnnnnnnnnnnnnccagttctaaagttacacagtttttaacctgctgtttttggagagtagaataatgatcataacctctttctgcctcacagcagcattttgatagaaccctgggcttcacatcagctggtgtgtgatcctagccctttcacttattagccaggtgaccttggcaggtctgtgtctcagacatcatttgtaaaaacatggagtgaatcttaacattctttggattataaatcttgtgatgaaagctgtgaaccttcttcccagaaaaatgtacataagccatttatttttaaatatgcatgtaatttcaagttctgaaatccttgaagcctatccatagactcaaggttaagaataagattattcctaaggacttctctcctaaaattttatagttctaagatacatgaaactcactatttttttttttttttttttttttggagacaaggtctggctctatgacctagactggagtgcagtagtgcaatctcagctcactgcaacctctatcttccaggtccaagccatcctcccacctcagcctcctgagtagctgggaccacgggcacacgccaccacgcccggttaacttttgtattttttgtagagacagggttttgctatgttgcccaggctggtctcaaactcctgagctcaagcaatcaacctgccctggcctcccaaaatgctgggaatacaggcatgagccaccatgcacccagactcattaactcttaatagcaattaatatgtcttaccatttaaactggattttattgctggactcaaatttaatagtctcagactatacacaccatcctttcagatcatctgtctgctttgagagagaacaagtgatgtattagtcatctgtccagacaaggcctttggcctaagctctatatagaggcttagatttaaatcatagttaaaaagagggcatcctgagatatgtccaaaattaaaaacatttcaatgagaattaatgcttgccctattgcaatagtaggtgttatacctgttttgtgacttttgaaaacaaactgtttagaacctaaaagagtaaactactggcaaggaaaatccaagaaagaaccatcagctgtgggagaggcaaacagcatcttagcaatgaaccctgttctgctttgatctgcagttatccctggatctttactacactgaggatgaaatctatgagctttcctatgcccgggaaccaaggaaccacagagctccagtgagtttttcatattaagactccacatgtaacaggtgctttacaagcttctcctcgagttcattcatcctcaggaacagactttcagttcagtttaatacatgtactgtttttcttagtgctcaaccttatgctaggaacagagaaagcttttcaacatatgtctgaggaatagttcctgtccattaaaaagctgtgatatagttgaagggataagcctaatgtgtgaccagtgaataactagtgaacagtaaataactatatcatcagaatgccaggtgtggtggaatcagtcagtggtttacaaagtagagaaggaagatactattgtgcaccagagtgacatcccccccgcattaagaagagtccccacataaatttcttttctatgattcattgatgataatgagagtaatatgcgtactaatcagaagctaaatttctgaagatttccaggttggtagatagaaaagccccattttcctgtaatgttctgggtgaaaagaacagtctgctgagtcttttgacctcctatgctgagaagtcctcaaaatagtacacagtcctggcactgcctgcagtaggaacttcacaggttatctgccctaccctcccacaggcaagtaaaatcacttcagtctcctgggacgtttccaaaccccaaaacaagtgatactcaagggaagagagttgcccacacttaagaaatccagctcatctattggggtggctaaattgcactcctccacacagaaagatcaagttctagctttctattgtaatgaaagattccactgaaaatatttggtagattccattttcaggttagaggcatttcaatggaaagggtacattctgttttttcagagagattttaatttgggctgagtttcaaatacagtcatgcaccacataatgacattttggtcagtgatagacctcatataccacagtggtcccttaagattataatggagcagaaaaattactactgcctagtgacagaacaattgtaacattgtagcacaacacattactcactatgtctgtgattatactggtgtaaacaaacctactgagctgtaaaaagtctaggttatacacttacgtacagtacataatacttgatagtaagtattaccggtttatgcacttactatacaatactttttatcattattttagagtgcattccttctacttagaaaaattaactgtaaaacagcctcaggcaagtcctccagaaggtgacagctccatgcatgttattgcccctaaagaccttccaataggacaagatgtggagtggaagacagtgatattgatgatcttgactctatatagacataggccaatgagtgtaattgtaccttagtttataacaaagatttaaaaaattaaacatttttaaaatagaaaaaagtttatagaatatggctataaaggaaataactggtacagctataagctatacaatgtgtgctttaagctaagtgtcataacaaaagagtaaaagttaaaaaaattaaaagcttttacagtaaaataaggtaatttatcattgaagaaaaaatttaagaaacttagtgtagtctaagtgtacagtatttataaagtatataggagtatacagtaatgttaggcctccacattcactcaccactcacgacttgccacagtaatttctaatcttgaaagctctattcatggttaagtgccctatacaggtgtaacattaaaaaaaaatttctataccatatttttaccttttctatgtttagatatgttaagatacacaaataccatcattacaattgcctacagtactgagtataataacctgctgttataggtatgtagcctaggagcagtaggctataccaaatagcctaggtgtgtagcaggctataccatctaggtttgtgtaagtacacactgtggtgctcatacaatgacaaaatcacctcatgacacatttctcagaacatatgcccagtcattaagtgatgcatgactgtatttagaaaagagcttgtccaggcttccgatgatttttcttgtgccttcctgccttttagctaagcttttccttattcacatttctactgcaaaatgtgactggagaatagagaggaaacataaatgatccactttactctttgttgatagctctgacaaagggtttaatggagagggaattgcaactcaggcagattgagaatttcaaattatctgtagctgcagataatgtatgtgaagagcactctggaaaccgtaagcacaatgccttgttagccaaaattattagtagagatttcaattgcctgtgggttctctgctccttgccactgaacataattgaagattgtccataaatgtaaccgtcaggtagtgggaaaagaaagagctataggttataatattgcattgtagtcatgaggatttctctaaatatttcattttagccactaacaccttcaaagccaccagtagtagtggactgggcttctggagtgtctcccaaacctgatccaaaaaccattagcaaacacgtccagaggatggtggatgtaagtacagctgtgttcagcacacaaaaactaggcattgcctggctcagttttgtatgtggggtaaagggagaggaaagcacaatggtggaaatgtaaaggcacgaaacttgaaccacttacttctcttactgtggctttagaacaattcaaaagttacattttgacaacacacactggactcatatgaaggcagttgtgcctcctcttcaagacctagcaaaagagcatatgcttaaaggttgtcagttgatttaggagtacagaagtattgggatgcatttgagtatagtaaggggtaatcaggtaaacctaaaactgaaaacctttgtactgcttaattcaattctctgtgctaattgctgaggaaggggtatatattctcatacttatgcatgtatcctcgtggacaactcacatgtaacaatggaaaactaagagcgtaacggtgagaaacaagaggattaacagtggggacagagcacttccaactgggctgtttgtagaagcttctcaaagaaggtacaactggagctgagtgatgaaaaaaagggtagagtgaaaggagaacatccctctgcgcagtgaactaggagtagccagcgtgatagtataattgacgtgctaatgattcaaagtacatggccaccccccacatgctgctaccagcaaaggcctgagatgtgacctgccacatctttgccacagctaaaggagcaggtttccctgttcctctcgttcaggttgttaaaaggcttttatccaactgccccagctctttgtcatttgactaaagggagagaagaccggtttctctttagtaatcaccaaaaaaactcctttttcacagtctgtcttcaagaactatgatcacgaccaggatggatacatttctcaggaagaatttgaaaagattgctgcgagttttccattttccttctgtgtgatggacaaagacaggtgagggtttgtacttaggaatatgtggttatgagcccattggtgagaataggtttataggtatgtcactagaagaatttgaaaactcagatatgttgctgctgtgatcacttaaagaacagaccatgaaatatgcattcttttaaaaatattctgggcctgggcacagtggctcacgcctgtaatcccaacactttgggaggccgaggtgggcagatcacctgagctcaggagttcgagaccaacctggccaacatggtgaaaccctgtctctactaaaaatacaaaaattagccaggtgtggtggtgggcacctgtaatcccagctactcgggaggctgaggcaggagagttgtttgaacccaggaggcggaggttgcagtgagccgagatcatgccactgcactccagcctgggccacaagagcaaaaacctgtctcaaaaaaaaaaaaaacaaaaactgaattgaacattccataaatctgccactttataaatagtcaactataaataagaaaaagtttagtcttccttcttgctttgtcattacagattttgggaaacaactaatacttattcatactttgcatttttacttttctcaaggttaaataaattctatcttggttctctataggaaactaatcatatggttagtgggttccagttaggtactgtctaaagtcagaaactgtagcataagacatttccctccctatacacatgtacatgttacattgtttctttttcaagtcttatagatagtggtcaagttagttagggaaacctagtttggccaaagaacacctctgtggaaatgagtaatgctgccttacctacttaccacatgtcatcttgtatccttgttaagagtagggcccatggaagtaatcatgaggtagcacataccatattaccactgaggataaaaagaaaggtgagtttctaaggctagaagcccccccttgctacctgcctccatgccccttatactcacatccttgccttggtcatctgccggcagggaaggcctcatcagcagggatgagatcacagcctacttcatgagagccagctcaatctattccaagctgggcctgggctttcctcacaacttccaagagaccacctacctgaagcccactttttgtgacaactgtgctggatttgtaagttgttcttagggtgctccagggctgaatttggggaagagtgtgggatactttaagacaggcacagacctcacaatccttatgaacccatcccagcttggagcccagacagacacctagaataacctagagctcaagcgtgtggtttttacctgcactcatcatctctcgcttcttcctgttttttcttttctattgcaatgaggccttagataaatggtaccagaaatgctgaattaggatatacttttaaagtataatattcatgtgctgtttcaagtgttataacaaagacatatgagataccttctgtctttaggagataaccttggctatgcccctcttccgttccactcctgaccaatcgtttccccctaaactcgggtcctgatgcaaggctctatatccttctcagtttggagtcctgaggaacctgtttgcccgatgattcatccatttctcgagaatgtctgggtcataaggctgctagtgagagccaggtgtggtggctcatgcctgtaatcccagcactttgggaggccaaggcaggcagatcacttgaggccccgagttcgagaccagcccacctaacatggtgaaaacccgtctctactaaaaatacaaaaaaatttagccaggtgtggtggaacatgcctggtagtcccagctacttgggaaactgagacaggagaattgcttgaacccaggaggtggaggttgcagtgagccgagatcgcaccactgcactccagcctgggcaactgggcaagactgtctcaaaaaaaacaaaaaaaaaaaaacctgcttcttgagaaactttgatcagcataaactcttctcatggatttaaggtcagaagggacaagacatgagagataaatgaggtttccttcccacttgagctagagagtaaaatgaaggaaaataaaggaatgtcaccttgtagcctcacaccagatggatgaatgacatgtggtgcattctgtctcttgtttcatagctctggggagtgatcaaacaaggatatcgatgtaaaggtaagactcaatattgttgacatattcctggtgtatcagtccattctcacgctgctatagagaactgcctgagactgggtaatttataaaggcaagaggtttaattgactcacagttccacagggctggtgaggcctaaggaaactcacaatcatggcagaaggggaagcaaacacatccttcttcacatgctggcaggaaggagaagtgctgagcaaaagggggaaaagcccttatgaagccaacagatctcatgagcagtcactcactatcatgagaacaacatgagggtaaccgcccccaggattcatttacctcccattgggtccctcccatgacacatggggattatgggcactacaaggtgaggtttggatggggacacagagctaaaccatatcagctggtcttagagtcccacctctaaaacattttttacccatagtagttgtccatttagtccacaacttctcagcagagttcagagtctcatccccaaagtggtttccctcggacacccccggtgaatgaccgccacaccgaagagagaaatgcctggttgcacagataggcattttctctgtataaaatcctctttctgtcgtggctggcctagaacagggatagcaggtaggagatggtgctctcatatagtcatggaagggtgggtccccagtgaaaaagatagaatctcttctgcaacagaagataaatgattactaaaggcccttgtcagctttcctttatcactcaggacataactgtccttccttgtgactaggagaattcaggagtgaaagagaggaaaccttttactgcaagaaagaaaataagacctaacagctgagtgtttccggagggtctccctagagtaggcagaatgtatgggataccaggacaccatctcttccctccaagatatcaggatactgcttctgatgctgagattcactgataagggctacatcaagagtgtgagctctgggcttcaccaagtgagaagaatgctagcttcattaggaatgttaagtgtcttagctccagaagatagaacagacatgtgtgacaagaaagcactgcatgaatttggttgtgagacacactggggaagagagaaaagtgaaagacttcttgacccaggatgtcttgtccacagactgcgggatgaactgtcacaaacaatgcaaagatctggttgtgtttgagtgtaagaagcgagccaagaacccagtagctcccacagagaacaacacttgctgtggggccagtgtccaacctttgctcattgggagccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagcagcaggaagcagacttagccacagacagagttctactagctgagtgactgtctatgatagccccaatttttctccaggagaggaaccccaagccattaatttaagaccaggtcctagtctgaggaaccctgaggggccaggtagcaggtaattgtcaaaattctagaaacagaaggctaaatgtagaaaggaagggcggggggcaaactcccactcaagtggagcttgcagattaaaattccaaatcatacaaggaaaatcctaggactgagacaaaacattcaacattcaagaaataaactagcaaattcacttacattaaaatgcaaacaacagtacaataaggaaatgactttgagtatgtttgagatgccccagatctaaagtgcaaagaagcagaatagactgtctctgtcttcatggagtagttctagttagggggaagataatatacaaatatagagcagtttagaaacaatgcaagagtatatgctaagagccaaataggttgcagtgacagcaaatgacaggaggacatagcagagagatcgctgtactggggctgttgggactttatggagaaggtggaatttcagctaagtcttgaaggaagggtagaattaagttatgggaggaggacagagcacattccagataggatgtacagtaggagcaaaaggccaagggcagaacagctttagtactattgggatagtgggaaaaaaaaaaaggtgttaaggcgatttaggtaagagatgaagtagaaaaatgagacagtctagagagtcttaaatgacaggtgcctgtctgtatgataaaatgaggagctatttaaaaaagggtaacatgaagggcttgttggggacggttggggcacaaggcttcatagtgctatactaggccctgatctctgggctggctggttagccagcatgtcaaaacactgatcaccttgactaactaaagaacatataggtcttcagcaaaaatccagtgcttattaggttagtgccagtttaatataagaagctgtgtgacttctaagtagaaccaaaaagggaaataagaaatgagtttatttatataaagcacttaaaatcgggcttaacacgtatgtaccatatgttaatatcattactcttttgaaataagctccctaaagtggtaaggccactatcgttacaacagatgcctagagaaaaagtccatatagtatacattctgcatttaaagcacttctaatgttcagtggtaaatatccacatgcatttattgatcaattagatcaaagcttaagtgcttcacttccatgtaagaaatgcacattcctttttatcacatcagccaagtaaaaattttctgtcttcctaaatctttccccttactatctatctaaacacaggctgacttcaaacttttggggtgttttgttcttagggggaaaaaatcctcttagggtcttttctaagaaagaatatgctaatcaactaagaatttgatgttcaacttttaatagaaatcacaaacaccattgtgaaaaataggcctgtaccctgtatttcattcatgcactctgtattttcagagttacacataaccttagggcaccacaattctgtcacataaaatgcagattttcaagtggaaaagacagcagagaacagcctgaatctgaggcctcaaaaaggaatccctgaaggggcagttgttagagatttctcctctccaggccatctctccccttttccaaaccctgccccacagtggtaagataagtacttgtcaggaagtagaccaataggtaggataaacatacatgtatcatgggcaacaaaatgaaaattactatattattataaagttgctaaaagtcaaggtctatttataatggcaaaaatgactattggatatcatccattcttagttatttctatctcattattatcggggatggtttctgcttatcaaatcaaaatttccagtgatttcttttagcccattactatctttctcaatctcatcaactttcactttcttgaaacttgtacctctcctaatttctgttaacactgtcatctctcaggactcttcctgcaattttaagggctttctgttgctttttgttcttactgctttcttccttttgctcctcaaagtgtatagtgcctgaatttctgtcccaagctccctgtatgtctaggaattcaacctaaataatggaggggattatattcataatttgacaatctaggttggtaaaaagaatgtataactgtattacagaaaagttggaaaatggagatataaaaaataatcacccataatactcctccaaaaaaaaaatgtaattattttagggtgaccataacaatttaaatatttgagcacttaaataactatgtaattacaattttgagctttattggataaatattaaatgttaatttaaattatgttctctttggcaagaattaaactaagatctttgtaagatttctagttttacaactggttgattctggtcaaatactaattagaaaacttttttgttgttttttaaagccatcttgactatactaatccaatgtcttcaaagtcagactatccaatgttttaatcactgctgagtctttccaaaaagtaaactgagatgatcttcagtttatcttaaagcctatctatcgcccacctcaaatacatctgctcttactttacttttccaggaaattactccttatggctaacattactaggctggatcctgggtagtgggtcttagttaaagaaaaccagagtaacttacctttttcctctcagtatcaaacaggggcaatacattttaaggtacatttccacaaagctaaaacttctttctcatggttaagctgtgcccactgtacaaacgggttcccagagagtacttacctgctagagggtgtctgtatcaggactgagacatgaatgtggagagctcccaaattccagggtccaaaaaagtatttatggagcatttctgtctagatattgttcttgttctctttattttatgaaactctgtggcactgaggcaggggcttcaacttacctccaaaaacagaaaccctctaagcaacctttgtgcaaacagaagatgctctttctcagggtggatgtagcttgacaccagtggccatgtcttggccaaagcccctggatttagccctcaccccctaaactgggtgcctgaaaatgggtcctctttgaacatatggaactccagtaacaataagaaaggtctcattgaaactaatgtctcagtcttgagtctctgctttcctgagctagagtactagcatgtcctgtatcttcctacagcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggtaccttccttttcattttcctttttttcagactatcttagagaagtggggccaaaccaggaaagagcatgtggactgaagattcagatcaggctgattacaagcagtctaaaacaaaaaaggaggaggggagaaacagggagggagaaacagggaggaagagagggagggaaggaagaaaggatgattgattccagctttctcacaacccactgggggccttggttcacattacacaagtagcacaggctatacagggctccctatcaccacacaggtggtggcatttcagagtgctggtgccagtgcccaaagccctgtttagtaggctcacagagaaaaaccacagtatctactggttagctttactgtgctgataccactccttttctagatggaactaaaatgaacttgcctaaatcctccttccctagaggtctctttaacatgttcatcagggttatggtttaggatcatcatggttacctaagcatcttcctaagagaagttagtgatcttagtcctatagcaacaacaacaagagaaaggtgagtgtattgtggctcaccatagaaaacgcctccctcctaaatataaacgaagagaatcttttctaacacatcagggaatatgctgatcttttacacatattagaatagtgaaagcaacagtagcaggcaaacacacagtggaatataatatagagcaatataatctataaaatgttaacaatcatgacaagaggagctgcttttcaatgttaggctcacaatgtcctaattatcaggtacctaacagagacaatggaaaagacaaaataaagtttaccaaggaaaggagaccaagagtttggaaacatggtgccaaggtttgagagaagggaataatgacattaaaaacaggaaaatagggctgggcgtggtggctcatgcccccagcactttgggaggcagaggtgggtggatcacttgaggtcaggagttcgagagcagcctggccaacgtggtgaaaccccgtctctactaaaaatacaaaaattagctgggcatgatggcaggtgcctgtaatcccagctactcaggaggctgaggcaggagaatcacttgaacccgggaggtggaggttgcagtgagctgagaccaagccacggcactctagcctaggcaacagactccatcttaaaaaaaaaaaaaaaaaaaaaaggcccggcgtggtggctcacgcctgttatcctagcactttgggaggccaaggtgggcggatcacgaggtcacgagatcaagaccatcctggctaacacggtgaaaccccatctctactaaaaatataaaaaattagccaggcgtggtaatgggcgcctgtagtcccagctacttgggaggctgaggcaggaggatggcatgaacctgggaggcggagcttgcagtgagccgaaatggcaccactgcactccagcctgggcgactgagtgagactccaactcaaaaaaaaaaaaagcgggtggggaggagtaggagacgggaacagcagaaggaaaaagagccaacagccaactgtcaagatactcaattctgaaggttcaatcattactatacttctttttgtttcgagtacagtacacaactcacagggctggctcaagaggttacctataattggtaagaacctacaaatggtaagaaactactgtcccatggcatagtagtttcttaattatagataactaagccattttagagacagggaagcaaggatacgttaatatcaacactactattcactttattacaggaggaggaatgcctttctggcttttcccaaaaacatcaaggtttgcactgtgtttttggagacctgtcagtgcaaacacaaaaccaatatccagctagtagaattccttatataattctacattctacagactgaaaaactgtccacgagggcttcaggattccctgcattgtcctcaatgctctaccttccctgtcagacccccagaaactgaattagagaaacatctgaagaaacaagttagataacgtatgtggaactcttgatttggtgcttggtacaaagaacataatattaagagaaacatacgaaaaaagaacaacagattttctggatgaatggtactctcttgctcagagttattgttaagatgtgctgtaaaaaccaagtcaatgagaaggtggcaaaacgtgggttagacaaaccccttcctctttagggatagaaactgccaaatgcaacttctaaaaatgatgaaagaaacctcgaaaaatgaactcggtagaatagaaagaactttggtcttggaggcaaagatttgtgttttcagtcccagacatttcttacaccagctgttaaactctacagcctatttggtccttgtgaaatacagggctgggattccatgttctgaaaggtttgcctcaaatcttgacattttacatgccgatgaaaaggaaaaatgtggttggcaacaatgctttaagaagtggctcgcagaaagattagaattcctactcagcaacatcagagccagtaaaccctctcaccattttgaccaccgcctctctttactttttaggcttgtcagatagacctaaggtccagaattcactgtgtgtattttagaggaacaattatgtgtcccactttcccattaagtataatccttacaatgactagtctatgtgtaattcaacagtcctatccataataactagtcaaattaaatcagtatttacaatatataacgtatattaataagaataaatattatgtattattttaagtataatgtaccactgaaccagcatgggacaaaagaataagcaaataaaagcttttatgtttagatataccaaggctcaactctgcagttttatactatatggcaacatttgcctttataagattgaggtatacaacctattttcagggtgtttgtgtaggttaaggcagtccattatgtcacacagcgcaggcacatagcaagtgctcactattatatggcagctgagacagctatgtagataattcagattgagaaacaaccccagtgtatcccaaattacccagacactggctatatataatattctcttggagtaatcagtataggataacatannnnnnnnnnnnnnnnnnnnnnnnnnnnnnnnnnnnnnnnnnnnnnnnnnnnnnnnnnnnnnnnnnnnnnttggctctataatgataccactacaaattagaccactaaatctcaacttaggggtggggtgaaattcttaacatcatcaaaaagttaaatttgttttcaataatttgtgggggggaaacttagataaaattaactaacaccttgcattacagaattctcagtcatgctttcatggctcagacctgaccagagactgtttctgccaagttgagatctcccgcgagaaaacatccaaaagttttgtcattatctacctattgctcggaaatggtttattctgcctgctaaccactcacaaactttgatatgataacaaagactaactgctgcttacaaatgctcgtttgatatttaacttgctattttctattcagggcaaaataactatcttgaaaatggttgttaattctcagccacagtgaataggaaatgccaatcaaaagtagctctcaatttgtaattcatttgctattcattgctgctttattaacatacctcattctcctttccctttaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccagtagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaacacaaatgtcttgtgtttcttctgcttcgtgaccccgtaaacactttacctgaatttttcctatattccacagctaagaccactgccctattctattaatcaaattgagttttcctggaaggaaaggcaaagcagctattcagtttaaaattttctacatctttttacaacacgaagaagtaacactacagaaatattcaatctctttccatcttattcataacttacagtggtccccaaatattaagtctataaatacttaacattaaaggagacagacttgaggttgtcccttctctgtggcttttaattccacagtttcatctaagcaaactagcatgtaaagaagaaatcctttgaagctatggataaaattggtaacgacagctcaatccaggttacagacctactcagggcaatttatttgtggtcatgattatttagaatgatcagacatagccacaattttcccttaatccccagctaatttttgtttaaccacaccaatgaagaaagaggaaaaatttcagtcactcaaattcctctgtggaatgcattctggaacgtttagatgggggtgtatttatcatttgggcaattcataatacttcatacaaagtaataaagtcacactgacagcctgatcctgaaggcaagattaaactgcctgctcacctcccccaattttcatccccacatttctctaacctgtgctccttccaaggtatagatagtatcactgctcaggacatttttctggtcacaaattttttttaggttgtcatgcctcctcttgtcacagatacaggtaataagatgttttttatttaaaatgttttcctttttctgtttaatgaggcaaggtttccctgatctgcaaaacaaaagtaagttcaaagaaaacccttgtttcccttttgatgtgtgcttatgagtaatagtgtggtgattatgttatagacagaatacatgctctttatacggtcgagaggaaagatgactactttaggcagaaactcccagtaagatcatgtctatatttgctattaggtaccaggctggacaaaaagagaagaaaaaaggggaaggacaatgaggtaattaaaaaatgaaattgagaaccaggcaaaaaagaatgaaaaggaggtatcaaaaaaagtgttggattttaggaagcagtggagtgccattcatcatactccatgtcgtattgcactcaatttataaaacattttcacactatggcctttcccattaaggccccaaatttccttcctgctattccagatactgctcagcaaactgttctacaaaagaaatttttactgaacaaagattatcaggaaaatcccaccttacaggaaagagtaaaatattaagagtctacctgattcagcttttcattcaattaaggtttataggaatgtgtacataggagtggtttcagctccaacacgattccaggagcaagtgctaaactttgataggaaataagtgattgtagtgaataacccaagcagcactcctataaaggtacaaagaaatcttatggaaaatctaatgaaactgataaactattgtttctgccatatttaccataaacctttagtggtaaaaaagttgaaagtagttgtaaatctccttcatcagcaactaatgctaccaaaaaagaagtgaggcagaaatgtaaaggttttaaagaagatttttaaacaactcttgaaatattttactcaagtagtttttttcttaaaagtttttaaaaattatttttcagagttcatagctactgataaaggtattttcttaattatggaaagcctttttttcagctatcacaaatgaaattacatcttttcattaaatataaacacacaaaaaataaatttacaaataaccaaaaaattttatattttcctaccttgaacacatttcttcaaagggttagcttgaaaaatacatgtctaagattacagaatattcaatagttacttttagggttttaacattattttagattttaccacagagtttaccaaaaaaataacaacaaaaaaacctgctaaacatcaaataccacttgtccactgggaacaattcagctttctatcagttgagttggttagatcacattaagttgttatgtataggtattgaccagaagcctacaatgagatacagattttacactaagattgaaaaaatttatggtaccagctctttttctcttaactttctacactaagagaaaaatacattacttggcctacatcttaaagcattcaaaataggccctctgtaagtttttaacaaattgtatttgtatttaggtctttaagaaacaacctgagatgatggtaagtgtctcattcctcatttgacaaatgaggacaaatcactccttgagaactaaggtcatttcaatccatagcacccctgacctagtgccatgattcaaattcacaactcttgatagctaagactttgactgctccaactagcaaatcacatatagccattccctaactttgtgtttcccaaatctagctgtgaatcagaattaccacaggatgccttagccctacccttgatctactgaagcagaaaattactgccttaattctgtgtgatacaggtcagcctgccttttaatatttggatatctaaagtgagagcataaatgatgaagagaccagtttataggactatttctcacaccgtcatgtaaagttggtatgtgtctttgctccattaaagtatttctgacctcaatcttaaactttgctttgtcaaacaaaatcatgctgatttcaaatccaattagaaaataagtatgtacagtaaaaagtaaacttgggcttcaattaatgaaactttaacagaaacatggctagagaggaatctcctcctataagagaaaaaaatgattcacaacaactgcctactaaatacaactggaagtgcctttccctattttgtaaaatcgaatgaaaaacccacaaaacacatccacagcaatacaggtgaggcaagggtctatattcctttctattacaggtggggtcttttatatgtctcaaacctgaacaaaatacaggtaacaatctaaattcaatcatgacaataaaatactttccattttccaagtctgatggtaataaatatttacattttaaaaaataatttttgttcttttttttgttttttaaaaagacacaacatgctcaagggtacacagaatatggaaaaagtcatcacttcatttgagagatcaactggtaataaaaaacaatgttcttacatattaaccaattcaagagtggtatcaccagggagtctaacatggtgtttacttcaaagatgatattcaagtatgttatttggaacactatttctaatgtatctataaagaagcaagcactgctatctaatttttatagtttttagtatcttctatattccacctcctccaccaccaccaccaccaccaccaccacctcctccatatggatctccatagcctcttccaccatagccccctcttccaccataaccccctcttccaccataatctcccctgccttggaaacctcctctaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaccaccccttccaccgccgccttcttgtctcttttgccaagggggcatttctggaggtggtggttcaatttcattcggccggcctcccctgtcaggcacccttcccatcagcacctgtgtgaagaaacattttcttttagttcctaatatttcaaaaaagtttacataaaagtttcaagtgatgttgtttctaataaacagaagccaatatttaaggacatgaaagtaccagacatggcagaacaaattaatattaaaaatattaagtgtggaaggataaggagaaatctgttaaaggatacaaaatcacggctagacagaagtaataaattctagtgttctataccattgtatgatgactgtagttaatatatagtttcaaatagctacaaggaggatattgaatgtttccaacacaaagagatgataaatgtttgagagggatatgccaatcaccccgtctgatcactatacattgtatgtatcaaaacatcactatgtacctcatacatatgtacaattatggtgtttcaatttaaaaaataatttttttacttcctgtttaccaagtctgaagaaaaaagaaaaaaatgaatggttttaaaaaggaaatatgaaaaaatataaaatgtgtgatacatgacaaattccttagtgtatatatatatattttttttttttttttttttttttttgagatggagtcttgctctgttgcccaggctggagtgcagtggcatgatctcagctcactgcaagctctgcctcctgggttcacgccattctcctgcctcagccccccgagtagttgggactacaggcacccgccaccacgcccagctaattttttgtatttttagtggagacagggtttcaacgtgttagccaggatggtcttgatctcctgacctcgtgatccgcctgcctcggcctcccagagtgctgggattacaggcatgagccaccacacccagcctagaatatattatttttaaacaatctgagagagtatttctgaaacttaaaggcttaatttttttctcacttaaatttgtttagcaaattctgtaacaaatgtagtacccatttcactaagaagttcttttaggaaaacattttttatatatataacgacataccttacattcattaacttaatatccatttatacaataacaactctggactttccattgccattgatttggtaattgattatccaataaaagattatattcctaagcacatttcatttcaaaaatgtatgaagtacatataacatgggaccttaatgaggtcagagattgatataaaaactataattccaggtatcactgcaaagagagagaaggattctcaatgaactgcttcttttaagaaacttaagctcacttactttcagtgatgatactagtaccatattattaaaaggaaaacacagttaatataattcctttactatgctttataatcctttcaaaaataaactagggaagagtttaagtatccaaccttctataaaaagtagcagctttatatgccatgagcagaggaaagatagcaataagaagggtgtcatctgctcaccacagacaaggggaagccaatagcttcctgctactgcctttcaggaaagaaagtaaaaaagcaactgcctcaaccaaaatgaccaattaattatacacttccattgatcctccaatcaaaaccaagtttaggatttatgtcacaaatgaaatataaaaagtgcaatatcctcaaagtgagacaaggttctaagtatgcaacattcttttaaagatggcaatgatgtcctaactaccaaatccaaaaaacagcctttcttggttattattctcactggtctctctaccaaacatggtatgttggtgggcatatggagatgccagaactgatcataagactaccctcaaataatgagaccataaattataaactcagaagagatggccaatgttacttacagaaatagaactcttgatccagcaagactaaattatcacccaatgcaagatgttaggtaatatatttaaagagagaacactttcagaacataggattgagccacagtggaagcacagaggcaaacactggtgatgcctaacttagcaatagttagcaaaatgactttaaaaacaaccatccctctgaaaaggtattttatctcaagttacactgagtgagaagcgatgctttaaaattatccaaatcccttatttctgattttttgctcttttgtaataaagtttgccatggagtgctctacctaaatgaagaggacatgccagttaagctgacataaacatactaaattactttattgttattgctgttgtaaagtgaaaaattcagactccttgagcttgtttaaatagactactgtcagagaaatggatgtatactccaaatcaggaaacagaagctcaaagaagttcagtagcttgctcagggtcatttctgtaagtaaatgacagagccaggatgggaacccagattggtctgactctaaagcacaaactcttcttccctttacaccaaggatataacgaatctgtcagtacttgaaacaattccgaaagattcttactgacaaaaaatgattactttttagaaagatggaacataattcttgctaaagctttgacaaaaacaattcataattcctctaattcagaaaatactttgatttatgaatacacaaattcaagtgaacatacacacatacacaaaaataacataactaagcctagactgaacccccctgccactcttttttctaaacatttaccaggacatgaaagaaaaatagactaaaatctgtaaaaacattaagtaagatatcatcaattcattttccactgtactgaaagaaacaccaaccttattaatggcacatgcggtcttctcccggctggtgccactacttgtcctaatgatcttggatagatcttcacgagcagcaagtagatgtgccattgtaatcgttgtcttgggtgacaaagcataacgcttaggctgataaattcttgctatatcatctgtttttacctaaatgacaagagttaaggaaaaaaggaacaaaagtacattttaatgaaagagcaaaaacaatcataatctttagaaataaagaaaaggagataatgcataagcaaggagttagaaaagagcaaaaacacccaaatatctgagaatttatgaataatttagaacaaataaaatagaccaacaggtgttaaaaatatgtaactaccagcaacaactcgctaaaaaataataacaaaaaaatttctatacatattaacaaaaaatacctaaaaaatagttttaccaaaaccacatacaggacatttaaaagggaaacatcagtaaatcttgcaaaaacaaaaggaaaacttgtataaatggtaagaaataccaagtttctgtatgggaacattaagtattattgtcagttttcccccaaattaacttataatcctatataaatagtttttgagagaatgaaaaaaaaatctaaagttaaatccagaaactcaatatgtaagaataactaaaagcattttgaaatataatcctaccaaatactaatatgctataatacaaaattatcatcatcttatcagttaacatttaatgagaacttattaaatgtgccaggatgctgttcacttagtaaggcattatttctttaatcctcaaaatatccttttagagtggttggtttttattatccccttttgcagatggaaaaaaaaaatgaggcatagaaagcttaagttagtttccccaaaatatagagagaatcctagctctgcccacttagcaacaaaggtctacctgacccccaagcacaggtctagtatagataacagtttgctatcctacctccatctaattaactagaacttgggagaaaaaaacatagattgatgaaatagtatattgagactcagagcctcataaatctatgaatgcaataaatgataaaggagacatcacagatcaacgagaaaaggaaaggattatcttttaaatggtgctggaatgacctggtggctatctgtaataataacaataatacagcacaccatataacaaagggaattccaaagagaacaaaaagttaactgtttgaggtttaattttcaatttaaaaacaactacattataaaaattaaaatttctgtactttaaaagatataaaacaacatctaatgacaactggggaaaatattttcaacaaataattcaaccagcaaacttcctttctatataaaaacctcaaacacaaaaagaaaacagaattctacaggaaaaaaaaatgacaagacataaatagaagttaaaaagaggaaattcaaatgactaataagcttatgaaaacagttcaactttgtcaataataagaacagacaaaacaagttagtctttttaacatcaagttagcaataaagaggctaaagtgacacaacatttcatttaccttactggaaggagtttaaattcatataaa

SEQ ID NO: 1035 - DNA, 5021 bp, Homo sapiens
cccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctgggggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaaaaaaaaaaaaaaaaaaaaaaaaaaaaaaaaaaaaaaaaaaaaaaaaaaaaaaaaaaaaaaaaaaaaaaaaaa

SEQ ID NO: 1036 - DNA, 2394 bp, Homo sapiens
atgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctgggggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 1037 - DNA, 23169 bp, Mus musculus
  misc_feature (2418)..(3132): "n" at positions 2418 thru 3132 can be any base
  misc_feature (5952)..(6013): "n" at positions 5952 thru 6013 can be any base
  misc_feature (8299)..(8346): "n" at positions 8299 thru 8346 can be any base
  misc_feature (9379)..(10000): "n" at positions 9379 thru 10000 can be any base
  misc_feature (18821)..(18840): "n" at positions 18821 thru 18840 can be any base
  misc_feature (19910)..(19929): "n" at positions 19910 thru 19929 can be any base
  misc_feature (21696)..(22021): "n" at positions 21696 thru 22021 can be any base
  misc_feature (23090)..(23109): "n" at positions 23090 thru 23109 can be any base
taatgaaattctgaagcctacagactcttcctaggggagagaggaagtattcaacttggtagaaaataaatgatgggtgagggaacaggaggatgaaagggcctgatgaacaggtgagcgcctatgactccgtggggtggaggtgatgttctggattatctaacccaatctccctcataatgttgttccgggacaatcgaattcatccagaaggatcttgcccaaggtaggtaaaggggattcagagaaaacttttctatgctttggtgctatgagataggagagcaaagaaaaatcacgaagactttggtcagcaagccaaatgccacatttgagggtgtcttgtcctcaacccaattctaaagggacccttgtgttactgtgcccaagaagttggaatttcccccaggagtttcactttaggggaagaaaaagccttgagtcctggttccagccagagagggagcttgccttcagggaagtgattgtccagatctcacagagttcttgcaaattgatattacagcaccttgcaagagaaaatggagctgagacaatgctgcctcaaaggtgggtgggaaagaccaggactcttgtgtcacaaatacctgtttcctttcatttagtcctatacctgtctggacatcgaagatgaactgagggcctgggatggggaagggggtggggggtcattgaacccctttatatttgtttctctctctgatgtgatcacattgaatgcacctctgttttccaccattgattgctaggctgcatcattggtctattgaggacgagtagtcaactcttgcttgttaacggctgccttacaactatgattagaacgagcatttaaaatggtgttacggggctggagagatggctcagagttaagagtactgactgctcttccaggggtcctgagttgctctcccagaaaccacatggtggctcacaaccatctgtaatgggatctgtctggtgtgtctgaagacagctacagtgtactcatataaataaaaaaaaaaagaaattaaaaagaaaaaactttaaaaatacacattaaaaaaaaaaaagataaaatggtgttaccaccctttcccagtgcccttttccgatgatggcgctgcatggtgaaaagcttgagttagtacttgtagctatgctgtccaaggatccgctgcaatccgtgcaggtcttcggacacaagaagacagtcactgctgtggcccactgcaaatgaggaaacgggctcatcaacgtgaatggatgaagcctctaagaaggagatcaaagatagcctcattcagtatgatcggaccattcttgtagctgacctccagtcgctgcgaatccaaaaaggttggaggtcctggtgcccgtgcttgataccaaaaatcctaccaataagcccatcccaaggaccagggtttgtttacctctgtaatgcacatcctaggattttttttttaaatgacattaccgatacaacccctcagccacacactcacccttggctaaactctctcggtgctagctttgaaatttcctccagcctccaatggcaaaatacatgcacctagtttggtggggcacctcaaatattataaacttcattcggctgtggtggtcagcttgtgattcaaattcaactaccacctaatttgtctcatctcagcctctctgaacccttcagagagttcagtggcaggtagtcaggaagagtaacagcaaatctgggtaggaaaacatagacttaagggtagtttaggccgggcgtggtggcgcacacctttaatcccagcacttgggaggcagaggcaggtggatttctgagttcgaggccagcctggtctacagagcgagttccaggacagccagggctatacagagaaatcctgtcccgaaaaacagagagagagagagagagagagagagagagagagagagagagagagagaagagaagagaagagaagagagtcaccaccaccacccaatcccgaatgttattctaatcaaaacaaacaaaacagaacaagcaactttgggggagaatgggtttattttagctcacaagcgcacgttacagttcactctacggcagggaagtcaaggcagcaagaagttcaaagggctggtccatccacagtcaggagcagagggcgaatgaagtatactcgacattccgttcactgtttccactcgaatacagctcagaacccaatcccagagaacggtaccacccacagtggtcgaggtcttcccacatcaattgaggcagtcactcacagacatacccacaggccaacgtgacctagacaatctctcatcaagactctctgcccagatgattctaggttgtgtctagttgataattaatctcaccatcataggtattagagatagatgtaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatatatatatatatacatacacatatatatatacacacacttaaaaacaaataagcatacctcaaaatctagcaagcagcatagcctggcagcacagtgcagtgtagagtatctggtgtttatcctcaagactgtaaggcttactagagagtatagcttgctatctctgcccagggctgttgaaagagtaccatatgttgttggttctgagaaagtattattattggagggggtaggggtgtcactcatgctacagcatgcctgtgaaagtcaaaagacaattttgtggcagtcagttctcctcttccaccgtgcaggtcccagagaaccaactcagggtgctgtgcttggtagcaagtacctttatccaataagccatcctgctggcgtgtgtgtgtgtgtgtgtgtgtgtgtgtgtgtgtgtgtgtgtgtgtgtgtgtgtgtgttttggtggcattggttggggggggggggtgtatctttgttttgagataggattttgctacaccaccaaggcaagccttcaacttctatatgtaacctaggttggcctgattagttagctcaggctaataccaaatttgcatttctttagactcagccacaatagcactaggatcacaggcaacacaccctgcttgttgattggcactaacaagtcttacagtgtttttgctattgacaaccttgaagcagtacgtattcttggtgatttgtcttaatctctctctctctctctctttctctctctctctctccctccatccatccttccctctccctctctctgtccctctctctgtccctctctctgtccctctctctgtccctctctccctccctcctttcttccctcccttcacccagggtatgacttagtctgtaaaccactctagtctcaatttatgtaaatctaccttctttggcccccgatgttgagtgttgggattaaagatgaatgtcactaatggagtctcagtttggttgttgttgtggttatggttttggtgtggttttgtttttgtttgtttgtttgtttgtttgagacaggatcttgctaaagacaccacattagcctcaattttgtaaatcttcccaattctccctcccaagtgttgatgtttacagatatgctctgttatcttcaggagttttaaaaactattttacattgcacacttatttattttaaggactgggtgagatcataggacagctttaagcagatgattctctccttccactaaatgagacccagggatcaaactcaagttgccaggtttggccacaggttcctttacccactaaagacatttcagcagctcttgctttattatctctttttgggtgattctagaatggaattctttctacttttgggacagaagcagcagtggtgtatgaaagtgttcgtatctctcactctccagcctcaccaccgttttgaggcaatctgctagactgaattgttaatctccctgagatttaatttggattgtcccgagtcaggcgaagtagcccattttcttgttggtactcaatttgcatttcctgtttggcaaattgcctattcatatcctagagccagattcctctctggcttttctttacctccattcagtttctaggatcccttcctgcacgaggaatataacctttgcctctgagggccctcaggaagtgccatcccaaatatgacatttttgagagctgatgaactcaaggggcgacggagctggaaactgcaagtgtaggcttagctgtaccccttatctacataaagacatcctcccaaggcagctaggctgttctgaatctactctccagtttcttatctcccagtggagattacctccgtgacacccagccaaggtagactctccctgacctattctgtgggccgcttccagacagggttaataatacctgagactgtatcggtctgataaagtcagacctgctttccttccctcagctcccagaacgctaggcatcccgggacactgcatgagtctcagtcatttgaccgtccttcagacctcagatgtgtgaggctcccatccactgacatattgttcagtgtattttctactatgctaatctgtctgttttgatagttctactttttgcagtcaaatcttaaaagccaacctattttcatattttactttttttgtgcaatgcagaatataagttttcttttctcctcttcctcctctgtctttttttctttcatacaatacttcctcatcgtcctcccctatccccgactttttaaaaaaataaagtcaattaatctgcaggattttttttttttagtatgtatatgtgttgacctgtttgcctcagaatgcatgcagagatcagcaaacaacttgcaggagtcttttctccccttccaccacgtgcatggggcctcaggcagttagacatagaggaaagggtccttaccacctgagctagcttaccaactgggtcccagggattttttcaactattttaagcaaaaattacaagtcctttattttgttgggcctgggtcttgtggtatagtccaggatgacttcggactccctgcctcagcctcacgagggctggagtacagtaccacaagggactgtgcctttatttgggcaggagaaatttggactcagtaaaatagtcccagaagaaacccaaaagctggatgaggttgttggtctactaaccatgatggattaaatcctcctgggtttgtgtacctgtgagctgtctttatttatttcatttggtaaagaaagannnnnnnnnnnnnnnnnnnnnnnnnnnnnnnnnnnnnnnnnnnnnnnnnnnnnnnnnnnnnntaaccaggtcaccttctctctgtcccctcttttctgaaacatcttatcttttagcagagtgaagagcacaggtgtggagagagaactttatccataactaaccaggccatcttagccgactttcccagtcccctgctgcttgagggagttctagtaggctggtcaaagtgtcctttacgtgtccgctgctgaagttctgaggaagattctagaagccagatgtggtggcacagacctgtagtcccagagtttgggtaatggcaagaggatcaattcaaggtcatcctcctcaataaaaatagagttcaaggtcatcttggactatatgagacctcggctcaaaaaacaaacagaaacacctctccttcccctccccccccccccaaagcaacaacaaaaagagaaggttctgggagccacacctatctctcccccactgtgccactaataaacaaaactaacctgccagatctggctgtctaaaagggttcctttcaatggagcctacctccagcagcatccaggaacacttaccatacagcccctgctgtgtatgtataattacaatccgaggcaaagttttcagagagccagcatcttgagggagaattcagcgggaggtctcggtttggaagaggccaggggtgtgaaaatgagggtgttaaaggcttttgcaaaggtaatgggttttacatatgtgagcccaataagaaaggccttggaagggtggctcaccctcattcacggctacttcctagaacctgccgcagtccccagaattatgtaggcattcggggacagatgggaagactttcacacatgctaatacacattttgaccttgactctctaggcattctcttcttcctcgctggaggtgaatgaggggtgtcattttcaatttagagggaaatggagacgcttccccacaaacaagcttaagggtttaaggataaatcccaccctactgagaatgtgtgttgaaaaagggcttcacccagggacccaggttactcctggaaagttttgtggggcaagagcatttatttttagccccacatttaggaaacagaccttttagcatgcttgcctagacagaagtgagacgctgtgggatggggagggagggaaatgtgcccacggctgtgaggaaagaatacacgcaccctgctctagtctaaataagatgtcgcgctctctctgttcacgccacctcgtaagtgaggcaaatgggacacaaagaggccaaattaatgatggctttccttgatgtcaccatccgtaggaactcgaggtatacagagcagtcagtgatttgggcaaggaaagcagcggtccgtaattcaaccctggcttcggaaaggcttttgttgggaacggtgggcgcgactttaggggacgtccctccacgcgtttcacaatcccttccgcggtagcaaggattcgctaattgtctcgcgggggtggccccactcgggctccgaggctgggcggtgcggctccgctttctgcttggtctccgcgaggtgtcgccttcggccgaagaaagcggtaaggcgccaccctcgtagcccgcacttatttattttcaaacaaggggggcgccccttcctttcaatttgaaactagaaacctcctgcggtctcgtttctacgtgggcgcgtcctcggcctcccattttgcactcctgtgtcgccttccttcgagatcacacacgaacagcccctcgaccaggccttgttccactttagcctggagctcatctttcacacaaacacacactcgcgcgcagtccacgcagggactgggctagaaacctcttttcccattcccagaacacacccagcgacctttaaaaaaaaaaaaacacggagtgcagcgggtgcaagccagggggtccaaaagggagggggaagcactcctcgggtttcccagctttgctgcttgcagtctgaaaaacgagaggggggagggggagagagaggaggggaggagggggagaggagaagaggggaggagggaagggagagagagagagagagagagagagagagagagagagagagtcggaaaaaaaagagaaaagcaaatggcttttggcgcgaaaggctttggcgcctcccctgatttttatggaaatcaagagggcggggaaaagcctcttgcctctgcctttctccctccccctcgtctgcgccacagcccccttctctccccgccccccgggtgtgtcagattttttcagttaataatatcccccgagcttcaaagcgcagccagtgacagnnnnnnnnnnnnnnnnnnnnnnnnnnnnnnnnnnnnnnnnnnnnnnnncccgccgccgctccctcagcccacccggagaccccagccccgagtcgcctccggatccccggcagtctgcgggaggtaagaagcggtacttgcgaagcttcgagcgcccggggaacggcggagcgctgcggctaggcaagcccctggacgcggctccgcaccctgcacccaaatatgccgggcttttctgggggagggggtaagggggcaacacaccgcgtctgcttccgaaacaaaaccatctgggttttttgtttttttttttttcctgaaaagcctattcagcacccgaaggcaccctggctggaagagacccgccctaatcccttttacagccctggcccaggcagagaaatagctttagcgaaaagaaattcgcccggctccacaagatttgtctgagtgtgaggtgactgggaaccggtgcgtccccaccccaagctggggttctccaaaaggtgccgcggggaaagaaggaaaaggggttaggcgaagctaggtgcctgagtgataatgtaggtcacggctgctccggcttaggagacgcgattctcgccggcgaccctgcaccattcctagggatggggttcagcctttccccccgcctgttgaagaggttgaggtctctgaaggaaggggaatggaaagggtataggtataggcagcgatgagtaccaagggtatctgccaagattgaggctctaggtctaggtggagagggttgtatgtaattgcctgttgttggtctgactggagaaaggcccttaataattaataaagtttcctgaaccccgttagcgtttgcgctcccgtgatcgcatttctgcaaaaggggaatgaaaggtacttcaatcccatgcctggtagctgggctagagagcaaggacttcctttaagcaactagtgcaagtggggtagtcgcgctagtaagagctgagatctgcagcttgaacagcccccctcccccaggcagtgccttgtgtgaatgaaacggcagtttcccaaagttgcagagagccacaccaccccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgaattgggctacggagatgctgctgccggagccgacctgtggggcaacccgggcgaggaggatgcgttcggtctcgggggcctgggtggcctcactcctaatccggtcatccttcaggactgcatgtggagcggcttctctgcccgcgagaagctagagcgcgcagtgaacgaaaaactacagcacggccacgggcccccgggcgtcagctcagcctgctcggctcccggagtgggtgccagcagccccgggggccgtgcccttggtgggtcgtcgagtgctagccacaccggggccaccctgcctaccgacctctcccacccggctgccgaatgtgtggaccccgccgtggtcttccccttcccggtgaacaagcgagagtcggcgtcggtgcccgctgcccccactagcgccccggcgaccagcgctgcggtcactagtgtgtctgttccagctactgccccggtggctgctcctgctcgtgcaggcggccgtcctgccagcagtggggaggccaaggccctcagcacctccggagaggataccttgagcgactcaggtaaagcctagagtagagttcttgctagctccttacggactgggaaggtgggggtgctgcgttccctttgttatcatagatttgtgcgggtgattctcttctgttcaccagcctcccgggacagaagaggctggaaacaccagctacaccttctcttaaatttgccatcccctttttcgcgaatccttgcggtaggcatgccctcactgtggcaaaagttggtggccagctcagtcagtctgtggagtccaaaaaactacctgtacagaaatctgttagtccgttggaaaggaacctttaagccaggtcaaggaagggaaaagactccctgcaagacgagggctgcacaatcccacttgcaaaagttaagagaatgcctggcaattcctccctcccctcccctaggactctgagccctccgtgggtggtgggctgtttgcgtttggtgcgtggccagcaggcggcgttgtgtctgacgcaagacaggcaggatcaaaaagactgggggtgatgggggcaccccctccctccagttcagcagctggcagcaagtgcattagtggttgtgtacgttttcagagagcctctttccggttttgattgagtactagtcccgttgtgtttcctagctggaatttctgacctaattgagctgagttgtgttccataacccattgcccttgaaggttgagggcgggtccctaccactgccgctcctaaggaatgcacgcacccttaggattcattggttctattgtaagcctttatctgcgctgtcctcggaaagaaagggttaaaaagaagaagaagaaagctttttttttccatggggctgtgaaagtacctaccacactttacccaaatccagtctgcccttgtccttcgagctgtaggtccagcccccctattagaccttggaagccagtgttttcaaaatgccaaagaataaaaagtctaaatttcctcctgggctgtggagggatcgctctaaggctcctgggaggaaacttggtgataagcctgcactttgaaagggctctgtccctttaatgtctgtgccttgacagctttctgttaggaagcagttccttccaacagctgtcttcttggctgaaaaccaaaacactggcttaaagggacctaccggctggagcagcctaacatttcagccttagaagaagaaacctcacaattgttccgctttccggtcctccctagattaagcagacgatgtgttttggttttcgtgcttgcttttattttcttcttttaagccataattttctctcctagcctggcagtaaacgaagtcagaatgaatacacataggacgatacaggcttttttttttttttttctcgtgcaccgccccctttgggactctgagctactgtggattagagctttataattgagatctgatctctgcctagatgaaaaactgcttactccgtacaacgcatgttcgcaccaggaaaggttgttgtcgtagtgaatgagattgtcctagagttttaaggatggcagaatcaaacccagccatgggttttaccaaaggaggagcctccggtctgaagggcggctgtggaagtgtgtataagtaaatccatggggcagactggctggtgattatgctaaaagcccctattaccgagcatctgtcgccaagtctacatagtgtctgccaaactcaaacactgtggttattacccccattgaatagctgaggacactgaagagtttttccaggatcatgccgacaacggctcgttctgactccagttgggttcctcgagtttctgccacatcctcaagtttgtcaccaggggttgaatcctgggcccttccacatcagacaagtgccctgctggccccacaccacccagggaaggaaaggggtggggcgtacctcttgtccgcgttgtgatcagcaaacctagctgacttaaataacaagtgtatgttaatcgcacaattaaccagaaactatttttcccctcagatgatgaggatgacgaggaggaagatgaagaggaggaaatcgatgtggtcaccgtagagaagagacgttcctcctctaacaacaaggcggtaaccactttcacgatcactgtgcgtcccaagacctccgctctgggtctggggcgagcacagcctggcgagctgatcctcaagcgctgtgttcccatccatcagcagcacaactatgctgcaccctcaccctacgtggagagcgaggacgcgcccccgcagaaaaagatcaagagcgaggcttctccacgccccctcaaaagtgttgttccagcaaaagcgaagagcctgagcccccgaaactcagactcggaggacagcgagcgccgccgcaaccacaacatcctggagcgtcagcgccggaacgacctgcgctccagcttcctgacgctcagggaccatgtgcctgagctggtgaagaacgagaaggccgccaaggtggtcatcttgaaaaaggccaccgagtacgtgcacgccctacaggccaacgagcaccagctcctgctggaaaaggagaaactgcaggcgaggcagcagcagttgctaaagaagatcgaacacgctcggacttgctaaacgtttcccacacggacagtcactgccactttgcacattttgattttttttttttttaaacaaacattgtgttgacattaagaatgttggtttactttcaaattggtcccctgtcgagtctggatctgggtagggggcaggacacggggttctgccatgaccttggaaaaaaaactgacttatgggatgctgggtggcttgttttcctcctccatatcacctggtgacagccgtggaagttcgggacactaaggagcttcaggaggctgtgaagtcaccttgttccggtccaagattccaaacagagtcattccttctttttacaatggtgcttaagttccagcaaatgccacagaaggggggggttgccatttgatgcccctgggaacacttgtgtaaataccattgatacacccgccttttgtatacgtcctgggtaatgagaggtggctcttgcggccagtattagactggaagttcacacctaagtactgtaagaatacctcaatgtttgaggggcatgttttgtatacaaatatattgttaatctgttatgtactgtactaattcctacacggcctgtatactttagtatgacgctgatacataactaaatttgatacttatattttcgtatgaaaatgagttgtggaagttttgagtagatattactttatcactttttgaactaagaaacttttgtaaagaaattttactatatatatatattcctttttttcctagcctgtttcttccttgtttactgtatttgttcatgtttggtgcatagaactgggtaaaatggcaaagttctgtgtttaatttcttcaaaatgtatatatttagtgctgcaccttagagcactttgaaatacctcatgtttatgaaaataaatagcaattaaatgatgcaaggcgatgttttccttcctagcttggctgcagtctctgcacacagtccattccttacccggacttttaacattgtggaatcctggttagggagggtacttgtagagggataaatgggtttgtgaattccacagattagaaccaactactttcaataggcaatcaatgggtgttaaagctctttcaaatattttgttttgggtgtgagtgtgcccacaatgtcacatcccctgcaactggagttcaagtctaggaacaaggcagaggccctgcgcaacagtaacaagtgactcacccctgagccatctgtcaccccttcatttttgaggcctctttgggtctctagctgggattataggtgtgtgccccccatatctagttaccaaaacactttcacatactcgaactctcaaagcattttagatagtgtagataccagcccaaagtttggaataagcagtaaaattggcaagttgtgccgaaatttacataaacacttgtcctagttgtttggaaggacttgttcctgaagattcccccaggaagagctaggtgtggaagcatatctgatgcctgcagaggtgacaagaaaaatgtcacctagccctcttagcacagcaagcttctatattgcaagcccaaggccgcagagtaacacttagtccaaaagaaatctaggaccagtataatattctggactgagcactagtgaaataagaggatggagtcactgttcatcattgatctcggtcaccagcctcagctccagttcccagagtactgaagaccaagaaggggaaggagagctgtcattgggtggactgtgggggtgcctcaaggaagaatgagctacagaccttggagaaggccagaactaaacatgaaggaggcttccctctatctactcagggaaaattttctggaagtctgaagaccatctaccttacttaagaacaggacttctatttttctttggggtaacagactacacacagcatttccctatggtttcattcactgcaggtttttaacttcaagttgaaaaaaaaaatgtcttcatggaaaaatgcagcccaagggtccagacagctttgcttgtgtggctgtactgtcagggacagagatcaggctgcgcaggtggttggccagacaggtagaaggtgagccatggaggtccttatttggggtgacagctacagatgctgtcttaacagttgctgttgggttggtggtactgcctgcattctctggtgatttgacaaaggttggaaagtgggcaaaatgccctttacaaaatcctataactccccagtcccaaactagcaaataataagccactctgaaggtcccattcaaaagaactcatctgttgcatcttgcaagtcctacgtaacaagcccatcactgtatcagtacatctagaaaccaaatggaacttaaagatctcaggttaattgagcacctaagagtgttgaagcctgccgcagtcaactgaattgctctgtttctcttctcccaaaggggacctgaagtgtgacagatgagctagaattctactgtgtaagaagaaatagaacagagaccactgaactgaaatttctaccacattcttattttggtgactacggggaaacttgtagataatgctctcttacatctccaggacccacttctgcctcgaaagctctgttactctcttgacatcaatcacataacaacaacaaactctctgcattcggtggatcataaataaaagaacatatattgctcttccagtggatctgagttcaattcccagcacccaagttaggtggctaagctgcttgtaactaaggcaccagggatttgacatctctagactcctgtgacttacactcgcatagatacacacacacaatttaaataaatacatttaaaataaataaaaacacactaaaaactgttaacacttaggttaagacacacttttgtttcctcatctagctggaggaaagtgttcctactgtaactctgcagttctctgtacaataattggaaaagagaagaatccaagcagttgtctgaaaaacacaagactgagatactcacagaaagaaactctttcttaaaagagtaaactggcacttctgtggagtgttccaccatctctcaatcacttcctctcacagaatgcaggtggggtgtccctggactaacttggggcacaggactgacattgaggcctcgtgatcagcctggtggtatctcgcaggactcctgtaacctataggctggcctccacctcaatatgtagctgaggatggtctgagctcctggtcctccgacctccacattctggatactggctaacaaagtgagccaatatacctatgcatgtattatgtaagtgctggggatagaatccagggttttgtgcatgataagcaagcacttcctgagctatgtcacgtacccttgctgatggaattccctggctctttcctctcaaccaatgttattaacataggaactaacatttgtcaggtgtttctggtgcttgggagaaatcaatgaagaacagcaacaacaacaaaaaaaaaacaaaattgccaactgcacccaattcttgtctccttgtggtttataatctaggagacaatgggagtaagaatataaataagcaaagcaagccaacaaatagcaccaatgaggtagtgagtaatttataaaagaagtggactggtatagaggaattcaagattgccaccagaggggatggggagccaggccagtgcagatgcacctggtccttggacctgtggaggaaaacgcaaggtgactgacagggctgctcagccaccagagcaagctgctcaggttctccatttagtccgtctcccctcctcacaccctggacatgcgtgttccctactatgtcctttgcctatctgctgaaagcgaagcatcaaactatgatgcagctgcagtctgattccctgggactgagtcccacagttaacacagttcctcatattgtggtgacccccagccataaaagcatttttgttgctacttcataactatgattttgctactgttatgaatcgtagtgtaaatatctgatatgcaagatatctgatatgaaaccccagtgaaagggctgttcaaccccacaactgtttccacccacagactgagagtctctgctacagagaaaggtgtgtgtgtgtgggggggggggggttatttggtatcgacagaattgttcctttgtttcctctgtatttttctaggaaaaaaggactatttagaaaaatgagcagtaaagcaaatatataagcctgacctcaatgagaactctgcagacttttgttacccccaaaaggctttataaaacctaaaaaacgggcgctttggaaaagagtaaaggtaagctctgaagcctattttaagacagagacagatcctaggaacctgagttccacggaccatctatgctttctacaatggtttattagttctccttacttgtaaaggaaatcccttcataggcgactgaccaaggccacctgatctctcttgatactgacaggtcatactacaagacatccatcctgaaacctttgaccagaagtaacagagccttgtttatagtggaagcatggcgactggctgggacagtgcatatttggggaacacacacacacacacacagcctaggctgcttagatgtgaaacgtaggtgattggcgggagcatgtgtgcactgagcggcagcgtccagtggactttcctctgctatctagcaggccagagatttttttcaggccttaagggctaacagatctttttttaaggattatttttatttttattcctgtgtgtgtctgtgtacccaaatgtaccttcagatgccagaagaaggtatcagatctccagcaactgagttagaggtagttgtgagccactcagtgtgggggttgggaatcaaatccaggtccccaggaagagcaacaaaggctcttaactgttgagccctccatttatgccataatctttttaagttattcattcatttattcattcgtcactcagtggggggggggggggtgcatgccacagtgcatgtaggtatagaggtcagagggacaacctgagggagtcagctctttatttccagaccagctgggccttaggagagatctttggccatcaggctcaagggcaagagcctgttttttttttttttcgatgagccaaccatgtcaatggcccctgttagagaatctttgagaggcaggaaagcaagtagaggtcttctctaaagtttttctgaagtgagaaagagagtcagagatagacacacacacacacacacacacacacacacacggagagacagagagacagagacagagattcaatactgagagttgaacccagactttcacacatgctggacaagtgttgactaccacttagctacaccccaagctctccttttgccttgtattttgagacagggtcttaccaagttgtcaggctgggcttgcactccctctgtagctcagatagtccttgaccatgttgtccccctgtctcaggccctgtatagctggggttgcagacctgacccaccaggtctgtgtatttcgtgtgtctttgttttgtgtcttaggctccctttcatgagatgataggacgaggtgacactgagcgttgcctgggagacagactttgtgggccagcaaccagccttgannnnnnnnnnnnnnnnnnnnacctccctgttggctgtgaatatgtttccactgacacctttgggaggtgatttctccaggagtgcgacctcacttggtaattcgcctgggtaacaaaggtaccaggcctgtctgtcactgttgcccaacttcccactgaccctccggagtggaggctgctgctgccctgtaccctcaccaccccaccgtcaggtgcatagctgctgattctggttgagcaaccccagagtattgtttcttgggtattgtgatgaatcacaaagcaaaacaaggctggggaaaggaagtagtacttagtccaagttcaaagtaagctgctttcattggaggcagtgactacagagagcaggctaactgaggtagaaaacaccagacagcgcttggatgacttaacagttaagagcacagactgctcttgtagaggagccaagtatggctcccagcacacacactcaaggggatggctcacgactgcctaaaacttcagttccagggggctgacgccctcttctggctttcataggcatctacattcaagtgcacacacacacacacacttaaaaataaaatagaactcttaagccagggctacacagagaaaccctgtctcgaaaaacaaaacaaaacaaaacaaaacaaaacaaatctcttttactggtgttctttttccttctattatccagggtgactgaccaacccatcttggctttcaaactaaaggacctggatcctagggaacattgaggtccccttactctgccctgccactcctccccccccccccccccgacagtgtttgcttcttcattgtgcatcataaattgtacagccaccttctgcaggtcaaccaactctgccttctttgagggtcagccaaatgatagggaaaggagtgattggcccacgccaggccagactgggaggaacatggacttggggttggatagcccatagataagagatctggaaaccttccaagggtaataaaaggagagaaatctattttccttttcagagacattgaatgtgaagctggtgggtctcacataaatgtcagggaccaatttaannnnnnnnnnnnnnnnnnnnttaggctccctttcatgagatgataggacgaggtgacactgagcgttgcctgggagacagactttgtgggccagcaaccagccttgactcctctcgcttgctcaccttcttactctccggccaggaaagtttgtatcagttccccatctgtgagcagaacaggctggagctggtgagctcagagacaggtgcagcttgcagtcactcatcctgaggaagggctgcagccttcagcatccccacaagatgccaagcacggtgacacacgcttttaatcccagcactgagaagggaaagcctagcctggtctacatagcaagtttcaggatagctagggctacatatagagaacctgtcttaaaaataaaagatgactaaaagagctagggatgtagatcaagtggtaatttgtctggagtgcagcaaatataaacgccatattgtggtgcactcaggaaatcctacatgtaggcagaggatcaggcgttcaaggccatccttgcctacacagcaaaatgaagtcagcctggactatatatttcaaaacaaaaacaaacaaaaaccaactcagatgtcgtcagtgctggtaaacagtggcactgtggttggaaacttgggaacctatcagctctctgctggtcaccttctccagaactgtcgtcattcagtgcatccatccctctgatgcacgctgtcttccagcctaaaagcgggagctggggatgtttttcatctgtggagtgtggaagctagcttgcaggagggcctgggttcaatccccagtgttgcaaatgtaaaataagaatcacagctgcaaggttcttgcaaggatcaagtcataaaccactggagggatgtgacaaactttggaaacatgagcgccatccatgaggtcttactgctgcccggactcagaccacacttgagcagcctccctccagtctacagactgccatctagattcgaccctcagggtgtttccccaggcaacaaactcctttccttgtgtagcaggcttcctctggttgatcccttgtacctagaatagggctttgcttggcagtctagatgttattttcatagggaaaacctggctattttcttcaagccagctagagccatgattcctgcaaacgaactgggtactctggctggtctctgctgaaactagagagaagtatgattaatccattgttgaaattggttactcaaatgaaaacagaacatggtaacagacatttcataccttgagtctttgcttgggttatgctagtcacttctttttggcacaaaacaagaaagaacaagggctttaaaccaagagtagatacaagtttgctcttttcttttttccagagcaactgagctatagtaaagaaaaagaaaccccccaaagagtgggaaagcacgaaggaaagaacaccccaggtttaactgcatgggttgaaaaaaaattctttatcacctggcatggtggtgcatctctacattcccagcactcggaagaagcagaggattgttcagactgactggtccaggtacggtctaggccaggtggggctactatatactgagactttgtctccaacaaaacaaaataagaaaggaaatctttcccaccctgtggtgggtcctacttctgaattttctttctttctttctttctttctttctttctttctttctttctttcttgcttgcttgcttgcttgcttgcttgcttgctttcttgcttccatccttccatccttccttccttcctgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttttttttttttttttttaatttgttttttttgacaaggccttgctatgtagccccaactagcttagtactatgtaaacaaggctggttggaactcacagcgattgttctacatcagcttcccaaagggctggaattacaggcatgagccaccaccttctattttattgctcatgttctgcccgcctccctccaccctccttctttggacagggtttttactcagcagccctggctagctcaaagagacacacatgtctttgcctccatgttttggaatgagaggcttatggaggcacactcagccttctgctagcatcctctagcttcctctagtctcctccttctttcagtctttgtacgctgccaaaagaaacggttgtccgatgaaagagcacaaagcaagctgaaaggaggtgagggaaacacgtaaaataaaatgctcccccagttcctagggaaaattgagccctacttagtaagaaaagctgcagattcaggtacctggatgtgggtcaggaccttgatgctctaggattataccatctcccaggaatcttcctggggcttcctgtggtggctttccacggtctcaggatgagaccacctgggcataagccagttgtgggtggaggggctgcattcctcagaacttgaagatggatcccttcacaaaaagaagaggatggaagaaagtagaccttccaggagcctttagcatgggtattcacatggatttaacttggggacaaacctgcggttaacttggttagcaactgcttgtaaatgggagaatccttattccaggggctggtgcacatgggggaaaaagacagagcagtccatggcctcctgaagggaatggttctatcatgttaatgctctgcatcttattacagtcaggacaaagggcctggagtttgggactgagagtttgttttggagtcttttaatatggagatgactctccctaaggggaaggaagaggaccctggagtcaacccacaaacttgtcttggcatggtggtggtggggtgttgagactcaccacaggtgcggtgccccnnnnnnnnnnnnnnnnnnnnaaatggaaacaaggactttggtgctactgatgtctgtctctctgcctatctcttggtgtt

SEQ ID NO: 1038 - DNA, 7340 bp, Mus musculus
  misc_feature (172)..(172): "n" at position 172 can be any base
  misc_feature (2306)..(2325): "n" at positions 2306 thru 2325 can be any base
  misc_feature (4127)..(4127): "n" at position 4127 can be any base
  misc_feature (4696)..(4696): "n" at position 4696 can be any base
gaattcagtgggaggtcccggtttggaagaggctaggggtgtgaaaatgagggtgttaaaggtttttgtaaaggtaatgggttttatacatatgtgagcccaataagaaaggccttggaagggtggctaccctcattcacggctactccatagaacctgccgtagtccccantatgtaggcattcggggatagatgggaagactttcacacatgctaatacacattttgaccttgactacacaggcattacactattacttactggaggtgaatgaggggtgtatttaatccagagggaaatggagacgctcaacataaataagcttaagggtttaaggataaatcccaccctactgagaatgtgtgttgaaaaagggcttcacctagggacctaggttactcttggaaagttttgtggggcaagagcatttatttttagccccacatttaggaaacagaccttttagcatgcttgcctagacagaagtgagacgctgtgggatggggagggagggaaatgtgcccacggctgttgaggaaagaatacacgcaccctgctctagtctaaataagatgtcgcgctctctctgttcacgccacctcgtaagtgaggcaaatgggacacaaagaggccaaattaatgacggctttccttgatgtcaccatccgtagaactcgaggtatacagagcagtcagtgatttgggcaaggaaagcagcggtccgtaattcaaccttggcttcggaaaggcttttgttgggaacggtgggcgcgactttaggggacgtccctccacgcgtttcacaatcccttccgcggtagcaaggattcgctaattgtctcgcgggggtggccccactcgggctccgaggctgggcggtgcggctccgctttctgcttggtctccgcgaggtgtcgccttcggcgaagaaagcggtaaggcgccaccctcgtagcccgcacttatttattttcaaacaaggggggcgccccttcctttcaatttgaaactagaaacctctgcggtctcgtttctacgtgggcgcgtcctcggcctcccattttgcactcctgtgtcgccttccttcgagatcacacacgaacagcccctcgaccaggccttgttccactttagcctagagctcgtccccacacaacacacactcgcgcgcagtccacgcagggactgggcctagaaacctcttttcccattcccagaacacacccagcgacctttgacctttaaaaaaaaaaaaacacggagtgcagcgggtgcaagccagggggtccaaaagggagggggaagcgctcctcgggtttcccagctttgctgcttgcagtctgaaaaacgagaggggggagggggagagagggagggacggagggggagaggagaagaggggaggagggaggggagagagagagagagagagagagagagagagagtcggaaaaaaaagagaaaagcaaatggcttttggcgcgaaaggctttggcgcctcccctgatttttatggaaatcaagagggcggggaaaagcctcttgcctctgcctttctccctccccctcgtctgcgccacagcccccttctcccccgccccccgggtgtgtcagattttttcagttaataatatcccccgagcttcaaagcgcagccagtgacagtcatctgtctggacgcgctgggtggatgcggggggctcctgggaataagcgcgcacacactgcagccgccggaggacaaccccctcccgccgccgctccctcagcccacccggagaccccagccccgagcccctccggatccccggcagtctgcgggaggtaagaagcggtacttgcgaagcccgagcgcccggggaacggcggaggccctgcggctaggcaagcccttggacgcggctccgcaccctgcacccaaatatgccgggcttttctgggggagggggtaagggggcaacacaccgcgtctgcttccgaaacaaaaccatctgggttgggtttttgttttttttttcctgaaaagcctattcagcacccgaaggcaccctagctggaagagacccgccctaatcccttttacagccctagcccaacagagaaatagctttagcgaaaagaaattcgcccggctccacaagatttgtctgagtgtgaggtgactgggaaccggtgcgtccccaccccaagctggggttctccaaaaggtgccgcggggaaagaaggaaaaggggttaggcgaagcttaggtaggtgcctgagtgataatgtaggtcacggctgctccggcttgagagacgcgannnnnnnnnnnnnnnnnnnntctccaaaggttgaggtctctgaaggaaggggaatggaaagggtataggtacaggcagtgatgagtaccaagggtatctgccaagactgaggctctaggtctaggtggagagggttgatagtaattgcctgttgttggtctgactggagaaaggcccttaataattaataaaatttcctgaaccccgttagcgtttgcgctcccgtgatcgcatttctgcaaaaggggaatgaaaggtacttcaatcccatgcctagtagctgggctagagagcaaggacttcctttaagcaactagtgcaagtggggtagtcgcgctagtaagagctgagatctgcagcttgaatagccccccctcccctaggcagtgccttgtgtgaatgaaacggcagtttccaaagttgcagagagccacaccaccccctgcatctgcaagccccctcccactcccagtcctagacagcttgtacacaaaaggagggagtaggggagacgctcaactttctcccaccttccagagctgtggggagcttgcagaagagattgggggctcccactgcctgtccccaccaacccacccctttggctcattctctcttggtttgcctattggttgtagagttggaggttggcgcgactctgctgctctccacggggaggaagcactcccccatattaaaaagagcggagatattaaaaagagaggcgaacccatgcccagctgcaccgcgtccaccatgccggggatgatctgcaagaacccagacctcgagtttgactcactgcagccctgcctccacccggacgaagatgacttccacttcggcggtcccgactcgaccccaccgggggaggacatctggaagaagtttgagctgctgcccacgcccccgttgtcgcccagccgcgccttcccagagcacagcccggagccttcgaattgggctacggagatgctgctgccggaggccgacctgtggggcaacccggccgaggaggatgcgttcggtctcgggggcctgggtggcctcactcctaatccggtcatccttcaggactgcatgtggagcggcttctctgcccgcgagaagctagagcgcgcagtgaacgaaaaactacagcacggccacgggcccccgggcgtcagctcagcctgctcggctcccggagtgggtgccagcagccccgggggccgtgcccttggtgggtcgtcgagtgctagccacaccggggccaccctgcctaccgacctctcccacccggctgccgaatgtgtggaccccgccgtggtcttccccttcccggtgaacaagcgagagtcggcgtcggtgcccgctgcccccactagcgccccggcgaccagcgctgcggtcactagtgtgtctgttccagctactgccccggtggctgctcctgctcgtgcaggcggccgtcctgccagcagtggggggaccaaggccctcagcacctccggagaggataccttgagcgactcaggtaaagcctagagtagagttcttgctagctccttacggactgggaaggtgggggtgctgcgttccctttgttatcatagatttgtgcgggtgattctcttcagttcaccagcctcccgggacagaagaggctggaaacaccagctacaccttctcttaaatttgccatcccctttttcgcgaatccttgcggtaggcatgccctcactgtggcaaaagttggtggccagctcagtcagtctgtggagtccaaaaaactacctgtacggaaatctgttagtccgttggaaaggaacctttaagccangtcaaggaagggaaaagactccctgcaagcgagggctgcagaatcccacttgcaaaagttaagagaatgccttgcaattcctccctcccctccccttggttcagcagctgtcagcaagtgcattagtggttgtgtacgttttcagagagcctctttccggttttgattgagtactagtcccgttgtgtttcctagctggaatttctgacctaattgagctgagttgtgttccataacccattgcccttgaaggtcgagggcgggtccctaccactgccgctcctaaggaatgcacgcacccttaggattcattggttctattgtaagcctttatctgcgctgtcctcggaagaaagggttaaaaagaagaagaagaaagctttttttttccatggccatggggctgtgaaagtgcctaccacactttacccaaatccagtctgcccttgtccttcgagctgtaggtccagcccccctattagaccttggaagccagtgttttcaaaatgccaaagaataaaaagtctaaatttcctcctggactgtggagggatcgctcaaggctcctnggaggaaacttggtgataagcctgcactttgaaagggctctgtccctttaatgtctgtgccttgacagctttctgttaggaagcagttccttccggcagctgtcttcttggctgaaaaccaaaacactggcttaaagggacctaccggctggagcagcctaacatttcattcagccttagaagaagaaacctcacaattgttccgctttccggtcctccctagattaagcagacgatgtgttttggttttgctgcttgcttttattttcttcttttaagccataattttctctcctagcctagcagtaaacgaagtcagaatgaatacacataggacgatacaggcttttttttttttttttctcgtgcaccgccccctttgggactctgagctactgtggattagagctttgtggttgagatctggtctctgcctagatgaaaactgcttactccgtacaacgcatgttcgcacgaggaaaggttgttgtcgtagtgaatgagattgtcctagagttttaaggatggcagaatcaaacccagccatgggttttaccaaaggaggacctccggtctgaagggcggctgtggaagtgtgtataagtaaatccatggggcagactggctggtgattatgctaaaagcccctattaccgagcatctgtcgccaagtctacatagtgtctgccaaactcaaacactgtggttattacccccatttaatagctgaggacactgaagagtttttccaggatcatccgacaacggctcgttctgactccagttgggttcctcgatcgagtttctgccacatcctcaagtttgtcaccaggggttgaatcctgggcccttccacatcagacaagtgccctgctggccccacaccacccagggaaggaaaggggtggggcgtacctcttgtccgcgttgtgatcagcaaacctagctgacttaaataacaagtgtatgttaatcgcacaattaaccagaaactatttttcccctcagatgatgaggatgacgaggaggaagatgaagaggaggaaatcgatgtggtcaccgtagagaagagacgttcctcctctaacaacaaggctgtaaccactttcacgatcactgtgcgtcccaagacctccgctctgggtctggggcgagcacagcttggcgagctgatcctcaagcgctgtgttcccatccatcagcagcacaactatgctgcaccctcaccctacgtggagagcgaggacgcgcccccgcagaaaaagatcaagagcgaggcttctccacgccccctcaaaagtgttgttccagcaaaagcgaagagcctgagcccccgaaactcagactcggaggacagcgagcgccgccgcaaccacaacatcctggagcgtcagcgccggaacgacctgcgctccagcttcctgacgctcagggaccatgtgcctgagctggtgaagaacgagaaggccgccaaggtggtcatcttgaaaaaggccaccgagtacgtgcacgccctacaggccaacgagcaccagctcctgctggaaaaggagaaactgcaggcgaggcagcagcagttgctaaagaagatcgaacacgctcggacttgctaaacgtttcccacacggacagtcactgccactttgcacattttgatttttttttttttaaacaaacattgtgttgacattaagaatgttggtttactttcaaattggtcccctgtcgagtctggatctgggtagggggcaggacacggggttctgccatgaccttggaaaaaaaactgactcacgggatgctgggtggcttgttttcctcctccatatcacctggtgacagccgtggaagttcgggacactaaggagcttcaggaggctgtgaagtcaccttgttccggtccaagattccaaacagagtcattccttctttttacaatggtgcttaagttccagcaaatgccacagaagggggggttgccatttgatgcccttgggaacacttgtgaaataccattgatacacccgcctttgtatacgtctggggtaatgagaggtggctcttgcggccagtattagactggagttcacacctaagtactgtaagaatacctcaatgtttgagggggatgttttgtatacaaaatatattgttaatctgttatgtactgtactaattcctcacggcctgtatacttttgtatgcgctgatacataactaaatttgatacttatattttcgtatgaaattgagttgtggaagttttgaggtagatattactttacactttttaactataaacttttgtaataaattttactatatatatatattcctttttttcctagcctgtttcttccttgtttactgtatttgttcatgtttggtgacattaactgtgtaaaatgtcaaagttctgtgtttaatttcttcaaaatgtatatatttagtgctgcaccttatgagcactttgaatacctcatgtttataaaataaatagcaattaaataatgcaaggttgatgttttccttcctagtttggctgcagtctctgcacacagtccattccttacccggacttttaacattgtggaatcctagttggtgagggtacttgtggaaggatagatgggtttgtgaattc

SEQ ID NO: 1039 - DNA, 1389 bp, Mus musculus
atgcccagctgcaccgcgtccaccatgccggggatgatctgcaagaacccagacctcgagtttgactcactgcagccctgcttctacccggacgaagatgacttctacttcggcggtcccgactcgaccccaccgggggaggacatctggaagaagtttgagctgctgcccacgcccccgttgtcgcccagccgcgccttcccagagcacagcccggagccttcgaattgggctacggagatgctgctgccggaggccgacctgtggggcaacccggccgaggaggatgcgttcggtctcgggggcctgggtggcctcactcctaatccggtcatccttcaggactgcatgtggagcggcttctctgcccgtgagaagctagagcgcgcagtgaacgaaaaactacagcacggccacgggcccccgggcgtcagctcagcctgctcggctcccggagtgggtgccagcagccccgggggccgtgcccttggtgggtcgtcgagtgctagccacaccggggccaccctgcctaccgacctctcccacccggctgccgaatgtgtggaccccgccgtggtcttccccttcccggtgaacaagcgagagtcggcgtcggtgcccgctgcccccactagcgccccggcgaccagcgctgcggtcactagtgtgtctgttccagctactgccccggtggctgctcctgctcgtgcaggcggccgtcctgccagcagtggggaggccaaggccctcagcacctccggagaggataccttgagcgactcagatgatgaggatgacgaggaggaagatgaagaggaggaaatcgatgtggtcaccgtagagaagagacgttcctcctctaacaacaaggcggtaaccactttcacgatcactgtgcgtcccaagacctccgctctgggtctggggcgagcacagcctggcgagctgatcctcaagcgctgtgttcccatccatcagcagcacaactatgctgcaccctcaccctacgtggagagcgaggacgcgcccccgcagaaaaagatcaagagcgaggcttctccacgccccctcaaaagtgttgttccagcaaaagcgaagagcctgagcccccgaaactcagactcggaggacagcgagcgccgccgcaaccacaacatcctggagcgtgagcgccggaacgacctgcgctccagcttcctgacgctcagggaccatgtgcctgagctggtgaagaacgagaaggccgccaaggtggtcatcttgaaaaaggccaccgagtacgtgcacgccctacaggccaacgagcaccagctcctgctggaaaaggagaaactgcaggcgaggcagcagcagttgctaaagaagatcgaacacgctcggacttgctaa

SEQ ID NO: 1040 - DNA, 24009 bp, Homo sapiens
tacagatatctttcccttatggaataaaagcagggatagggctcattattccgatattatgaaccaggagaagttaatggaccgatctaaaattcctcaagaagtaagacacaattctaagcttgaagaactccagtcctctccccgggtgaccctgtgttcttactaggactaccttatactaccttgactctgcagtaccttctttcaagcctaaagttacttgattacggacaagccatgaagagtaaaggggtgtggcccagagagatttccagttgaagaaagaatgattcaacagtcccattaaaacaaagagacattttctgcaggctcccccaggacacacatgctatggtctattgctgcggggtacatggagcccctgcaggagggctgggactagaaggaagggagggaacgtttactggacatccattataagccagatggctactttgtgtaatcctcacatgatactaaaagaaagatgaaaaaatggccgggtgtggtggctcatgcctgtcatctcagcactttgggaggccgaggcggatggatcacttgaggccaggagtttgagaccagccaagccaacatggtgaagccccttttctactaaaaatacaaaaaaaaaaattagctgggcacggtggctcgagcctgtaatcccagctacttacgatgctaaggcacaagaatcgcttgaacccggtaggcgggggttgcagtgagccgagatggtgccactgcactccagcctgggcaacagagtgagattctctcaaaaaaaagaaaaaaaagaaagaaagcaagaaagatggagaaataaagcctcagaaaagttggactatccaacatagcagaactcgctgtcatgtctggtgtcagagctgttctttccagcattcgctgcaccagatgctgtagaagatggaaaggcaacatgggaaagggtgctgcactcaggaactgctcatcctgttaggggagtcgcacacacacacaggaatctgataaagaacccccatggccgggcacggtgactcacacctgtaatcccagctctttgagaggccgaggcgtgaggtcgcctgaggtcaggagttcgagacaagcctgtccaacatggagaaagctaaaaatacaaaaattagccgggcgtggtggcacgcacctgtattcccagctactcaggaggctgaggcacgagaatcgcttgaacctgggaggaggaggttgcagtgagcagagactgcaccactgcactgcagcctgggagacaagagttaaaaataataataaaaattaaaaaagaacccccttgttggcggcaagcagtataagattaatggagatttggggcagagaatgggtagggttaggggaagggaggacgagattccttccaggacagtctccagctgaactttgaggaaagaatttgaataagcagaaatgaaaggaaaagcctttctaggccagaagtagcagcttctggaaatgagcagatagaatcactgatatttatcagtgattgttatctgagtccaaggaaactgaaagggccagcaggcagattctagcaattccactcagatattgaggtagctcgggccgtccatggggctacaggaatgtatccagcattataggaaaatgaaattagcaagaatcagtgggtgagatcagccatctactaagtaatcacctgaggagaagatctgaaaacttcagcacagcgcgaggtgatctggacacatccaaagcacgtcattgtgtctggaaagtaatcccagaaaaaggagacccctgtccttcgtagagagcctgcctgtttcaaggggcagcgccaaatggactcaaaggccagatctggcatcagaattccttgtagcccttacagattcctactaagatgaggatcccctaattgtgagccattccagtgcactgacaaattcaagtttgaggcccacaaggggaaacctatttctccccaaaccccatacctgtggagcctggccctgagcagctgcctccagggacatctttcccattttgacttttagcataaggaaactaagggaaatgagaattccaactccacagcagcagtatcaccgtccattccccgtagctcttcatggtttgcagtgcattttgactcactccatcttagccctctctcaagtctacgtaatgcatgaagctggagggaagtcttcacagtggaaggggtctttgagctgcctccaaggatgcaaaactagtctctgagggcagtccagggtctgctggacacttcgattttctaaatcagtaatcaaattactggcattaaatgaagataatttttgttttaaacctaattatgctattacaaataaaacttcccacctccaaaactctctcagtggtggatctcaaactctcctccagcctcagatgtcaaaaaactatgcattttgccttgggcacatccaacatcatatacgttgaatggctttgatgggcatgattctaatcttaattaaagcagtgcccgttttggtccatcttggtctctttgaacccactctcagctgactcagttcaatagcagtttggtgggaaaaatgccaactggcctgggaaacaaaggagaaatttgggggtgactttaggcttcacaaaagggtcccttacatcacttgaaatgattaactttactgaaaagtaacaaaattatttttgaaaaataacaaaaacaaagaaattaaatttgttcataaccccattgctttaaaaaaaaaaaaaaagttataggccaggcacagtggctcacgcctgtaatcctagcactttgggaggcggaggtgggtggatcacttgaggtcaggggctcgaaaccagcctggccaacacggtgaaaccctgtctctactaaaaatacaaaagttagcctggtgtggtggcatgtgcctgtaattccagctaccagggaggctgaggcaggagaatcacttgaaccagggaggtggaggctgcagtgagccgagaccgtgccattgcactccagcccgggcaataaggcgagaccccatctcaaaaaaaaaaaaaaaaattaattaggcatagtggcgggtgcctataatctcagctactggggaggctgaggcacaagaatcacttgaacccgggaggcagaggttgcagtgagccgggatcacgccactgcactccagcctggatgacagagcgaaactgtctcaaaaaaaataaaataaataaataaaagttatatcaagaagaaagtttctccctccacctgactgattgtcttcttcaaagtaaacccctgttagcaacttggtgcacattcttctcaatttgttactggggggttgatgcagatatatctaagtacatatatatccaaaatgccagacagattgacctataccttgcttattttccttcatgttcaggaacatttcccgtctgtaactatagacctaacacattatttttagtgggtgtatgtaattccactgcatggatgtattacataccattctcctgtttaatttgttttagttatggatatttagattgcttatagtatttttgttattgagaatgatgcagccacacacattcttgtttatatgcttttatgtgtttgtcttattatttctcgtaggatggatcatgaagagtggaattgcttttcctcttggggcaggcacaccaacagtgtatgtgaggcccctgctcccactccccaggctggccagtactttgggccaatctgctagacccaaaaatgttaatctcactgagatttaatttgcattcccctgactaccggtgaagttgagcatcttttcatatgtttattgacaatttgcatttcttattcagtaaattacctgctcgtatcctagagtcatatttctgtctgcccctttttttctattcaatttgtgggagctctttgtatacctgggatctaatctttgactcatatatatggcaagtattttctattactgttgtcaactttttatcatagtaaaattcttacatccagcacccccacccctcccctgcccttttttttttttttttgcatttgggttaggcagagagctagctttactgttttccaaatgaagtcaatcgatcccaaggatttttaaattatttaatcagtaaaaatgtacacattttgagggaggtgtgaagatcctaggagaaactgtgctcttgtccctgaagacagactcagtagatcttttttttttttcttttgagacaaggtctcactctgtcatccaggctggagtgcagtggtgtgatgatggcacactgcagccttgatctccctgggctcaggtgatcttcctgcctcagcctcccaagtagctgggaccacaggcacgcacccaccacgcccagctaatttttatattttttgtagagacagggtttcaccatgttgcccaggccggtctcaaaatcctgggctcaagccatctgccctcctcagactcttgaagtgccaggattacaggcgtgagccaccatgcctggccaacccagcagatctttaattcacaatctggaaaaaccatctagaggctgttgctctcctagccagtcatgatttgggcccttctcaacatgtgtatgtgtgtgttgtttctttgtgtgtgtgtgtcttagtaaagaggagatttgtaaactaaaatattctcctctctcaaaaatcaccttaattataaaccaaatgctgtgtataactctatcctagcagttggtgattagattgaggcatccatttcagatgtgggtctccttccctggtccacagtgagctccttgcggctgtaccttaacttacctctgttccaaacccacccaggggctcagacacagtaatagatgggtacttgtctcagttcattttgtgttgctataacctaatagcacagactgggtaacttataaagaaaagaaatgtatttctcatgtttctggaggctgagaagtccaatatcaaggtgccagcaattgctgagggccttcatggtgtaccatcccctggcaggaaaaaggaagagagggcaagagatcaaactcctagcctcaagcccttttataattagcattaatccattcacaagagtggagccctcatgacctaaacacctcacattaggtcctgagacaggaataatataaggtggctgcagaataatagaagattttgggcagcaatttcacatgactagcaaaaggaaactgttgaaatggctgcagaggccatgggctaagaccgtgaaaaacagagtgtagaccaagctggctaagacccactgaacccagcatggcactggatttgacctaggtttctcctaggacctcattatacgctcattaacatactaaatcacacaccccactagcatcatgacacttccgagaacacccatatttggtttaaaaataggtggtgtcacagttctgagaaatctcctcctttttctaggaatgatcatgaatattccgcctcttggttaaagaaacccgtaaaggtagcaaccccaaaccccctttcgtgtgagtctctcgagtacacccatattcccttttcttgagtgtgtacttttccctttgcaataaatcgtactttcactattttccaactggtctttgaattcattctcttgatggtgtcaagagcctggacactggctggggtctaggtcccactggcatttggggacctcccctccaacactgttgcactgggggttaaacttccaacgtgtttttttttggaggacacattcaaaccatggcagtactgaacaaaaccttggctttgaaaccatatgaagatttgttttgtgtgtgttcacatagttgaagtatttcaacatttttaagagggattttcaggcttctctataagcagactaagaatcagcattagcatgttttctccatgtacaaagtcttttatctttctacttacaaatgaaggtaaccaataaatatttgttgaattttatcattctgttaaccttcagattcagacttgtcagtaattactggcttgcattaaaagcaggagattagagattgaggtccaggaagtataaatgatttgctcaaaggcatgtagagtaaccaggtctcctgtccctctgtcccccttttctgctacaccttgtccctcgacaaagggtgaatgacctagtgatggtcattcatctgaggagaaaggacaaaggtaggactttgaatcggagcaactgaacccatcctggcctattttcacagtcttgccacagaagatctggccaccttagaaggactcattcagtgatcttggtcttgaataataccatgagtacttactatatacaggtacactgctgtgccgtaaggattccctctggagcaaaactgacccaggtcacaggttagtgagggagactgagcctgtcttccacagtgtcacggaagtgagcactaaacaaatactcccaggcatggatcattacaaatggaggtgagtgctggacaggaaaggacaggatgctaggcgagaattcagcaggagggcttggtggcgattagggggctagggaaaagcagaagtggggctgtaaaaggcttttgcaaagatgaaggcttttacatttgtgagggaaataacaataataaaggtgcttggaagggctgctcatccgcattcatgggcctcttcctagaactctgggaatctttctccctagagctctgtaggcgtccagggtcagggctggaaaggccttcacaaatgctaatctgtgagcattttatgggttgccccctgaccctcagcatcctcctccttaactagatccaatggtgaggtgaagaggtgggggcgatggagaatggcatttccagtttggagaaaaaagtagggagaggcggggaagccttcccaccccaatcccagggccaggttcccctctctccaaacaagcctaaggaatgtttttcaaggcaaaatcccacctcactgtgtatttggttgtgaagggggctgtccaggagatcagggttgtttttggagagtttggagggcaggggcaataatgtctgaccccctgcaaacaaatacacctgtaagaaaagctagaccagagtgaagtaaagccaggatttgatggtggcgggaagggaaggggccaatgctgctgctggacagaggggtgttattttccccagaagaatagcatgtcgtggtcatcatcataataatagctgacacaactattatgggctggggacttataagagctttcataactctcaggtaggaggcactacgaactccatttcacaattgaggaaactgaggcacaaagaaacgaagtagtgacagcagctttcctttttcccttcaacagtttggaatcaagctgtttgagccgaggctgggtctcaggaggtgtggacagcacttccatctcggtaaatcagattcgcctgcccataattggggagaatggtggctttgaaaaggttaacttgggagccctggggacggctgcagggaacgtacgcccattccccctaggaagcagagccaggccgcctcctcctccgcagtggtgaggacgcgtggacagtcccgcgggggcggcgggagacctgcggagtggccgcactccaggtccgcgccaaggccgggcagctccgctttctgctcagtctccgcgaggtgtcgccttcggccgaagaaaccaccgcggcgccaccctcgtagctcgcacttatttatttatttattttcaaacaaggggggcgcccctcttctttcaatttgaaactggaaacatccagaggtcttgttcctaagggggcgcgtcctctccctgctattttgcaccttcggactagccttctttcgtaattacacaggagcaacctccctgcaaggccttgctcaacgttggcctcgcgctcagctgcacaacacgcagtcaaagcgggggctgggttagaagcatcggtctcccctccccaacacacacccccggagccctccgtaatttttttttcttttaatgacaagcaattgccaggctcgcagggtgggtgctgcattgcaccgctccgcgcgcagctggttctcagagtgcagccggtgcaagcccgggggtccaaaagggcgggaggagcacaccctgggcttcccagctttgcagccttctctctgcaaagaaaagcaagtggcttttggcgcgaaagccttggcgcctcccctgatttttatggaaatcaggagggcggggtaaagccgctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgaccctcctcgcgcgggcgcccctgccattcccgggaacaggggctcagcctctccctccctggaagaggacgttgtcgtgggtttggaagagcaggggtgggcttagagagcttccaattaagctattggcaggagtatccctgcagcgggtgaatgccgaggggcgtttgctcaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggcagagaggtcctgtttcccccaagtctctcctcggggtaaagagaaggggctgagagaatgccgttgcaaaaggggtgctctccaattctcgccttcactaaagttccttccaccctctcctggggagccctcctctaggccatcacgggccctcacccggtcccccacctctcttttgcagcgcagtctgaggaataaaattggagaaagttggtggctaaaccgggtgggggtttagggggttgctgggtgcactgcctggacagaaacctgttagcgcaggggtgaaagggactctctggcccaggtcaggggagggaaagacatcccgagaagattcaagggctgtgcaaagccctgtttaaggcgcaggaacttataggagggttgcacagatggctagagccgattttctattctttttctttttctttttttttttttttcaaatgtcggtacctttcccttcccccatcctcggtgggtggtgggctatttgctcctggtgcgtggccagcaggcggcgatatgcgaggccagcaggcgggcccgggatctgaaaggctgggggtggtgggggcaccctccctccctccattcagcagctggctgcaagtgcaacagcagttgtgtacattctcagggggcctcctctttccagtgtgcagtggaaactggctgtagttttgtcttccagcctgaattccaggcctaatttgagatgtgagttgtatctgtaacccagtgcccttgaaggtgagggcaggcactcagcagcctctccaggaaggctcacatcctgggaggactcactgattagttctattgtgttcatttgtctgtgtcttaagctgaagggaagagttaaaaccaagcctttccctgggggtctggatgaacagaactcaacccaaagagtggcattgccttgtccttggagcagggagctgggaccccccttggactttgaaaaccagtgttttcagaatgcaggtggataacaagcctaaatttacttctgggctgaggagagatctttgaggctcctggaaggaaacttggtgataagcctccagtttgaaacggctctgtccctttaatgtctgtgccttgacagcttttggtgaggaagcacttccttccaacagctgtcttcttggcagaaaaccaaaacattggcttaaagggacccacagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttgggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagccaggattctgtctgaccctaaaggccaagttctttatatttatttctaccacctgctaaagtcttgaatggaggctgaaagcacagttggggtatggggaagaaaaatatatatacatacatatatgtatatgtatgtatgtatgtatggggggttgttttgtttttgtttttgataaggagttttgctcttgttgcccaggctggagtgcagtggtatgatctgggctcactgcaacctccgcctcccgggttcaagtcattctcctgcctcagcctcccgagtagctgggattaccggagcatgccaccacacccagcaaagttttgtatttttagtagagacagggtttcaccatgttggccaggctgatcttgaactcctcatctcaggtgatctgcccgcctccgcttcccaaagtgctgggattacaggtgtgagtcaccgcgtccggcctacagatatatttaatttaaagagatctaaaacaaatacaaaactgtccacatctatgttgatggacccataaaaatagcagtctgccagggtctgccggaagagacagataagcatacatattaacatggatatatatgtgaatttcattcaaatggttctcacatgagagtaactagcatctttctctcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgtcccttaaggagcaaccataaataatccataacctatagagggaatttggtttccgtaaatagccctttttgcacctgtacaatcctggttggggggcatgagtcattgtccccacttaaggtggagggaactgagtttggggaaattaaggcagttctccaagattatgcagaatagagatgttattagcgactattgtgtgcattgtagcaatggcatttgataatttacagagcacttctgtatactgtggctccttagtggaattaagctgagacctcagatcagtccctttaaaagaaaagtaaaaatagccacagggttgtttaactcgcttgtattgggctttggtagtattcgtcccattggcagacagtcttctattttaaggtagagcatagtttgtctccaagaattcattgttaaaaacattcactaggatctgtggaggttctaggctaagcagagtaagcagaataaacagatggaaatgggttcctcccttcaatgaactcaacctgattcaccaaagtgtaattcacgagtgacagttacgtagtccagagcaagtaccaggtgcaggagagaccctggggtcacaatggagaccccatatgggtggcatggctctctacttgccattcctattacacagcagtgtcttggctacttgggctgccctttggaaatgggatcaatcttgcaggctccagaagacagagccaagacttgtgtgttaaggagatagtttacctgttgggacataagagccttgcttgtaagcagcttctcagaactaaaagtgtacaaataacctatttctcttttgagtgtcaggttgtactcggttatttctctagggttttgttcatctcagatttttaactgtgagccgaaaaaaaagaaaaaggccttttgcttcactgagaagaaagcaggtccagagatgagacagctttgcttgcctggacacacagtttgtcaggggcagagatgggagacaccaagccatgtgtccttgtctgctttggtcatttttatttgtttcttttgagatggagtctcactctggtgcccaggctagagtgcagtggtgcaatctcggctcactgcaacttccgcctcccgggttcaagcgattctcctgcctcagcctcctgagtagctgggactacaggtgtgtgccaccatgcccggctaattttttgcagttttagtagagaccaagtttcaccatgttagccaggatggtctcgatctcctgaccttgtgatccacctacctcgacctcccaaagttctggaattgcaggcgtgaaccaccatgcccagccgctttggtcattttataaaggcaagtaggagtttagaactcagtcctccttatcctgcttatcgcacacccttgagatacgaggttggtgatactaccatggacatctttctgatggtctcgccatgtagaaaataagataaaatgccctttaattctcctagtccccatccccagactaaaaaataatgcaccctttctttttgaattgtcattcaaaaaacttccgttcgtttgcattttacaggccccaaatcactcacggcctctgcccctgtgtgtgtgcaagagccaaaagaaagttaagcaacctcacattaattgtgtacctaagattcttgaagcccagctcagtcatcccagtttctctatttgtgattaccataaggaacctacctgagtgtgtccaatgaaatggaatgcttaaccgtgaagaaagaaaactgttcatatgaatgaggccactaaactacaattcctactatgctctctttttgctcgggctgctgggaagctcagagccaaattccaccccctctaacatctccagtggtcattctcttctaaatgtttacggtttcttgttttccattgttaggttagtcatctttttaatgtatataatgtagtatataacatgaaacgtttttgcattaggtggaccacaaatatgcacctaaaggattaaaactaaagtgaaaaaatcccatatttgccttttctgacctagctgagggaatgtcaccaaatttagctctgcaattatctataaagtaattgctgtagtcacagaagaattgaactagttgtttcaataacatgagaaaccatctctgcattccaagagcagttttgagactgggaaagagctctacatcatttagttcaataaacgatagagctgagacgaagcacagagatcatctcattgaaattcatttctcagaatgagggtgcgggatcccacctggaattaatggcttaacccagggagactagagccggtgtctcctatgacccgcccagtgcccttccccataacattcactttctcattgcccacactgtagcctccccacctcctggcctgcccgtccacctacatcatgcttccatattaacccttctaaaccacctactctttatgcaaacttccaacagttccctactatttacagaatcgagtcccgactctccagcccagcacagaggcacttctacccagtcccaccagctccattgcccatggccctccatgtgctggactctggctgtttctcatccgtgacttgtttcaccacatccctccttctaggttacccagattccattaattgaaatccttctcaatcttgcacccccaggtaggcctttcccagcccttggcctctgtgcacttatcttctagctgccttatgcacctcctggaccccctaaactgtgggctcccttaaggcagatagggctctcatttgcctctgattctgagcatctgccctgtgactgacaggtgacagagccttagcagatgccagcagtatagacggtaacagaggaaggagcgaggagaggatttccattatgggtgggtctcccaccaactccagttcacaagctctcaggctaattcagatgggaaaagacatcccttagacatcaatgagtgtctggtactgactatgctggcagttctgaagaagtgaagataaaatgctcatagaggactgtctacaaggagcccacagtctgcaagagagttaaagccctgggggttgtatagaaggcaagaagagaaaccaagaggcactgggttgaggggctgatgaatgaaagcatatgaggggcctagtggctgagtttggggctatctgaaggaggaagctggtcctctgcctgggttcactgagtctacgcctggcctggcttgtggcagctcagacacttgcctcaggccacagatggtctacactcgtagtgaaaaaggttgcaatgcctcccacccctgtgtagcactgcagagcttcccaagtttttgtatgcatgagtctcaaaaatccttgaggatttttgaccagtttatcacattcccacattataagtgagggaatctggtcttctgagttttagtttcattaatccctatggtggctatgttttgaaattctgatgtgagttgttttcgaaatcagaggttgtttgatttggaagaggcatagaagccaactagtttactctcccatttcaggggaggcacctacagtctgcttgtgagaattttatttttcctttattttatttttcttttttttgcaacagggtcttgccgtgttgcctagcctggcgtggagtggctaatctcaggcacagtgccactgctgatcagcacaggagttttgacctgctccatttctgacctgggccagccagttcatacttccttaggaaacctggtggtcccctactcccaggagttgccatattgatgctaaacttagtgtggacatccagtaggcatagggtgctacagctcagaacttctggactcaagtgatcctcctgcatcagcttcctgagtaactcggacaacaggtgcacacacactgccgtgcctggaagcgttcttttttctttttttctttccctctttcccattctttctctcaacaaatatttatttaacagttaccatgtatcaagcactgttctaagtgcttgggagacatcaatgaacaaaaaagacaaaactctcccaaatcttctctgctttcttgaagtttatagtgtaacagagagtgacagctgtacaaataaacataataagcaaataaattaaacagcatctaatatggtggcaaatgccgtaaaaaataagtagaaaggctagaggaattcagggatgccaacagcagaggtaggaggctcagggaaggcgcatctggtcctgggagctgaggggcagggcctgtggggagagtgtcctgccctgggcactcttgtgcttgctcagaaaccagatctcaggcctcaagcttctcggttcagtgcttaacttcccttatctctggctgggcgtggtggctcacgcctgtaatcccagcactttgggaagccaaggcaagtggatcgcaaggtcaggggtttgagatcagcctgaccaacatggtgaaaccccatctctactaaaaatacaaaaattagctgggcatggtggctggtgcctgtaatcccagctactcaggaggctgaggcaggagaattgcttgaacctgggagacggaggttgtagtgagccgagatcacaccactgcactccagcctgggtgatagagcgagactccgtctcaaaaaataataataaaaaataaaaaatcttcccttatctccctctggacattggtaaatgtaccccaccaatttccattcattgtctcgaggagaaaccattgagcatagtagttaagagtatgaatctgggctgggcatggtggctcatgcctgtaatcccagtactttgggaggccaaggcaggtggatcacctgaggtcaggagttcaagaccagcctgaccaacatgatgaaaccccatctctactaaaaatacaaaaaaattagccaggtgtggttgcgggcacctgtaatcccagctactcgggaggctaaggcaggagaattgcttaaacccaggaggcggaggttgcagtaggccaagagcgcgccattgcactgcaccctgggtgacagagcaaaactccgtctcaaaacaaagagtatgaatctgaagttaagactccctgggtttggccgggtgcggtggctcacgcctgtaatctcagcactttgggaggccgaggcagggagatcacctgaggttgggagttcaagaccagcctgaccaacatggagaaaccccgtctctactaaaaatacaaaattagccaggtgtggtggctcatgcctgtaatcccagctactcaggaggctgaggcaggagaattgcttgaacccggaaggcagaagttgcggtgagccaagatcatgccattgcacgccagcctgggcaacaagagtaaaactccatctcaaagaaaaaaaaaaaaagttaaagactccctgggcttgaatttgattcccaaactcacaggctctgggttgtgcagctccccaactggtacaacgaggggataacactgggattattagcgggttggcatcattattattaatatgttttaaaatggtctcactctgattgcccagattggagtgcagtggcctgatctcggctcactgcagcctcgacctcctgggctcaggcgtttctcccacatcagcctcccaagtagctgagactacaggcgcatactaccatacccaacaaattttttccatttttagtggaatggggttttactgtgttgcccaggctggtctcgaactcctgacttcaagtgatcctcctacctttgcctcccaaagtgctgggatgacagacacaagccactgcaccccgccttcaattgatttatatacagcacatagaatagtgtctggcatgtgacaggtgtggtttaagcctgctcaataatatgatttgatgttgatggggtctttcctctctctatttcctcagtatgttaccagggcaaagaacctttagaaaaaaacatttaccggtagaacaaattcacaagcctgagtttaacaagaactttgcagacttttgttcctcaaaagaggccttacaaaacctgaaaacgggtaccttggaaacaaatgaatgtgagctttgaagcctattttaagacggagcctaggaatttgagtgccgcagaacatctacgccttctacaatggtttattagttttccttacttgtaaaggaaatctcttcataggccactgaccagggttacctgatctcttttgatattggtgtatcaagctacaagacattcatcctgaaacctttgaccaggagaggtaacagagcctttttatggtcgaagcacacagacctattggtacaatgcacgtttggagagcacacacagcacaaactcctctgatagctacagacaatttgcaatgggatttgctcggaagaggcaacacaaaatcaacttttctctgcattccagtgggcctgagattctcagcagacctttgaggtagggtgggggaaacaggcccactctttcacaaagcttgacatcagttgaattttgtgtgttcttgttttgtggctcaggctatcttcagccatcttcctgagagaggacaaaagagcagtccctccactggaaaaatgttgttccaggttcactgggaggcaatcctgagtcacagaaacacttagtttggaagaagcccctggattgggtcttagatcagttattgactattttcaaccttgaaataggaaagtaacttcttgttgctcagtttccttgtctataagtagaatgggctgaagtcagtgatctctggggctccctgtcaactttgaggatccagagtcattggtcctttgcaatggctgcagctttaaaggtggctgcaagactgcagtgtctgtcaacaccctctggttggaagatgtgccctgtcaagttcatatgatggaaatttaatccccaatgcaatagtgttgggaggtgggtactaataagagatgatcagatcatgagggctccgccctctcaaatggattaatgtgcttactgggggagtggattagtgaccttgaaaccgccattacaaaattgtaactgagacagtgaaagagctgacctaaccaactccatcttgtttctaacctccaagctgtccttgttctttgctgggcgtaggctgaactaactttgggaggaacttagtttgtagattagccctttcccaaaacaaacctccttcttgcctggggactagactgcctttgtgggactaacaccagccacaagattagaaattatggtttaggagccatgcagctggaggctacaagattccgaccctccctaaactgctcctaagatcagtgcttgagatattctgcagaccctgcacttgatgatcagctggcaccacccagattgataaactggctcatctgatcctgtggcccccacctaggaactgactcagcacaagatgatagcttcgactccctatgatttcatctctgaccaattagcactcctggctcactgaattccccacactcaccaagttgtccttaaaaactctgatccccaaatgcttgaggagactgatttgagtaataagaaagctctggtctcccgcacagctggctctgcatgaattactctttctctattgcaatttccctgtctttataaattggctgtgtctaaacagcagacaaggtgaacccactgggtggttacaacctcaggagtgagtgggcttattatgaaagcgagttaagcagcctttctctctctctctctcttgcatcctcttcctcttccacctcaagctatggagtgacacagtaagaaggcccttgccaggtgcaggtctcccgaccttggatttctcagtctccagaactgtaagaaataaatttcttggccgggcgcggtggctcacgcctgtaatcctaccactttgggaggctgagacaggtggatcacctgtggtcgggaattcatgaccagcctgaccaacatggagaaaccccgtctctactaaaactacaaaattagctgggagtgatggtgcatgcctgtaatcccagctactcaggaggctgaggcaggagaatcgcttgaaaccgggaggcggaggttgcggcgagctgagatcgcgccattgcactccagcctaggcaacaagagcgaaactccgtcccaaaaaaagaaataaaaataaaaataaaaaataaaaataaataaatttctttcctttataaattacccagtccgtgtcattctattacaacagcagggaagagactcagataggagccctggggcatatcttggctctgcaattcaccaactccatggctgagggtcagtcacttccctctgaatctcactgtctctctctaaaacaacaagaataatcaccacctcaccaggttctcataaggaccaaatgacgtataggagggaggtgctagcacttgaagatggggcaatcttttaagaaccctcattgccctcgatattgacacattcagcccttgtccagcacggcccacccattccactgttttgctttctggattcatctctaagtgggtttccccaggtgggaaactcctttaaagacaattagcatacctctgggtgctcccctctacctagaacacggctatgctcataatagctgcttcataatgtttgttaaataatgacaaccaatgaaaagacttgactgattgttcaaagccagatagagagactcaatgtgtgcagacaaactggttacacaggcttgtctcatctggaactatggaaaactatgattaatctggtttttaatttggttacttgaatgaaatagaatatggcaacagacatgtaacaccctgagtttttgcttgggttggtttagccacttttctttggcataaagccaggaagaacaaggaatttaaactagagatttgaaaccaaggaagctttagttagatgcatctttgttggtaaagagggcagaattgagacctgagtttattattataaatagc

SEQ ID NO: 1041 - DNA, 2440 bp, Homo sapiens
ctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaatt

SEQ ID NO: 1042 - DNA, 1371 bp, Homo sapiens
atgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcgtccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctag

SEQ ID NO: 1043 - DNA, 47098 bp, Mus musculus
  misc_feature (1)..(2265): "n" at positions 1 thru 2265 can be any base
  misc_feature (3596)..(3722): "n" at positions 3596 thru 3722 can be any base
  misc_feature (8341)..(8429): "n" at positions 8341 thru 8429 can be any base
  misc_feature (11699)..(12095): "n" at positions 11699 thru 12095 can be any base
  misc_feature (15548)..(15567): "n" at positions 15548 thru 15567 can be any base
  misc_feature (28136)..(29283): "n" at positions 28136 thru 29283 can be any base
  misc_feature (32385)..(32404): "n" at positions 32385 thru 32404 can be any base
  misc_feature (40354)..(40373): "n" at positions 40354 thru 40373 can be any base
  misc_feature (43523)..(43982): "n" at positions 43523 thru 43982 can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccaaacctctttgtttgatggcatctgtttacagtagttacactttaatatcaacctgtttcctcctcctccttctcctccttctcctcctcctcctcggtgacctccttctcctcccctttctccggagaaacttcgccccggcggtgcggagcgccgctgcgcagccgggggagggacgcaggcaaggccggagggcagcgggaggcggcaaccggttgcggtcccccggggctcttggcggagccccggcccgccttcgccatggcccggagaccccgaacacaggtaatggggaggctgagagggcggcctcgggctagggcgcgcggggatccaggcatcccggagcaggtgggaatgccttccctgttggtttgcggggctgtcagccagtggcagaagacactcgggagaaggatgaatggaaaactctgcgagaagcgcacgggtatagtgggaagcatgccctgaggctcttttttattttatttccctttttctttcttttttctttttctttttgcaagttgctcggggattcgtttctctttggggggtggggtggggggggggctcggcactcttcagccgaggactgaacggttccatcagacccgaggagcccaccaggtgtttggcttgatgccccgagtgtcggcgagggagtcgcagcctaattgctgcatgcattgaggtgtgtttgcacttgaagagcatatggcagatatagggaaaggccgggttgtttagtagctgcaggtagttcatttaaatttcattcattcattatggaggcgagagaggtgtcagctgacaggcaggcagctgcaaagattttagggggacaaaatgggtttgcagattgttttaaacccagccgtttgaagattcttgtacttgttatggaagaagcttttgcaaacactgcacgcgcccgcgtcgcacatgtcaccgcaccggccgagatgatgcgtgcactctctttccattttggccccaccttcgggaagagggatcctctcggaactgtcagttgctggcgctcaagtccggcccgactcggggtttcccgaggacacgccggggctcccagagagcaacagatgcggggcttagctcggtggcggtcgccactcggcgcaaagtgctggaggcaggcggcacccaaggcagctgcagtgcaccccgggcgatgtcgccgctcttctcctgggccgcgcacacgtggaagcagctgaggtcgccgctgctcccagcactctgctccagctgcttttggtggcccgcctctggcaaagccaccgaccgaccgaccctaaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaattggggagaccttgaatcttggctcccagtgcctggccccgggcctgccgcgccagcctaagtgccaccctttaagaggtttcgcctttcgcttttgggacctaaaccgcccgcacccaggtcacctgttctgcagaaagctgaaacctgcagcaggaggagggagttaggaaggggtgctcccaggaggtgcggcccaagctggccgccccaaggttcagtcggggcgtggccgcgcaggttccctggggctcgcaggtagcccggagcggaggcggcagggaggggcgggagccttgaacttgactcagggggaagagaaacccggctgcgggctcggagccgtttcttgcagggctagcgtcaactcggcagggattattaaccaggtcagcgaaatgactctgaaccccttttctagaatcacgtagcggccacaggcacttcctccggtccccctccctcttcccaaccccccagtgttctttttcgtttctttgcacggtttgtttccttgatagaatgtaacattcatagttgtactcttgtaaccacaccggctctcgcaggtggagcagtcgagagcatctagcttgaaatcagcctttgaaagtcctttgactgttgggtctgagatcttgtcggagcagataaaggaaaagttatttcgggtcctttgtcgaaattaatcatgctaccgaggcgaccaggtcattttagagcaaggaaatggcatgcagagctcagaggcaagccccttgtcaaagctgacagaatcctggactcgcccagctccctctcacagcctttcaagatctgcaagagtcacacgccacatttcaccccaagactttggctttgcacatctgcccagggcttgctttttaagaggcacagaagacagtagaggcatgcctctggaaagtaccttaaacatagaatcccctccctagtgtgtaagatgggatccacgagagggaggggggtttgtccaaatcaaacgactaggtgcgtggacaactagggctgttagaactttgctcctagaccccctggtcctgtgtgatcccagttctccctcacctgactattgactgccccctgtgggcgactgagggtgatgcttgtttttagattaagttttgaccagaggaaaatttgcttggaaaatgtccacaatgctgaaagtgacacctccagatctggacaagcctaacaggcgaatctaatgagagttaaatcggtggctccactctcaggtcccgttggctttcttggtatccctgatacttcacaaagggatgtttcatcctgagagctttccaagttccttaacaaaagggaattgtcacccaaagaggctggtttgcagttccggcctcataactctttttcccttcacaacaccatgttttataaaatcgtaattattactgcacagaagttatttgccgcctcctgtttactgttggaaataaaactgcttttggttgaaaggatttacactaagtggaaaaatatattgcagatcatgaataaagtttcctgggattttttttttctttttggtggtgttattttaacgttagatcacatcctgtcaccatgaagcctgagccatcagtttgaggctcagaataatattttagatgatgaaaatcccaatgtttggtaaacactttggcttaacttttagggggccagaaatatacatttagtgagttcgtctggaaagacaaatcctattatgaatgtaagtttgccttttaaaaataattttcattatgatgttgtcttatatcatcttgctggttcgataggtttttcagttttacaacagtgagtttgttaagtggagttgttaagtgtaaaattcttcacattttaagtcttatagagtgataacaaaaactaaactgcagaattactctgttctgtatatgattgatgagtttggagttccttcagctgccatcaaaattcacactgttactcaacccggtaaaagaaaaggctgttttgaaaacagtctttttttttttttaacctgtagatttcatctgggggaaccccttggtttttaattagatacattgtaaggtattttagactccatgcactcagagacagagaaaacaagagtaagtaggagtctgaatagccagtgccctggccatgtgcttagttactcaggagacagcactgtaaacacaagcacagcttaggtagagtagacacgggcgggcagcgtttgaatgatttgcaatttatgttaatcacaaaacagtttgagggatgtctcctttaccaggtcttgaaaatcttcctgatttttttttcccctagtgccatggtctttaagaggtgatcacaactatactttggaatgtattctgtcttggtttttttattttatcagactaccagtactcttgagacacacttgattggtctgttgtgttcagaaactatttaaatgatttgctatttgctatatgccagagttggagtgtgtatttatagcaaggacatgggctcttgttcttctcattgtccttaacattgacttttaaactcaagcatcaattggttgggagtttgccagatgtgtaacttgtcactgatctaacagtaacaggttcaaacatgcagagcaatagaaaaatgccagggctcttggtgtctctgtggatactagtaacagcaaaaccagtttacaaacactacagcaccagaatgcagaaaacctcattgcgcaactgtgcaaggttttgtttctgtagacttttaacaagcttgctgaagcgtttctgtctgagtttcataatccaatagtttagatcctctgcctttggcccatgtgtgtccattcttatttctgcagcatctacagtagcgatgaagatgatgaagacattgagatgtgtgaccatgactacgatgggctgctgcccaaatctggaaagcgtcacttggggaaaactaggtggacaagggaagaggtaactagtcattttatcaaaacgtagggaaactctgtagagtctgtgattggtgaaaactgaaatctcggctaagctacatgtgcccttctgaagactcttgaagaggttatcttggcatgctgtacagaatgctcgtgttcttctctcccagtgtttattctgctttctgttcccaacctgtttattgttccttaaatgctttctcctttttcctttccactttgcctgtctggttctcattctggaacctcaccattccctacacattgccttttctgtgaaactgttactggccaccatctttaaggctggatgcaccctcccgtggtcccaacccccctgggcacatgcttggctttattggtgttgttacatatttgtctttcccaacacactgccaattccttgagggttaggactaaagtatctcttcatctttgtgttcctcaaactcaaaattacttgctaaaatgtaggatagtaatgaatgttctctggctaaagtgatgctttgctattttctaagctaaagtagccgtagaatttattgtgttgtaatatgctcagtgaacattcgttacacatgatagtcacatgacctatgtatgtgaaagattattctgaagagatccagtaataggagaagatatgcccacttctttctagagcaaaaatcatcaaagtatgaagaaaggtttcttccttctctactgaactgtgaccttgattgcatgctaaaatcaaagctcctgagaacaggtggaagcactcccagggaggcacttagggaatgcacgttctgtctgtctgtcctgctcaggcccgtggatgctcccttggagtgtgaacttctgttgttaaccatggattcccagactctgtctgttttgtcattatgtgtgaatgcagaaacctatgaagactgtgtttacaaaggtgtgcatgagctagcatgtagatgagcgtatgtgctgatggagccagcttgggaatgtctagctagtgtcttctgtgttctcatccataaactctgaacatattgatgcagatccttaatggctttactgcatgaagtacaccttcaagtcaaatgtgtcaaatatcttcttctttgcatatggagaaggttgaaccaatgggaagctgtctcatccatggtcttatctttctcagggttgaacggtgactaagtttaacgttggaattcattttcccccatttagtaagagtgttaacagttaccatctattaaacactaacacatgcccggcttcactgctttacataatggtattgtgtaatctccagataacaatgttgatactaccattcctatcttatagatgacaatagaaatctgtttatataactactcaacagctgtgtcaaagtaaaagctttagtgtgcctgtgagtaaatgtatgcccagaccagtatattacattaatattggctttatttgagtggttttgaaagctcccccccacccccgatcatgaggttggttccttttttcattaaacttagacagagctgttcagtaaacaagtgatgcctaggattgtctttacacaccttaggatgagaagctgaagaagctggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcgaatggaaaaatctcatctggatttaagaaattattggatagtttactaaaatactatgtatttgctcatatagagttaagaggaagagagccatccgtaatttttatatctgactacacaacatataattgaggtttctagagttactatccagagattttgattttttttttcaacaattgcttcttgttttgttttaaaataccctgatagtgtaagttaacattctgatgggttgttccaggataaaattttaaacttggtattccctccaagttagcttctaaattctcctattctcatcaacagccacatttttggtgtgtgggtttaaaaatctagagcgtcttttgtcttatagcctcccaggtccatctcaatgatgagtcgggagcgcagaatttctttacagtccttctcttccacttctttcctatggtctggtcacagggcagctgccctgccctctctatcatagtggcttccttcttggcttcaccatcttggcttcaccacgtgtattctttgagcttaccaccagttccaaacactgctagctgagggagcctcctaaacggcaactactcctaactactctgcttgcctagggtgtctgagtccctaggtttggtctcctgcaccaataaaatcaacaaataagcaaacaaacccccagcagtggtgacataggttctcacatggcaagtgggctaccttgacctggcatccagtttctctcctatctggtctcaacttacagtcccactgccctctccctcctctacccgctctgtttcctgcttcctccccacaagcaggtttggctgtgttcatttctgctttttctcctctgggcttttcttcctgctgatttcacccccaccccccacccccagcatgttctctcttgcttctccagttaaaagtactgagcaccctccaaaggccggatcatgagctctcgaatgcctctgaaggaagcagaacctcttctttaagagtccttttctcctcaccccaacagcacgtggcttaggtctcatcttacagataaagtcagcctttggtgtaatcagttacatgtccatctttcttcttctaagattatgtctaagaaagtgagaaagttttattgttttcattcagtctaatacaagtgtctgtggtcctgaacacacagagaggttgaatgggaggcacttcagttccttaggatggatttttattgaggcgtggccatgtgggatcactaatgcatcttcagccacagaggtacaaaccacagactgaggttaacgataagtcacgttggcatctatgtgtgtactgtgatgttccttctatgcacatggcagaccattaccttcaggctccaatcttagatgcaacttggatacattctctagtccgtgagcagtgtgggatggataggtgggctctctgtacaggcttctaaatgttcttagatgttttcactatgtatcatccacatgtgatccctattgaacaaagccttcatgtgttcttcacgccttatcatcccaacgctgtgtactttgtctagaaccggacagatgtgcagtgccaacaccggtggcagaaagtgctgaaccctgaactcatcaaaggtccctggaccaaagaagaagatcagagagtaagttctgtccccatagatgtgtgacttgcagttaagaatattgctaaaacaggtttctcaccccaaggaagcaatttaaatcttcaaacaggaagtaaagggctggctcctgcatgtccagtggatgaaagcagattatttcaagatctgaagatcttgtaacattgaggcttgatgacgctgactctttccgtaacattaaaacacagattatttttctgttcatctgaaggtcatagagcttgtccagaaatatggtccgaagcgttggtctgttattgccaagcacttaaaagggagaattggaaagcagtgtcgggagaggtggcacaaccatttgaatccagaagttaagaaaacctcctggacagaagaggaggacagaatcatttaccaggcacacaagcgtctggggaacagatgggcagagatcgcaaagctgctgcccggacggtaagacttgggcaacaaatatattgattgggaagaaccaagggatggtcgctaaacattctctgtgtgtgaatgaattacattcgagcaattataagcattttgtcagataaaccagaaacaccaacttttaggagcgggcaagagcttggagtttgttccgttggacaaggctagtgacacctgggtggtgagccccagccaaacctttcggctttcctccactgttgctcctccatttgtgaaatagctgatttccatgagttaacgttaggatcaagtgaaatgaatgtcaggtattctgtaagctaaagcacctacctgcctaagaagggagtgcagacacagattgctctcgggctgaggccatccagccagttcagccattactggtcactcctccactttagcaatttccgttttcctaacacctgcattcacctcatttcccatttgattactgggtgtttttttggttttgtttttctgagactaaaaaaagcctgtatgtctagagttgtcacgacaacttcaggttttttaactaatctcagtgttatgtcttatttttaccaaacaaggaggggaaatgacgcctttgtataggataattatggaaactcacctttgacccactgtctacacatatatacattgattttttttttttagctattttgagaaatactttcactgtaaattttaaaataaacaatattaaaagtattcttattcttgagctttttgaccccaaagtggggaaaggattgtttcaggatggcttatctagtatttcctagtcttgcatcaatggggtagctccctcatgccttgagaactttaagaagccatggatctggtcaaaggaggcctttcctcccatgtggcctcagaggatatactgttgacttttctaaagactaaaggggcaactgaacttcctcttttttaaaaacacacatttccccacccccatggaaatagtaaaaatgtttttacttaatttttctttcttttccttttctttttcttttttatttttttagctaagaaacttcctgaaaatgggaagagtttagtaaaagcaccttgcagtttgaaactatactagggggttgaatgtggtagcacatgcctgtaatcccagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagccacaatggaagggctttataacagtggggactctaagttctattaaagtccagtggcacgtgaattctgaggacctacgcctttatcaagaaatcaaaatgctaaaataaattttgcaggaaacttgatacatcccaaatcaggtgagcaagagaagagtggcttttcagttaggcgacaaggtagaaaagatgaagacaatttaaaagagggaaagaaaagttagtggaaccacagcaattaaaatgagaaaataaaagtggaaccacagaaattaaagtattttttgtttgttttttaagaaacagttttctgttgattgactgtaatctgagttaaaagttttataaagtttgtatatggtacatttctacacaggactgataatgctatcaagaaccactggaattccaccatgcgtcgcaaggtggaacaggaaggctacctgcaggagccttccaaagccagccagacgccagtggccacgagcttccagaagaacaatcatttgatggggtttgggcatgcctcacctccatctcagctctctccaagtggccagtcctccgtcaacagcgaatatccctattaccacatcgccgaagcacaaaacgtaagccactcccgagaatgtagagggagaagagaggtggttatatcacctggggtcataaaaatactttacagttgtgtgctttgcatagatgttgtacaagcatggtcacagatggagatgtgtcgatggccctcagctagacccactgtgtgaggtaggagatggccctcagctagacccactgtgtgaggtaggagatggccctcagctagacccactgtgtgaggtaggagatggccctcagctagacccactgtgtgaggtaggagatggccctcagctagacccactgtgtgaggtaggagatggccctcagctagacccactgtgtgaggtaggagatggccctcagctagacccactgtgtgaggtaggagaagatacacttggcttccgtttctggaaacaagaatgaaaaggaatttgtccatcacattgaagtagtgctgaatagaaccaaagtcgtctgattctagttttctgctccaaacctgatttaaagatcgtgttttaatgtaaatgtacttgtatattgctaaatcttaagagtaggtgaacatagatagatgcatagtctgttagctttcttttccaaaatgaaaaattgatgtaatattacatttaaggtcataaagaggagatagctaacctctgaaacatgaaaggagattataagttcaattctggcaatgatctgaagaaaatgaattgatttatatatccaggaaatgtttactttcttactcagagtcaagggctgtactgtgatattaatttggtgatgtgctccttcatcctcgcttgggttggtatcatttcttcctcatttctagacattcatatctagcgaaagaaatcgcttacagtacatgggaacaaagtctaaagaggagaatatcaagaaatgcttatcatcgagctgatgctaaaaaatgacaaaactcacccaagaatcacaaagaccatatgcaaatgttatgtaaaacatatgcatgtgtagttctcacgtggctctatctgtttcttagatttgactacagaatttccagaaaggtctccagtgaatgaattatcataaaagtttctgtgctttttattaaaaggaacattattctaagaaaagtacccctagtgtacttttttcacgcatcccacgaacactttcccgttgttcctctctccaactgagggatgttttctgttgggataggcagactctttgggcctctctccctgtttcttgaactagttagccatttttaagtatctggctaactttcaagttagagaagtttttgtttttgttttattttaatcattccatgaattttatcaaccaagtactttctcccttggtcacagagcaaaattttagagagctgaatcctcctggcgcacttgttaagtaggaatgacttagtctttgttttcttttcctggtctagatctccagtcacgttccctatcctgtcgcattgcatgttaatatagtcaacgtccctcagccggctgcggcagccatccaggtgagatcatctgacgggcaaactccttagctgagcaaggcactgcttttaaagaatactttctttctacacacacacataccatgtaatagaaaagctaacagcattgccaacctactttgggctagcctttatttacccttggtggcttctggaattttctgatgcatccatgagcaggtgctctagcctctgccttaccccttgttgccttaagtcccgtatcactttgagcagatagtggtgaattctgtggggtgattccacatggaagttctctgggctgtgtaaggtacctctccctcagaccttgtctctccctgcttcacttgaaactctagagacactataacgacgaagaccctgagaaggaaaagcgaataaaggagctggagttgctcctgatgtcaacagagaacgagctgaagggacagcaggcattaccagtaagactgtgaccttgggatgggtggcttcgctcagtgctcttctctctcctcctctgtctccttttctaaagactgtctcatccaagttctgtgtgtccgctaacaatgctcaaacaacagaaactgctactgatgactgataaaagtctgttagtctcagaatgtgcattgagtgactggaagtcactgttttagaataggaccacagtacccacttgtgactgtcaggatctccattgtaacaaagcacaaagctttgcctgcttgtttgattcttttactgttatccttttaacctggatttacatttcttacaatctcaaattccatttgaagtgtatttattatatacatgttttttaaaagggatctatacataagccactctttaaatgtttgctatcttttatttgcatgtatgaaagctctctgatcagtagtgataaggtgtttgtgtaaacacatatatgttcccatagatatgtgtatatatgcgtgcagatttctgtgcatacatgtgtccaggccagaggttgacaccaagtgtcttttttgataggtttccacattaaaaaatgtagttgtatgactaccactcataaggtactataagatatatgttgaaataaactctttcctctcaaagaaaaaaaaaacactagttgtaattgtgtatgcatgtgtacatgtgcttgtgtgcactcttggaggtaagaggacaccgttccagaatcagttctttccttctaccgtgggctctggggatcaaactcctttttaactgcctagtcatcttgctggccatccagcttatattttgaaatagggtctcatgaaagctggagtttgcccattnnnnnnnnnnnnnnnnnnnnccagtgagctcgagggtgtacctgtctctccctctccagtgctggggttacacaatggagctgctgtgggtgcgtggagatcaaatccaggttcttacgattgcatggcagtctcccttcagagtgagacaaccccctcccctttttttttgtgctgacaattgagcctagagtctcagacatgctacattgcacacacacacacacacacacacacacacacacacaggatccagctctagctcttgtatagaccgtttctgaatccttgaatgggcagctcacggaaaaagcaaactttggagttttggtagtttagccaagaagtgagtatgtgaaaggtgatacccactagcgattcttcaggtgaaatgttctttgttgttgttattaaataataaaataatgtacttgtgctagttcaaccacttttgaactttagttactattttgcaatttcttctcttgcatggacatgctgtaaggggacttctgttaacttgatctactttcccaaccacatatactctgcagctctagcttgcatcagtgcaacctatagccaaaaaaaaaaaaaaaaaaaaaaaaaaaaaaaagaaaagaatagaagcaacaggatatgtacagatagaagcaattctaacccttgaatgctttcaagggcttaacatgcaaataggaccattcttaagtcatagcaatggggaactgtttttaaattaaactccaatggaattctaagacatctaagacttgtattttgtagcagtcccaaggtttaacatttgactaaaatcttagcaactgaagcaatcctctaggtataaattggagagctattgcaaagctgtcaaaaaggaaacatcttgacaactgtctggcaggcttgagttttggatgaagcaaccactttttatcttgcctccaacagcatctgataccttgtgcaacatagttgctaagtttcttcttcctttcttctctccatccttatttctacacacccccttccccagacacagaaccacacttgcagctaccccgggtggcacagcacctccattgtggaccagaccagacctcatggggatagtgcacctgtttcctgtttgggagaacaccatgccaccccatctctgcctgcagatcccggctccctacctgaagaaagtgcctcaccagcaaggtgcatgatcgtccaccagggcaccattctggacaatgttaagaacctcttagaatttgcagaaacactccagtttatagattctgtaagtagaattgctaaggcacgttgatgtttctggaagaggaattgagaattggtatagcataaatcattgccattttctatagcaaatacggtttggtcctacattcatgtaaagtgaaagacttagcttttacgattccacttctctcagtggtcttgattttgtaggctacccacccaaaattgtttgccttccaggtgtgaattaatgaagttctgacttaccacaaagggctcagaatgagagctgtgtctgaactattttaacaaatttcttatatattttgcttacttctttgtgattctctagaaaatttctttgttgttttggttttgcttgctttttgttttgttttgtctgttttgggacagcacatttggacttacgtttcctcgtaaccttaagctttcagttcaagggtggggcatatagatctctctacagcatactgtaaattgattgacaatcatagtaacaccaaaataaaccatcttgaaccatcttgagtgaaacaaatttgagttcagcagtcactcagttcattttcttggtctcctaattggttaaaaagcacttattcccttcacacgggacagggccagctattgccataatgtatcatctagaaatgttttctgtttgctttaaattgcatgcaaaagagagtgcctgagctctccacagcagatgtgcaagacaacccatgcaccgctgtaatccctgagctagaaagcaggcaggcaggcaggcaggcccagcgttttcgtccattgctctttcagtgctgtgtttgggtgatggtggcgctgtcacttgcataccatctcagaagctctgtgcctcccacgttgtttcaggattcttcgtggtgtgatctcagcagttttgaattctctgaagaagcggcagctttttcacctagccagcagcccacaggcaaagccttccagcttcagcaaagagagggccatgggactagatctgcaggagagcctagcctgagggtgaccaggcgagtgctgagcgaggcatccctcggcccagactcaccccaagcgaggcacagcaaggttccgctggtcgtcctacgaaaaaggcggggccaggccagccccctagccgctggagagcctagcccctccctctttgctgacgtcatcagctcaactctcaagcgttcccctgtcaaaagcctacccttctctccctcgcaggtagagcacaatttctgcacagctgttactaattttcagcatacacccgagccttaataattagaaactaatctaaatttgaacaaatgactaatgactgccgtcctggcagatttaattccgcgttcaatctcactggggtagaggtggctagcttcctggcatttgggctgacacactggtgattttgtcgcatctctttctctcgaagtcttggtgttttggaaaatggacagaaagttgcatgggatgtgtttccatttcccttttcactacatttccctttttccgtccctcccctcttctcccttgtcatccttgcctcttcacattttaacacgatgtctgcctctttgttcattgactactaagtgatttactgaccctggggaggagggaaccaaattatgattacataacatttggattacaactagaaaatgaaccactatgccccttttctaagtgaggatgtttactgagatgatgaaaaagagatgcttctgcaaaataatttaacattttcaacactgggtcttttaaattctgctatgggattttgctaaggtaccgttttccaaagaatacccttacttcatatagtgttcttaaggtatataacactataatgcttagcagagccacgtgctttccaaattataattaagagacaatttggctccttaaatttttttcccaattatatccgttgaagatttggtactttgttttactttacttcattttagtagtagtagtaatagtagtagtagtagtagtagtagtagtagtagtattgtggttcttagaatctaacctggagcctcatgtgtgctagggaagtgccctaccactgagctatacatatttctggacttgtttttaaaagaactttaagtatagacaaatgatccccccattccccaaaacaattggtctccaccccccacccacccccatattttcctaaaccgtgttttgtgaaatcatttctgcaagatagatgtctcagggaaaatgatctaggtagacataaacgtttgggaaatgctaactcgggctttaaacggcttctttaccagagggtccttcaggcttggcgtttgtttggattttttattctttaatttttcagaatgcagacagtcttttattctgctcagcttgccttatgctcctgagttcaagaggcgccctggcttctgagtgactgactgcaggcagcagccactgctcctggcttccctgagagcgttgagtgtgctcatcagtctacccaagagataagatccattgcctttcccaaacctgtgttaccctgggagcgtcaggatgctgagagacaaaccttcttactggataatttcccacatcacgcaaaccttacacaacaacagtctgagttattagaccattaaaccgagaaaaccaaatatgaaagaaaaagaagataacctttttaatgttgatcaagagcacatatcattctcttaagtgacaaatgtcatttacagagaagattttctttgaattttgcaaggtttgaagctttgaccctttagatgttctttcttataaatctctgaaccttgcctaatcaggtggaataaatcaatatccttgccaacactgaaagattgttaacgttgtcgtagttggggttgtgagtcagtagaggacacttgcctgccatctgggtttggcttcaaactgcatgatcacagactcattatttaatcagtttttctttctttctttctctctctctctctctctctctctctctctctctctctctctctcccttccttcctccctctctcccccctccctccctccttccctcccttcctttcttctctcccttcctttctttcttccatgtttagttcttgaacacttccagcaaccatgaaagctcgggcttagatgcacctaccttaccctccactcctctcattggtcacaaactgacaccatgtcgagaccagactgtgaaaacccagaaggaaaattccatgtaagtcttagttcaataagaaaaatgtttattttatttatttatattaattaaaatgtctgacccccccttgtatgtatataatgcattcactgtatgtatcctatgcattctcataatggatacatcccaagtaagttacaaccaaccagggaagaaagtagagaataattaccttctgtagtacattctgatgtcttatgtgcatgcacagggagtttctgtaccattccccaccccccaccggccaggtttttctttccactgtttttcaatatccttactaaaaacaaacaaaagagactgaagcattcagaataaaattgagaatggttcatagtttatattttttaatcttattttttctttttgtaacaaatacattaggatctttttgcatactcacaggaatgaaaatgtatgtatgtatgcatgtatgtatgtatatatgtatttcaaaagccaggggtgattaagtaattgaaaagaaatacattcttattacttccaaataaaaacaaagttttagacatagcgtgttttggccccgtttgagggagcaggtgagactggtttacaaatgatcccagatatcacggtgctagtcaccattatacagatccaaggccattacctatgcctcaggctcattctcaaaaggtgggaactacttcagagctcttagtctcagggcacgatagtttgaagtatttgtagatctgcaatctggtttaattcagatctacaatccctcaatgaatgcatttggctaatcagcattgcccttccttgtccgttgcagcctcttagtgtccacgctgacggcgtcatacgggatacatgtctttttattctctgcttcttctcttctttagctttagaactccagctatcaaaaggtcaatcctcgaaagctctcctcgaactcccacaccattcaaacatgcccttgcagctcaagaaattaaatacggtcccctgaagatgctagtaagttcaagaaaggtccttagatttagtgggcttaggagtgtagacaagtttcctctgatctggaaatatccactcttcccttagcctcagaccccctcccatgcagtggaggacctacaagatgtgattaagcgggaatcggatgaatctggaattgttgctgagtttcaagagagtggaccaccgttactgaaaaaaatcaagcaggaggtaggtcgccctcgctgctttgtgcactttgaactgtttgacatcactgctaaggaacagtaacacttgtcatgcaagacttttgtgcaagcaagttgaaaggcactgtcataatgaggacttcaaccttccatttggaaagtgacttccatcaacttctttaggcagaaaagatgctagagaggggtaaagggaagagggggcagcgggcttatactcttctttcaaaatttattgacaacatagtattaatcgcacatatgcaaagagaaagactcccaacccaaatcatgaccacattaattagagcaagcttttttgtgtgcacaggctacttctctgtaagtcaagagattagcattggacatggggaaaataagggtttttgtagttcaggagtagagggtttccaaatgggggttttggtaggcaaaaagccagggctacaggagccaaacataagcatcacaaattgttcggaacaacctcgtagaacaaaagcatagttaacaggtggtcatgacaaggtgatcataacaacctttgaaacacagacatcattgccatgtcctggaacaggcagtacagagccatttgtaattgaggtttcagatggggcatagcccaatgcttgagaaacagaggtttaatcataaacaggaatggatctaattggtctttactttaagatggctttcaagcctaagatggaggcaggtgaatgggcaagaggatggatagacaagcagtcaacagagaaacagattccagattcattcctgttgtctttctaaggactaagaaatagtttattataagagtgaccatgcccagagaatgtagattcaagttaccctgagtggtatgacccgttagagaacaggagtttgcaagcacaagagaatgaaattttagccatcaagaatcagtgttaactcactagggagaggcacttgcaaggagggtgaacttcctttcatgacgactttatttttgcaagaataggtagcaatttacacctgagagtaaaggtctccagaaagtctttcttccatacacagcacttcctgtttgcttttaggtggagtcgccaactgagaaatcgggaaacttcttctgctcaaaccactgggcagagaacagcctgagcacccagctgttctcgcaggcgtctcctgtggcagatgccccagtaagtatcaggcggatctcggactcttctgtgatcacgtggccacagcgtcccgcgtgtggcatgtgggaccccatgccttcagcactcactcttagagcacctgcttcctaagtattcacagccacatgattctttttgcatttgcattatttgtcttctaagtgctgtgtttcctcctagttaagcagtatgttgtgtggttccatgtggtatctagcatagagtcaatcatggtgtgtaccaaatatttggcatgctaggagcctagtcaaggggtccttatggagccacaggagaatggcccacaggccagattctcacgttccacaattataatggcatggtatttgcatataactcattgggtcctcctgtatactttacattagctttagattaactcaactctcacattgtataaatgttgtgttaacagcacttcaccgtcttagtgttttgaccgtgaatccggatgcaaagtggaaactctgtcaccttgctctggttgtcacagtctaacagtctgtggatagcgtctcctacatcttatggaaaaccagagctagtgaaaattgtgaatacttactcagtgtgttaactgttaattatcatttcagggactttagatgaattaattcctgtagtcctcaaaataacattgtaacattttcactttcattaaagcaactgcaagttgggtaacttagtgatttggttgctcaatattatatacttaacttagtgctgctgcattagaactttgaaagtcagctcataaataccacgctttcaccatttgtagttgatgttgccgtagatttgtagacgtcaaacacttctgtgccgatatatacaacataagatgactcattagcacatctcttagttagaagaatggattggtaaattcatttagtagatagctaggacatgccacatgcttagaattaagcggtgccctacagtgttttcaccattttggtgatgtttgcagcagagagatgagaggcctgtgtagagttggctcctttcagctcccagagaaggttaatttctggtggatacttgctaatgtgtggcatttcacagtaatctctctagagttaggtctgtattcgctcttgtattatcctgcctcacttaaatgattcctttccctttagaatattcttacaagctctgttttaatgacacctgtatcagaagatgaagacaatgtcctcaaagcctttaccgtacctaagaacaggcccctggtgggtcccttgcaggtaatgactgttctaacatttggtgtcttaaaattttttaactgaaagtccgttactttgcgttgtttttaatgttttatacataaaggaatgatactttaagacaatgtcttgatgtctagaagtgagcctatggtgttttgttactaatcatgtgagacactggaaattcttgttcagtcgggggcccccaaacatgatgaagtgaaacatttttttaactgtaactgagactgagatcatgtgttgccctaggctgtgacagtatctccttctgcttttaaacaatctttaaaatatgtatctgtgtagttttttttcagaatgtaattatgtatgctttatcattaagcaaccaaggcctcagagactaaatttctaataaaatgggaaattagctagaaaataattgcaatgcctttgactctcagaacaaaagggcagccctcagtgttggtggaccatctgccgtcaagttttaatatcaaaagagatttcccttgcaactctgaggtagatgtgtattgatgaaatacaacaaattccaaattaatcctgagccaagtgtaaataagaatgcaaatttgttccctcaaattagttgaagcagttcccaacattaaatagcgtagcacctggccagctgcacttctcttccctctgttcccccattgttactcaggggggaaactctaccaagcagagaatagcctggctagaagtaaaaagtactatttgatgctgtatgcttaaaggcaatgtaaaagatagtagcctttgagagctggcctctctgtttatagggccgtcttgccactgatattctgtctaccccaagttgtgagaatcttaaagtctaaccttgtattatttgctatcatttaaaatgtctttgttaattctttgaggatttcatgcattgtgttttgatgacattcatctccaagtcctttccttaactcttcggacacccctggtctcctacttcttgtcttcttcgtcgttgttttgttcaataacctactgacctaatttgtgctacccataatactcgaagcaactcactgtagtaagctcagcctgccaggagtctcacactcttaaagaaaactgactcaccctcccccagaagccaccaactgtccataggtctgcagttgagggtaagggtttataaacccctcccacatcatcgttgattggtcttgtgtaggctctgtgagtttgtgaatgccgtggtcctgtcatgcccagaagacactgattttcttcatacttccgcagtctctgacccttagaaccttctatccctcttctaagtgttggagagagctgtgatatggatattacatggtggctgaggacttctcagtcacgtgttctctatgtttaataacctattgactacagcagtgagtttctgctttagccatcatccagtaaaccgagaagagtatctgatgaggtctaagagcttcactaatatacaggtgaagagataggaatttagaagatagattagtattgttcccatttagcaaagtaacagtagtagatttacatatggggcctatgaactgcctagccatgggttcttggccaaatttgcaggcatatgctaactcctatgaagcaagtcttaagtttaagaagaaaacggttggttgcctctctgacgtttgtgccaccgttgctgccatgggcatatcttgtcacgggggtcattattgaggttcacagtgttcacaactgggtaaaactgattggagctctctgccctgtcagcagccttgcatgatgtcttctggtattgtgaaaactagcaaggatggaggactcttcctggtcagtatgaatccagagaggcaaacataccatgtagattttattgctgaatctttgtatttgtgtgtttaatttggatggtcggtataatcgaggaatctggaaagggttcattggtggggaaagggaagaaaagatcttaaggaggggaatggttaaacaaagaggagaaaatggggaataatggaagggaggcttaagtgtgggggatgagaggatagactagaggatgggttaggagacagacaactaacactgagaatatttggaaaagccacttggaatcccactattttataaactgtataataatgtatcctttaattcatcctacaaaggggagtatgcttattttagaagctatagaataaaaagcccagtgctaggttcagggtacctctccactagttgttggtcagaggtgtcctaggaaccctgaaacaatacaggctactgccattgctcatggtattaagactctgttgctgaagacaccacatgcttcagtcacaagacatggagaagtcaacttggtatttgctgtcaccttttaggacaactggatgaactgtaggcatggttatttcttaactcagttggattgggtccctgtagctttcctcaggtacatgaactgctctgatgaaaggtgggtgggcaggagtacggaagaggaagaccaatacaccaagtcagctcttagggcagtcagccttctcttgccctatgtagagagaactcagaatacctcaaagatatggaaggtaaagaagaaagcacacttcacccaggtctagtgggatacaggaaggggattcaaaggatgtcagagcaaaggtagctatttaatacagtactgatccttggtggagaggaaacaccttgctttttaattggccctttggtttccaaagcatagaatttgactaatgctgtttgtatgttaagctacataagtttcatgcatattttataacctagcccgatattcagcctatgtttattgaagtataaagtgtagcctgacatgaggttgcatgtctttaatctcagcattttggaagcagaggcaggcagatttctgggtttgaggccagcctggtgtacatagagttctatataccagcacaggtacatagtgagaacatgtctttaaaaataagacgagaaaggaaggaagagaggtaaagaagaaagaaagaacattcagaacgtcagagtaagcgtgtgagtgtatttggtggcagtaatcatttcatatattgaaaactcatgactgtgcacctaaaatggaatcctatcagtttccagctttaccatgcagtggtttaggcctaactattcagagctgaacatgggctagcactattttgctatattcttccttacctgtgagggtatagtttttttcccctccccacagtggtacctgaattgtggctgatatcaaacattacatatatgatgcttttacatatctatcataaagtctaatctatagactaggcagtaatgagatacagaagtatgataataaactgtaatataaagcatcctaatcctatgagttgtttatttctgcatcttctgactgcatttgccccaggtaactgcactacaaaatgctgagactggtgcacagggagatccactgttttttcctgtactgggagctttgtttgttgaagcataatgccatttctagtgtttccaccaatacttcaattggatctgattaggcagatcttccatatgtggtattggtgagcatactgttcatttattaaatagtctaacttggatactttctttcccttttactatgaaataaatatctgacaaaagcaaattaaggaaggaagggcttgtgttggcttgtacgtcgttggagggtgccagccatcatggcggcaggagcttgaggcaggcagcggtcacatctcccccaggcaggaagcacagagcaatcgacactactgttcagtttgcttccccctttttatgcaatccaggaccccagtgcagagaacagcactgcggtgtttagagtatgtagtcccagttcaattaactagtcacgataatcccttacacatactcccaaaggcttgcccctggaagtgactctattttgtcaagttgccggtcactatcagccttctcactgaataaagaacatttcatagaatctaaaacttttctcatttgtacttttaagataaattaaattttcaatggatctttagccaaaccatttggatattcttgacactgcatagtttttcgttattttggttttattttcttgaaatgagctcttactatattgtgtagcccaagctatccccaaatttgggacaatccttctgccttggccttctgagctttgggattgcaaattgaaattcactgtgcctagcttttacctaaaacaacaaagcactattccccaaatattttacaagttgactgttttataaaatacaaaatatttgccacttttctagtgtaataaattgcaaatgtaattaaaaccagttttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtttcctttacagggtaagaaacatgctttatgctaataaacatttctactgccagattcaaacccatgctcttgctcttagccgcctgagcttcattttcttttacgttatcattcctttttagtcctgtttgaaacatgagtgcaagcgctgtgtttatatgcgttctttactcatgcactctcctctggattgttttgtaaccacagaatgacagccttaaattttaatttcctgacttggtttgtcaaagccttactcttaaaaaaaacaacaacaacaacaaaaaaaccaatgagtttgaaaacatttcttcagtctttaatacttcagcccatcctcagaagttccagaattttacaggactgttagcagaaattgcggctctcttccctcctctgttctgtgtaattcagccggtaattgtctgcatttcactcgtctgtaagtgttcatacttttccaacaacaccctttccttgtgactgatgttgctccgaagtgacatgagttctcacatgggcatcagagcctgggctctgctctgggctccttctcatcctatttggaggacttgattaaatggagcaaatgaaatgaattaagttactcttgtctacagttaaggaccgtgatgtgtccttccctggtctcttaagattgctgtaaagatcatatggatcggatgattccaagatggcagcacataagccagcctgctcccatgatatttattatcagagaaaaactgcatgcagcctctgtcctgtcaaagaaatgcagctgagctggcagagtgctagcacagcatgcatgaagccctgggtttaatccagcaccaggtgtagtaatgtaaatctataatcccagtcctctggaagatcaggagttcacctgtaactacatagtaactttaaacatagtcttggttatataatgaaaaaatctaaatatagcttaaaaatcttaatacagtagttaaagagcaagtaagtaggtctccctattgccaggacttcttgtattatgttaataacgtctacaattcctattccaccttgcagaaccaggtcagtgggtcactaaaagaaatagctgagcagatcaggtagtcagggctcctactacagcagagatgaagcaggtgacgggcggcctgggtttcttttctttcctgctgttgtgtgggtagcaggaagatggccgcagatacagagtgcattctgagtgtctgtctgtctgtctactgtgctgccgggtttaactccagggtgtcttcgcaattgttgctattctctctggtcactatttttccacccatgtcactctcagaagtgtttcagtgaccagcattcaattagtgatatagattaagtaagctttctgtgtgtatctctgggatggaatttctctgatgagctgagtcggtctgccctgcccaagttgttccaagacagtaactcttcatacactttgtttgatgatatttaaaacaaacgtggagatagaagttgccttgggtaggtcagaaaaggtaaattgcttcagagagacttgacagttgtctgactactgataatcaagcactaggggatgtccgaggaaggagctgttcttcctaaaacttgggtaccccaagctatagaatgtaagttattgaggtgtctataaacatgttagaatgaacacttctagagacatctggataaaagcccatatctgcgaaagatccctgtgctctacccattgttaattcagcctggacacagaggcactaatgggtagggggcatcctgcagtaatgagtaaggggcatcctacactagtgggtagggggcatcctgcactaatgagtagtggggcatcctatactaatgggtaggggggcatcctgtactaatgggtaaggggcatcctgcactagtgggtagggggcatcctgcactaatgggtagggggcatcctgcactaatgggtagagggcatcccgccaccacctacattgtccatcccttcagttaggaaccctgaagttgtaagtatttcattgtgctgccacaggtattcactagtgaggaagtttgctacccattgatctcactgtagcaacctcttgatacaatgaagattttctgtggtatcctttatgaatgccgttttacgcagatgtccctgtgggaaggaattctgactttcagaatctcattaaggatgagatgagtagtatttttgtttggatgaattaaatagaatcggagaattcttactctggattccttagacactatcaatccatatatattagtttttttaaaagtaatataaatatcaataagatagtaattatatgttataataataaaatattaaataaataataaaatatatattagattcatctcgctgtcttattacatcttcacattgtaaaatagaatttcccaggcgccttgacctcagcagatactgtgtggctttatgaatgtaataatacagttattcagcatgaggggagcccacgggaaatgttgcaataatctagttctgtcagaaaaccacctgtgggcgtggtctcggctcctttcatttattgggcttttgcaaagggtctggatgtttttttttcaaagtgctttaacaggatatcccagttaaagttttgacagactgtttatagctcacgtctgcccagcggcaatgaaagatgcattacaggataagcaaggtgactctcctggccgccacaggaggatgtagggtaggattctattaacatttaaatgaattcagacaggctgacatctacagaacactgggtttagaagcagcaagaattcacatgcagaagctgctgcgcctaactgctctcttaaagtaaacagaaatgcaggagttgaaaacagaaacacacagaaattgaggtgacagcattcaaaaatagcccttaacagaaagacacctaatcctggtttgtcacagctatcatgttcttgagaagttgctgtggggtccccagttcaagatcctaaggaaaaaggaagctgaccttgacagtctttttttctcttctcttcttctcttctcttctcttctcttctnnnnnnnnnnnnnnnnnnnncctccctccctccctctctccctccctctttctgtgtatgtgtttgggagaagcacacagatggtatgttgcagacagaggacaaccttggatagtgttcctcagagtctgtccatcccaccctaccatctcttttgagacactccctgaaactcatcaaatacctaagtaggctaggctggctggctagtgagccctagggatccacctgcccctgccttcttagtgctaggattccaagtgcacactaccgtgccaatcccaccccccttttaaaaaacacagtttctggaaatccagcccaggttcttcctcactgaagagtaaaccctttactccccgggccatccccctcgcttgaaccatagtgcccgcctacctgaccttgctctccattctcgccattggtatgtgttctgttcagcttattacattctctgtgatgtacctactgtgtgccctcctagctcccaaagccgcttagctcatgcgagctgcctttctgcccacagtgattccacacacgctagcttactgcaccctatcgtgtgcacaccaagaactgcgtgttctgacctctccctagccctaggctctgaggctctgacctagcgctaggctccggcttagcacacgtgctgaggagtctgggtattttcattattgtgaatttgatctttagacattctcttttgtaggagaacctgattatttgaaaagtccccacaaagtactcatgagaactatatagtacattctttatatattgattctatcttaaatatctagtcctggaggaaagacaaaatatcactccagggatgatcaacctggagatttatcaaagtcacaattcttttcaaattgataagttgatatgattctctgaacaggcatggacagttaagagtcatctaacataccatacagcaaaggacggctcagtgtgtggccatcagcaggagcaaacataacttatattgtggtggaagcttaagaaacttaatttgcatacaggaattttattctgtattaaatcaggccaagtagaaaatttcttttttttagtaggaaaagctcttagaaaaaaatagaaataagccttttttgtttcaatatgttttttccttcattcttcctcctccattcttttgaagatacatgtttttggtaatacacatacatatatatatgtgtgtgtgtgtgtgtgtgtgtatgtatatatatatatacatatatgtgtatatatatggtgtaattttaaatctacatgcacagtatcattaggttaagttatacagtagcctcctcacttagtcagtgtttctaagcactacatatgcttctctgtagaggatacaccatttgatttgttgtctcgttttttgtttggtttggtttggtttttttgagacagggtttctctgtgcagccctggctgtcctggaactcactctgaagaccaggctggcctcgaactcagaaatccgcctgcctctgcctcccgagtgctgggattaaaggcgtgcaccactactgcccggctctgatttgttgtctcttaactgctcattattatatgtcatattttgctgcaaggattacaggccctaactcagtaattaaattgtattagtttaggtgatatagtgtgtctgtttgatttctgtgctgcactggaaaaccttcgctcctgcaagttagcaggcagtaacactcaagcagaggcgctgggcggactgaaaccctgcgcagagccatgtgtgttcggtctgtgcatttggatccagggaaatactcattttacagcacttctcagtcttcctaatctgcaaccgtttaatactactactgttttgaattgtaaagtatgaatctgtgttttcccatagtcttaggtgactccctcaaccctcccccacaccctcaaaggagttgcaatccacaagttgagaacagctggtttagaaccatttcaaaggatgttgtaactaagcttattgttaggaaaaatatcaaatgtgactttgtgttcagaagtcaacctgggatggctgccatcttggttgcagcctgtctgtgacatgctgtcccttggaatgctgtaggacgattcagtggctatggagtatgtcaagctgcacctgattgtttcgagcacacttgtgcacttggctgtgactgagaggcagccaggcaagctaagaggctgtgactcagggaagtcagaacacagcgcgctgcaaactgaaagtcactggaactttagtgtagtcactgaggggggtggcggggagatcaggacctcagcaccatgtccagcagtgttccttcaaggttgccatagttactcaccaacaagcatgcctcttctcactccacccccacccccacccccatggttctgtctgtactggaaggtcctggtgataaacccctgaatttcctatgcacatccctgctacgttcctcataagaggtcttagaggtatgggctgctgaatcccacctcattcagattactgtcccctcgttccttagtgatctagtcttgagtgtgttgctcatgtgctgtcttctatgttaacttcctgctgtgtgacctatgtggggtgctacagaggtggccacaccatgggtgttctgtgtgagagtttaagtgtgacaggatcacagcagtgcagtgtaagggccgttccatgatgccttgcaaccactacatcctttgtttctccatagtctttctcaccaacactgttcaaaccgaaactccccaccctcactatcctttccctccggccgttcttaaacagcgttctcagcgtcctgtgtcctgttctcttgcatgtggcactgcaaaccgccacgcgccggggttttttttttgcagggtataaaagcacatgtgtgttttatctctcaaaagacgcttgaggttctggagagcaaaagcttcaatgttggagacaaagctatgtagcccatgttggccttcaattcactaagtctcaacattcccttcctagtgttcttgctttttgttctttaaaaaataatttatttatctactttatgtgcattggtgttttgcttgcatgtattttctgtgtgaaggtgtcagatctcctggaactggagttacagacagttttgagttgccatgtgggtgctgggaattgaacatgggtcctctggaagagcagccaatcagcgctcttaagcactgagccatctctccagtcctacttctctactttagaaccactgttgtatttgtgctatgaacgctgtaaaccatcctgagaattaagtgggacataaactgtacatattccagtttgagtagacatggagaaacagcaggaaccaggagatacagtgggcagaacaccgttcaagctattgtgtgtacaccatagcctcacttgggcaagttctctctaaacctcaccccttcatttacctgtccagctacggtgtgtctgaacctttcctcgtggtgtgtctgcactatgtacatgtgactatgtgcataagacccagtactgtcctgggtatctgtatgttgctcttcattacttttatcttgtgatttccaatgtatcccttaaaactacgctaacgtggggctggagacatagctcagtccgcagacttcttctctgccatacattaaaccctgacccagcacttggggagttgaggcagcacttggggagttgaggcaggggagtcgaagtcagctcaactacacagtgagttcaagaccagtctgagatacataaggctctgtctaaaaggagaggaaaaggttaagctaatctaggagtttgggttgtagtttaatggtagagcatttgcctagaaagtgtgtgaggctctgggtttaaccttcaacgccgcaaaaagaagctgtgctgatagacatactaataaagataactttgaaatgtacatgtgtgcaaatagatgtatgtgttttagatatttgtatgaattgtgtgggttttatcaggtagtggtacattacagaaattacgctgcttggctcaagggctcgtcaagtccatggagtgagtaaaggcctaggatctatctgcctcaggtatctgtagagtgatgcccagattctgtctccaaccttggaaaactgcctgcgaggcagaaggcattccaagaacaagatgttacatcttacgaaagttctgagagacaaaggcttgctagcatggactgcttcccgcctggctgccctgctagggtggggaagcctgggcctcctggcctgaccctaatgtctccttctcctccctcattagccatgcagtggtgcctgggagccagcatcctgtgggaagacagaggaccagatgacggcctccggtccggctcggaaatacgtgaacgcgttctcagctcgaactctggtcatgtgagacatttccagaaaagcattatggttttcagaacacttaaaagttgactttcgacacatggctcctcagcgtggagcgctccatggctgagagaagagcctgattttgttgtggtacaacagttgagagcagcaccaagtgcatttttagttgcttgagatctcacttgatttcacacaactaaaaaggattttttttttaaaaataataataatgaataacagtcttacctaaattattaggtaatgaattgtgaccatttgttaatatcataatcagattttttaaaaaaaataaaatgatttatttgtattttagaggatacaacagatcagtatttttgactgtggtgaatttaaaaaaaaaatttacacaaagaaatatcccagtattccatgtatctcagtcactaaacatacacagagagatttttaaaaaccaggagaagcattattttgaatgttagctaaatcccaagtaatacttaatgcaaccctctaggagctcatttgtggctaataatcttggaaatatctttattatactaaaccatttcatgaggagaattttgttgtcagcttgcttgaaaagttattactgtatgaaatagttttattgaaaaaattatatttttattcagtaatttaattttgtaaatgccaaatggagaaatgtgttcgctgctatggttttagcctgtagtcatgctgctagctagtgtcagggggcaatagagcttagatggaaaaaagagaaagagactcggtgttagataacggactatgcactagtattccagacttttttatttttatatatatgtaccttttccttttgtaattggaaaacttatttgggagaattttgcatttgttgtacatttttgttttttaggatttttttttttgttgttattgtcggtttataaaagcattgcacttctttttctttttttgggagatttgtgttgtttatgtcatatgttttgttttgagttcagcctgaatgttcatccgtttgggcgtttttctgacttggaagaacattctctgtaggtttctaagtgtacagagccggaactgcctcgtggttcctgggcttcagggaagacaaatatggaagtcaacagccagtttctgccttgagagcatttgcaagaatgctggccttgaattctgaaatgacagtgtatctactgccttgtagcaaaataaagctatcctcttattttacatacttcctgatgtctctcgattctgtgatttggggtggtggttacatattcgaggagatgagacaaactcaaaataatcttcactttaaaaaaaaaatgtgcttgccatctaactttttacatggagagtcatcgccacttcagggaacgaaaagacaaaccaaggtaagtccacagaaccgtcacaacgaccgttggagggctcttccagcctgtgtcaaacaagggcactgaagctctttaattgaaacaatgcactctagaagtaaatgctggtatctgagttagggagatggctcagtctggaatgttcttctgtcaagaatataacctgagccgggcgtggtggcacacgcctttaatcccagcactcgggaggcagaggcaggtggatttctgagttcgaggccagcctggtctacagagtgagttccaggacagccagggttacacagagaaaccctgtctcgaaaaaacaaacaacaaaaaagaatataaacctgagtccccatctccagaagccccacaaagccagacaaggcatccatgtctatagtcccaccagacaaggcgtccacgtctatagtcccagtattcctgtggcaaaaaaacgggagttgaagatgaagattctcggatgctggcatgcacccagcaaacccacacaagaaatggcagagagctaagagatgctgtctcaagacaaggtttgaggggagaactgatagccaaggttgttctccatagaggacatgtggcatgcatatgccccgcctccaccatgcacacagaggctcgagaatttaatcgcatataggtaggctgtgagaactgaaaggtcatgctcatggaaattaggagactctgagagatgcgatgagccctggtgatgcaaaggctttctctttctgcttcccagccactctgatgcaaactgctccactttcccatcgtaatgggctgacatctctgaatctgtctttccacaagctgcttctatattttatcacagtgaaaaaaagtaacaaacacaggtgttccaatgtggtctattcagtgttcagtatcccttgcacaaatactgattgattctcacaactcaaatccaaactccaattttgagttttcataagcataacatagttggtgttcatcaagccaaggatatgatagatctaatgactaatcttcagagctattttataatccttgatcctggtgagcaatacattttctgagtgttgagtagtataactgatgagtagcttttgtcagaaaatggagccttgatgaccagttagctatctcagtgagtcaaagtattagagatgatgaatgtgactagcaacgaggagcctaagtgtgtggttcagtggcagggcaagagctgagcatgtgaatccctcttatagaggcttcgaccctctataaactcttacctatatgtaaatcatagttatatggcaggcaactgggaatggctgttttactacccagatttttctagtgactttcaggaaggcagtggtcataggtttataacacaatgctttaaagtatattgttctctagttctgggtgctagaaagtccaagttcagtaggtggatttaaagtctggcgagagcatacttcctgtttcgtagaagatacgattttgttgtgttttctgttttcacatgacagaaggccctggtttattttgttgattgggtgggtaggtaaagtgggtgggtggtttggtgggtgggtgggtggttaattgggtgggtgggtgaatggttgtttggttggttgtttgggtgggtgggtgaatagctggttaattggttggttgggtgggcggatggtggttatttggttgggtgggtggttgggtgggtggttatttggttaggtggttgggtggttgattggttggtttggttatttgaaacagggtcacctgtaacccaggctggccttgaagttgttatgtagctttgaatggtcttgaatccctgaacttcttacttccaatttccaggcgctgggattataggcatgggccagtatacccaactcttgctagtttactttggttgttggttttgtttcatgttttagtgaccctactctctgtgacacatgtacaaatgcatggatgtactatatttactacctaaatgagaagctattccaatgtcactataaagtggcatgtgaggaacaggagagacactgagaggaccaatactgtccactgacctcatataggactggtagatgcgagtgttgtcannnnnnnnnnnnnnnnnnnnttctgcatcaccagggtcctgtgttagggccccctgcattgcctcatctgatctgaagtctgacaaaatttggttgtaattcagactttaccatcgttgttgacttcacacaagtttgatgtcatctctctaagttcattttacttatattggatatcaaatataggtattatgaagatgttgtgaaacaggaaatccattcatgggtctctcttaagattctgtggcacctgtccgtaagatgctttgctagttcatctgtgcaaacaagaactgtgtgtgccattcggtgatgaggaatgaaagatttctgaggctcatgtccctgcttgcaagttacatgtactcaaatataaatattccttcctaatattctcagttattctacagtagataaattcttcttatgtaacatatatgcaaatgacagcacagcttcccttcaacctcttggtttctagtgcagtgtatcttacacacactcgttctcatccattgccgttctcatccattgccggggggtgatatcagcagggatgcagggtggctaagtgcttactgcatctactgtcaaggagggaggtgacctggttcccagcagtgagaagtgagaggcgaggggcaagataggaggctgtgaactgaggtttggactttgtcctttgcgatatggggggttattaaaggcttttaggtagagaaataaaatgattaatttatatctgatgtatagaaatcctgttcaaactctttattcacatatagtataaaattaatcctcagattagtagggagagatgatcagagtccaaattccatgccagttaacttatttttcatagcatgtttcctgctgcctaatttcagaagcatgcattttaatcctagaaaatctaactcgggggggaaaaaaaaaccaactcaactttgatctgtgcttcatgaaacatcatttcaagtgttataatccataaagtagaaattgactcaggaagaaacgattgcccagaacacttttctcctttagaagtgggacttttccaaccattactttctcagaccttctctgctaaacctcccactgaatcattatgtggtctaatccttggttctttatggatattttgatggatttttgtattcactgattaaggaatctttccagcatttgttcctgaagaaatttcaatgtagtgttatattgtagtctacccttcacactagaacaccaatgatcagtgggtcttgggttttattggacacagaggctaagaacactggtagattgaagttaagtcaggaatgcgtcctgtgtaaactctgcatcccatgtttgacagccaccaagtgactccaacacaggaggactgagggaattgaactacaaagacccggttttgtgaacaaatttgcaacctgagctttctatctgaccattccgcaagccttacccgtttctattgaaaatgtccattggtctgcaacagaaccttagaaaacataacccacagctacagggttttcttaactctaaggatttaatttgttactagtgttggtaattaggtcttttgtctggtgtttacaattgcaggaagcataatttcattcacaatacacttgggtctctcttatcatatggctctgttgtccgcgtcccatcaaaagggaatatacatcgatgaattcaacattaaagcaaagcaaagctgttgttcagagagattcttatttcgaaaccaggctgcaatgaacttgctgatctcctttgtttgcctaaacctctgagctttaggtttccgttcaaatggaggaagtatttaatcctgtatatagttacaaagcatacagaatttctcagatcagagataaacaaaactcaaagaatgcttcagtagtccaaagccattggaacacacagtgtgggctgcgagatttttaggtcaagaacaccctccaagatgaacctactatgcttggagaatatgtaaggacagagtcacgggttgttttcatttgactgatctctttaaaaacataagtgttttcccactttctaatagtactaaatatatctgaccatggatggagcaactcatccagctagtagggttagaacctaccactcatttttttccaaaaattctttttttattgagcacttccaatgcaaggccgagttcagctgagtatatacagctcacaaacataataagtacacacaagtatagtgtgtacaacattcacaattataggcaggatcattttcttggataccctcgaacatatgaaggaaaaaaataggcttatactttggtaactatgtttctttaagtcatacctgtcactgtttaggtaaccaagaaccagaggttagatggaccagagacctacagtaagaaagcataaaagatagtgataaaacgacccctaatgatattctgctatagtcatagatcagtggctctgttcagccatcagagaagcttcctcccacagcagatggaaagaaatacagagacccacagccagacattacacacagaaagaccttagaacactcagctccaagtgggatgtctccatccatcaaatctctcccctcagagctcagggaccccccccacacacacacacacacacacagaagaggaaggagggtaagagacagaggaggtgggccaccaggaaaacaaggacctttaagtttacatgaacaaagcacatatgaactcacagagacttagcagcaagcacagtgcctatacacgcctgcaccacgtcctctgtgtgtatataacggctttcagttttgtacttttatgggactcctgtctgtgttaaaaatgggtcgctgattcttgtgccttcccttggggctcttttccttctgttattttatcttgtccaacatcaatgcgatggtgttctttcttattgtgttttattttgtcatattattattatcatcatcacttagaagcctattcttttctcctgagagacaggaggggagtggatgcagacgggagccgagggacagagggcctgagcaggatgggggatgggaaatgatcatcactctattctgtatgagagaagaatctactttcaattaaagtgaggaaaatctaagatgtctcttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggactacagacaagtctgtggtgcacttttttgattagtggttaatgtgggagggctgggccaccgtgggcagtgccctacctgagctgtggtcctgggttgaataagtaattgggctcagccagacacaatgaataagccagtgagcagtgtctctccatagccattgctttacttcctgctttcaggctcctattctatatccctgtccttgccttcctgggttcccgctccgatgaactacagtctttaagggtcctacttccgtttggacctactcctgtcttgtccattcctcctccatctccctgggcttgaactgcctgctcttgctatccctatacagtgcacttcaacttttatcctggacacctgactcactgacagagtcacagggctggtttctgtcatcctacatctggtaagtccttgattcctctccttggtggtatttgatctttatcactactgagaaggaagccccagaagtttcttttttcttcttcttaataaaaagagggcggggctcaaaccatgactcagagttggaacattaattaataaaggaaccttttctaggccagcagacaggagttgcattcttgccaatcctttctaagagcggatgggcaatgcctgcatccatcctgcctaagtcatcttgaaactgagggtagctgatgcttttattggcatccttcctttgaatttgacttttcagctcctctgtggttttgtctgcagaccctggtggtgaggtgaaggggcaacgctttgctcacactgcagcgttcttcacgagcatattcgtccctagactactgagcagcctgagcagagatgaatacaggacagactgatgaatggttgtgaatggtagatgatgagtcgacatagcaattacagtccaatgttaattgtcaactagacagggagtatgcgtgtatctgctttgacttgacatttttttctaaatgtttacaatactcaaaatgtagagtttcagggttggatgactacaaatctaaaggcttcgacattgacaccataaaatcccctctgacttgaacgccctgaagctcatcatgcttctaagttgttttgtttgttggttggctgttgatcattttttcatctttaggtatattcttgtgattgtccaacatggaagctttaaaaaatgggtattttttcttttcaaaaagagagctgggagtagtggcacacacctttaatcccagcacttgggaggcagaggcaggcgaatttctgagttcgaggccagccttgtctacagagtgagttccaggacagccagtgctatacagagaaaccctgtctcaaaaacaaaacaaagaaaagaaaagaaaagaaaagaaaagaaaagaaaagaaaagaaaagaaaagaaaagaaaagaaaagaaaaggaaagaaaagaaagagagctttaggctggcctggaactcactacgtagccctggctggccttgaacctatagccatcttccagcatcatcctcctgagtatgtttgattacagatgtgagctaccagactcaattcagtttgttaaaataatagccaattgtggtcttttgtgaacccgtagtccgggatttcttcaggtgtctgtatcttgctcagtttttggtcttgggcttggtgagggttagcacagctcccgggggcaggaagagaagtacagagcagttagttcatcatcacaagatcagctaagcatctgagagagggccctgggttccatctcctattggcaagcaatagactcacattgcagagagtatagaagggcatcaaccagttttggactctgtattagtcagggttctctagagtcacaagacttatgaaatgtctctatatattaaaggaaattgttggactgacttacagtctgcagtccaactaatccaatgatggacaactgtgaataggaagccaaagaatctagctcagccccacaagactagttgtttcagctggtcttctagagaagcaggttccaacagatgtgctggcaagtaagagcaagcaggtgaagaatggacccttccttcttctattgtccttacataggcctccagcagaagtatggccaagagtaaaggtgtgtactaccatgcctggacctaagttgttctttacttggaacttgctctgtcccaggctggccttgaactcagagatctgcttgcctctgtctcctgggaataaaggtgtgtactgtcttgcctggtcctaagcttttcatggccactatgcctcaagatctggatcccaggtgtgccctccatttctggattgtagttcattccagatatagtcaagttgacaactgggaatagctatattacagactctatcaatataatcacccccttagcagttcatcttttaaaatatcattaaaggatgtggagaaatggctcagctgatatggggcattagttatggaggaagtgtctgtgctgggcatggatgcattacaattcggagatgtgattagcaaatgaccctgacaaatacggttagcaaatgtaatttctccttccctcccctccttcctttggatgaataaataggtgtttgcatttataaatatataagtctcccttcttacctacactttgctttctgagcttaagtttacctgaaatcaagcacaggtcaaaaatattaagaagaaaattctaggaataaacaattcatgcatttgaaactgcttttattatagtatagtataacaattactgtatgctgttgttattatcactgcatctaatttatcacttaaaccttacctaggtttataggtactgcaaacacacacacacacacacacacacacacacacacacacacacacacacacacacacacacgttgtgtatgttggttagggccaagaccgccaggcaggagaacccgaactccagctgctcggcctgattctgatggaaaccctgacttccggccagctcactgcctttcgggtgctgtaggatccctgccctcccccagcatcagcttccgcagaagacaagtgtgctcggggctcctcttcacacccttgagcccacactcccacgggcg

SEQ ID NO: 1044 - DNA, 3413 bp, Mus musculus
gggagtgtccaaacctctttgtttgatggcatctgtttacagagttacactttaatatcaacctgtttcctcctcctccttctcctccttctcctcctcctcctcggtgacctccttctcctcccctttctccggagaaacttgcccccggcggtgcggagcgccgtgcgcagccgggggaggacgcaggcaaggcggagggcagcgggaggcggcaaccggtgcggtccccggggctcttggcggagcccggcccgcctcgccatggcccggagaccccgacacagcatctacagtagcgatgaagatgatgaagacattgagatgtgtgaccatgactacgatgggctgctgcccaaatctggaaagcgtcacttggggaaaactaggtggacaagggaagaggatgagaagctgaagaagctggtggaacagaacggaacagacgactggaaagtcattgccaattatctgcccaaccggacagatgtgcagtgccaacaccggtggcagaaagtgctgaaccctgaactcatcaaaggtccctggaccaaagaagaagatcagagagtcatagagcttgtccagaaatatggtccgaagcgttggtctgttattgccaagcacttaaaagggagaattggaaagcagtgtcgggagaggtggcacaaccatttgaatccagaagttaagaaaacctcctggacagaagaggaggacagaatcatttaccaggcacacaagcgtctggggaacagatgggcagagatcgcaaagctgctgcccggacggactgataatgctatcaagaaccactggaattccaccatgcgtcgcaaggtggaacaggaaggctacctgcaggagccttccaaagccagccagacgccagtggccacgagcttccagaagaacaatcatttgatggggtttgggcatgcctcacctccatctcagctctctccaagtggccagtcctccgtcaacagcgaatatccctattaccacatcgccgaagcacaaaacatctccagtcacgttccctatcctgtcgcattgcatgctaatatagtcaacgtccctcagccggctgcggcagccatccagagacactataacgacgaagaccctgagaaggaaaagcgaataaaggagctggagttgctcctgatgtcaacagagaacgagctgaagggacagcaggcattaccaacacagaaccacacttgcagctaccccgggtggcacagcacctccattgtggaccagaccagacctcatggggatagtgcacctgtttcctgtttgggagaacaccatgccaccccatctctgcctgcagatcccggctccctacctgaagaaagtgcctcaccagcaaggtgcatgatcgtccaccagggcaccattctggacaatgttaagaacctcttagaatttgcagaaacactccagtttatagattctttcttgaacacttccagcaaccatgaaagctcgggcttagatgcacctaccttaccctccactcctctcattggtcacaaactgacaccatgtcgagaccagactgtgaaaacccagaaggaaaattccatctttagaactccagctatcaaaaggtcaatcctcgaaagctctcctcgaactcccacaccattcaaacatgcccttgcagctcaagaaattaaatacggtcccctgaagatgctacctcagaccccctcccatgcagtggaggacctacaagatgtgattaagcaggaatcggatgaatctggaattgtggctgagtttcaagagagtggaccaccgttactgaaaaaaatcaagcaggaggtggagtcgccaactgagaaatcgggaaacttcttctgctcaaaccactgggcagagaacagcctgagcacccagctgttctcgcaggcgtctcctgtggcagatgccccaaatattcttacaagctctgttttaatgacacctgtatcagaagatgaagacaatgtcctcaaagcctttaccgtacctaagaacaggcccctggtgggtcccttgcagccatgcagtggtgcctgggagccagcatcctgtgggaagacagaggaccagatgacggcctccggtccggctcggaaatacgtgaacgcgttctcagctcgaactctggtcatgtgagacatttccagaaaagcattatggttttcagaacacttaaaagttgactttcgacacatggctcctcagcgtggagcgctccatggctgagagaagagcctgattttgttgtggtacaacagttgagagcagcaccaagtgcatttttagttgcttgagatctcacttgatttcacacaactaaaaaggattttttttttttaaaataataataatgaataacagtcttacctaaattattaggtaatgaattgtgaccatttgttaatatcataatcagattttttaaaaaaaataaaatgatttatttgtattttagaggatacaacagatcagtatttttgactgtggtgaatttaaaaaaaaaatttacacaaagaaatatcccagtattccatgtatctcagtcactaaacatacacagagagatttttaaaaaccaggagaagcattattttgaatgttagctaaatcccaagtaatacttaatgcaaccctctaggagctcatttgtggctaataatcttggaaatatctttattatactaaaccatttcatgaggagaattttgttgtcagcttgcttgaaaagttattactgtatgaaatagttttattgaaaaaattatatttttattcagtaatttaattttgtaaatgccaaatggagaaatgtgttcgctgctatggttttagcctgtagtcatgctgctagcttgtgtcagggggcaatagagcttagatggaaaaaagagaaagagactcggtgttagataacggactatgcactagtattccagacttttttatttttatatatatgtaccttttccttttgtaattggaaaacttatttgggagaattttgcatttgttgtacatttttgttttttaggatttttttttttttgttgttattgtcgatttataaaagcattgcacttctttttctttttttgggagatttgtgttgtttatgtcatatgttttgttttgagttcagcctgaatgttcatccgtttgggcgtttttctgacttggaagaacattctctgtaggtttctaagtgtacagagccggaactgcctcgtggttcctgggcttcagggaagacaaatatggaagtcaacagccagtttctgccttgagagcatttgcaagaatgctggccttgaattctgaaatgacagtgtatctactgccttgtagcaaaataaagctatcctcttattttacat

SEQ ID NO: 1045 - DNA, 1911 bp, Mus musculus
atggcccggagaccccgacacagcatctacagtagcgatgaagatgatgaagacattgagatgtgtgaccatgactacgatgggctgctgcccaaatctggaaagcgtcacttggggaaaactaggtggacaagggaagaggatgagaagctgaagaagctggtggaacagaacggaacagacgactggaaagtcattgccaattatctgcccaaccggacagatgtgcagtgccaacaccggtggcagaaagtgctgaaccctgaactcatcaaaggtccctggaccaaagaagaagatcagagagtcatagagcttgtccagaaatatggtccgaagcgttggtctgttattgccaagcacttaaaagggagaattggaaagcagtgtcgggagaggtggcacaaccatttgaatccagaagttaagaaaacctcctggacagaagaggaggacagaatcatttaccaggcacacaagcgtctggggaacagatgggcagagatcgcaaagctgctgcccggacggactgataatgctatcaagaaccactggaattccaccatgcgtcgcaaggtggaacaggaaggctacctgcaggagccttccaaagccagccagacgccagtggccacgagcttccagaagaacaatcatttgatggggtttgggcatgcctcacctccatctcagctctctccaagtggccagtcctccgtcaacagcgaatatccctattaccacatcgccgaagcacaaaacatctccagtcacgttccctatcctgtcgcattgcatgctaatatagtcaacgtccctcagccggctgcggcagccatccagagacactataacgacgaagaccctgagaaggaaaagcgaataaaggagctggagttgctcctgatgtcaacagagaacgagctgaagggacagcaggcattaccaacacagaaccacacttgcagctaccccgggtggcacagcacctccattgtggaccagaccagacctcatggggatagtgcacctgtttcctgtttgggagaacaccatgccaccccatctctgcctgcagatcccggctccctacctgaagaaagtgcctcaccagcaaggtgcatgatcgtccaccagggcaccattctggacaatgttaagaacctcttagaatttgcagaaacactccagtttatagattctttcttgaacacttccagcaaccatgaaagctcgggcttagatgcacctaccttaccctccactcctctcattggtcacaaactgacaccatgtcgagaccagactgtgaaaacccagaaggaaaattccatctttagaactccagctatcaaaaggtcaatcctcgaaagctctcctcgaactcccacaccattcaaacatgcccttgcagctcaagaaattaaatacggtcccctgaagatgctacctcagaccccctcccatgcagtggaggacctacaagatgtgattaagcaggaatcggatgaatctggaattgtggctgagtttcaagagagtggaccaccgttactgaaaaaaatcaagcaggaggtggagtcgccaactgagaaatcgggaaacttcttctgctcaaaccactgggcagagaacagcctgagcacccagctgttctcgcaggcgtctcctgtggcagatgccccaaatattcttacaagctctgttttaatgacacctgtatcagaagatgaagacaatgtcctcaaagcctttaccgtacctaagaacaggcccctggtgggtcccttgcagccatgcagtggtgcctgggagccagcatcctgtgggaagacagaggaccagatgacggcctccggtccggctcggaaatacgtgaacgcgttctcagctcgaactctggtcatgtga

SEQ ID NO: 1046 - DNA, 57763 bp, Homo sapiens
ttgagaaaaacatgtaacagtgtgaaggtaaaaggtatcttcttttaaaaagtattttgcatagatattgttctttaaatgttccatgaggatatccttaactaccagttatttagaagaaagaaagaagcagcaaaagagttttcaaagaaaaaaaagtatatgcaatctaaaagccagctaaggtgctatgcacaccctctaagtcccagctgcttgggaggctgaggcaggaggatcacttgagcccaggaattcaaaaccagcttgggcaacatagcaacatctcatctcaaaaaaaaagagaaaaagttatcaaaactccatgtaacctagattaaaacataattagaaattttatacatatatcaaaatgtcatattgttccccataaatatatacacttataatttatcaattattgataaagaaataagagcttttatatcacgattttggtgtacctgacatttttcaaacaaattccgccttttggggccaaagtgctctctgtcaagctccatactaaaggatcaaatgagcctccccaagctcccagcagaactagcactttggaactttgtcaaaattttaagacaaaggattataaacactttgatatagtttccttagaggctgaatgttttgcttaacacaaatatttaaaccaaattaagataactcaagaactgatatgtttcataaactgattgtttttatttttctcagaaccgttaccttaactgaagagtaaattggaataagcaatttctatagatgtcaaaactttgtaaaattgattttttacatcatccacaaactttgtatttctagcaacaaatgtaaaagaaagagtagagttatggtacacttcatcctaacagggttcacatttaaaatcatgtagtccacttctgtgaagggcccaagaaaaataactcccttaaatccgttcctttcttcttgttctgttcgagttaaaaactttattttcttagactttggttaaaaaaaaaaaaaaaaaaaaaacaaggaaagacatagtggtgattaaaaaacatgccatttcttaccaaatggttttcacaaagcctaaaaaaacctacagttgctggaattaagcactcattcacttattgattttatgactaattttaaaatggatggcccattgaggtaaattcaatattatataaagatgtagtaaagtcaacaatcagataaatatacaatgataaagtaggagagacagaaataagattcagaaaaataatatgtgaaacatcatgctttaaaagaaaaacagttccaaagtcatattgccaaacagacagaaatctatccaaatcatagaaataaagcactacaagtaagcttaaaattatgattttgctatcatttgtaaggttatcaacctttatctgaggacagaattgaatccctttgaaggactcacaatacaggaagaattacaagaacataaaggcataggagttaaaagttgaaggctgccagagagtagcggaaagaactttggatttggaacaaaaaaaccttcatttaaacagtcccagctctggtaaatgttatctgtgtgaccttgtgcaaattacttcacctgtttcaatttcagttacttgacctggaattgaggaaaataatacctgcgggggagacataggcagaaaggcatgaactgctgtgaggattaaatgatataatatatggcacagcctgttgtaatctctaaagccaaatataacgtgctaataagtatattaaataaaaaataaataaaacagctccaactagttctcatcagttgtcatcagcacaacaaagatttatgtacgtacttatgttcaagaccccgttctaggaactgagtaggtagaaaggtaaaagatactgtctctcctctctgacctataatgaaggctccagatgaaataagacacatttataaatagatagatagatgatgcttagatagatagataggtaatagatgacagatagatagatagatagatagatagatagatacatagatagatagatacatagatagatacatagatagatagatgatagcaaagaaaggtaacataggccatacactcaacaagagtcagggaaggtaggtattaacacaactcacaggtgggagaaatgactgtggattagcaaggtccaagaaggcttcagaaggaagatttggacttcagcagggcctgaagaatgggtagcacttacataagcagagaggagaaaggaaggcattgcaggcaggaggcatgcttgtaaccaaaggcctgagattgccaatggttttttgggggaggaaacagagtgaacagagtatgataagagataaggctgaaaggtaggttgtgttctaaggcaaaatggcatgcagtcagtgtgcccgtcaagccctgcaggttgtctatagccaggcccactctgattggccaatacatgagccacttcaggtattaaatactatcacccctgggggtaaggttgtctgggcacagaggccagagcaagctcagtatagggaatgccaagttaaggagttcagatctctatcttgtcaacattagggagccagttaagggtatttaaacagatgactaacatgctaaaagtgagtataatgagattattgagcagtgggatgcagaatgcatgggggaaaagtggccacagggtggaaaattaattagggggctgttatggtagttcagggtgaagtaataatagcctagaagaaggtggtgacaatagaaagagaaaacaggccctgaatgtgcaggaatcatctagtaaaagttccacttctttctttctgcaggcccaagccttgcacagtgcccaacactaagtaaacacatgtgtttatcaactataaggaactatggaaacattgtcagggatacaaaggtaaattgagagacctgagtatttaagaaagaaacagaatattaaagactggaaacatttttaaagatctctactgcagcctccatggattgaaggtttgaaatatgaggctcagagaaactgtgtgctgctcatacatttgatgaacctgccttaaacaccctgttatttgttattccaataagcccctaaatgttattaatcttttgttgttgttgtttctattagcatttctactaataaaagcttactgttttgttgactaactttgaaagctgctattttacatttataacatatgtgggaaagtatagagaaggaggggaattgactaagaacagttgtgagaagagataagagagaaattacatctgtaggccgggtgcagtgtctcacgcctgtaatcacaacactttgggaggcccaggcaggcggatcacgaggtcaggagttcaagaccagcctggccaacacagtgaaaccccgtctgtactaaaaatacaaaaattaactgggcgtggtggcaggcgcatgtaatcccagctactcgggaggctgaggcaggagaattgcttgaaccaggaagtcagaggttgcagtgagccgagatcgtgccattgcactccagcccaggtgacagagctagactccgtcaaaaaaaaaaaaaaagaaagaaagaaagaaagaaagaaattacatctgtaaactggtcttgaagaatttccccgaaagctttaaaaagataggactgtcacttggagaaaagttaacgattccataaaacagatattctaaagcagaaagaggtaagaccttcatcctctacagcaatgtttttcaaactgcgattcactacctataaacagagcacgaaaacaactttgggatcctgaccagaatgaagagaagagaagagaagaggtctcagattgcatgcttggtagtaaggggtaagtattgttttgtgaaacttttaaaaattattatttaatagggacaaggtctcactatgttgcccaggctggtctcaaactcctggtctcaagcaatcctcccacctcggcataccaaaaaagtgctgggattacaggtgtgagccaccacacatggccagaacttttcttagctctgtgtgtgtgtgtgtgtgcgtgtgcgttgagataggatgtaagatgtgcttcttatcgtgtcacatataaaaatatttgaggccgggtgcagtggctcacgcctgtaatcccaacactttgggaggctgaggcgggtggaccacctgaggtcaggagttcgagaccagcctggccaacattgtgaaaccccgtctctactaaaaatacaaaatattagctgggcgtggtggaaggtgcctgtaatcccagctactcgggaggctgtggcaggagaatcgcttgaactcgggaagcggaggttgtcgtgagccaagatcgcaccattgcactccagcctgagcaataagagcgagactctgtctcaaaacatatatgtatatacgtatgtgtgtgtgtatttgaaagccaccttttcctcaaataaatcaaagcctttcaaaatcagttgaaaaaatacagaattttattaaaagaagaaaacatttgtgtgtgtgtgtatatatatatataactttctttattccccaacaggtctctccacccagcctctacctctcagtctcagccctgtcttttaacctcttaaatattatccaaagactttcccttggtcagatctctacattagcaactctatgaaatagcacagttgttgccttcatgtaaataaactcttaaataaagcatttatttgatgtgctactggtgaatgtttaacaatcagttttccaataagaaaaagcccttatttgtagcacttgccatttcctgtggtgtaaatactccaactagagccaatttcaagttactaacattacatcactacatatgaaattggaaagagatgcacaacagcacatattacattgtgtgatagacataaataacctcaagtatgtagataataggaaaatgtcataaaataggaagtgatgagttttgaatatttattgtcttttaaaataaaatatatttaactgtaagtttatataatttactttttaataatggctgtgtctaacaattaactcacaaaatttagctcccgtgtattcctgacccagcttgacttcgccagcaggctctgatcccacactctctaccacctgctgaacaactctacccggatgtcttccataagaaaccacaaatttaacataccgaaatctaaacatgctttcctctttgaatctcccagtgcatacttctcttcgcctcttgacttccctatttctattaatggtgcctctaatatccttagcaacccaatcagttgctaagtcttgaaggctctgcctatgttcttctgatctgcctcctccttttcattccacttacggttactgtcctaccccagacaattacctagcctcttccccttgtctcttctcactccaatctatctgacaatactgatagattaatcttccacacacacagctctgataatatagctttgctattcaacgcacatacatgaatccggccttcaaagctctccttgcttcaggcaatctggctagctccttctttcctgtgctgggaacatgccttgtggattctgattgtgtgattttgctctcacttttgactttctctggactgtccttccctctttatggaaagactcataacttttatacaagacagctcaaacaacaataaaaatatgtgggttggttgtcataggaatatgtaagttgatgagaatctggagagcggaaacaaacaagaagtgccaaatccaggaatcattttaaaataaaaatttatttggtcactatctgttatggaggttctatgaaacatactacactgttatggaggttctatgaaacatgctacactgaggtagcacttagtccactgtcattactaaaagattttctgggggagtcaacatgagatttatctcaaaactatggatttcaattatacatgccacagcttttcttcattaactgaaataattaagaattgtctgcattttaaccatttactgtaactatttccctcttaatgccctgagccaaactgggttgagtgggtgaggaaaggtgggtggtagagacatggagcccctaatctggtctgttttcaccattgatgagcctgattcatctttgggatgtggatcacgaggattaaagatccaccacgtgcccaggatttcccagcaattagaagcaaagaaactagaatttgtatcttttatatatattttgtccttcagcccttctccagtgcttagagtaaaataaaatcccttaagtgcttgcttttttcagcaggagaatcctaatgatgagcagcatgtgatcaagcgattccttttccttcaagctgaggttgaagttcagtagcgaaggaagaaggaacaggcagctacagccctctggtcagcagcaccaactttctcacggagttaaattagtttgggttatggagagcctgaatctttagcccaggagaggtgaaagtgaatgagggagaggaaggcggtgagagacaaatggcaaaggtaaaagtgggctgggtgcagtggctcacaactgtaatcccagcactttgggaggctgaggcaggaggatcaagcgcttgagcctaggagtttgagaccagcttgggcaatatggtgagacctcttctcaacaaaatatttaaaaattaactgggcatggaggtgcatgcctgtagttctagctacttgggaggctgagatggaaaaatcacttaagcctgggaggtggagactacaatgaactgtgatggtgccactggactccagcctgagcaatagagggagaccctgtctcaaaaatatacatatttttttatttttaaaaaaggtaaaagtgtatcaaagcagtctgccttcactctgatactgagattatcaaccagtgctctgcagaccttccatgaaaactactgttaaagatgcagattgttaggcctcatctcaaacctactgaatcatggtctctagggggacagcctgggactgtgcatctttcatgggtacacccagcaattctgatacactcgaaagcaagtttgtctaacctgtgacccgcaggctgcatatagccaaggacagctttgaatgcagcccaacgcaaatttgtgaactttcttaaaacattatgagtttttttgtggtatttctttaagctcatcagctatcgttagtgttagtatatttcatgtgtggcccttcttccaatgtggcccagggaagccaaaagattggacacttgggctctaaagattgaggatcactgctctagtgttggccaactactctagtgttggcctgcagactcaatacagcctttgagctaaaaacggtttttacatttttaaagggttgtaaaaaaagacaaaaagaaagacagacaaggaaagacacagaagaatatacaacatagcctacaaagcatttactatctggtcttttacaaaagagttttctgacccctttctagtgcactgcaaatgaaaggctgtacccaaatttagctccagtgcagccctgccacagctgaaataactgatgtagcaagcagatcttaaaaaaaaaagtgatgaaatgtgtaaagttgtcatctaaaaatacttttgtaataattataaatggagagagaaaatgtataaatacaaacattctgtaatgagtttaaaaatatagtttcatccatacaagaattttgataactccatttgattctgtttttccataagcttatcagatagcaatatatccaacattagcctaataaaattactgcatgtgaattctttattggactatgcatattcccaaacatattattgtcatacaactgagggaaaaatgtaaaactatatctgggaaatgaaaaattataaattctcaaaatgatacataggaaaatgatttacaaagaaaaaaaggaaaactgaacttagtatctttctactttaaaggggttcaagaacttaggagtagttacacacctcctaaaatcttgaaaaagaggctatgaactcacttcacaaagggttcagatactcacattgtgtccaagagactcagcaattgggaatcttgccagttagattcataaagcaatccgaaagccagaatgcaatttctttaggggtggtttctagatgtttattctagatatttttaaaagattttgtttatttttgatgtgaagaaagaaaattattatagaatctagaaataaatattggctttaaaagtattaatttgccttgtcctttgtaattgtgatccgaaatatctcacaataattttgtttcagtgttattttcttctcaggaggaaaggaatgttaaaaccttactagcaactaacacttgataaagatttaaactatataacaattttaaagaaagtctaaaacaccagatagtcttgaaacctcgcatgcttcaccgtttaataaaattatgactcattttagtaagaacatgcttttttagtaagaaaaaatgctttctgagctaagtttgaactgctggggcacatgggacacccacaaacccagtcagcagaagtctcaaactcctaaaagattaaaggaaaaatacattagtgtgtacagagaatgaaaaaaaaatccccaatggttctaatctataaacggaagtaaaactaaaactcccctaaaatccccccagtcatcaatccttataaattcagcacttatcttcttcctttacttctggagaccctcattaaacaacacgaaagcctttgctgacttttatctcgtaaaatagagccctcaaatgacactaagcagggataccgacctccaaaatcacaaactgttttacttctaaaaccatgcatgcaaacgtggggtttcctgagttctgctaggggcgggctgtctggacccccgtgtatttttttttttttttttttttttttttttttttgcaggtgtgcaatccagggtgcgcgctctgtgcagggaggggagcagaggtgtgcggtgggcaccgcctgggccgggcggggcggggtgggtggggcccgggtgtgtgctggggtgagagtgaaggacatgtgacaatacgacggtggcggctgcaggatccgggaggggagtgaaagctccgctggggcgctccattagtgagcggtgatggttgccgcccacttgtattgaagcgtcctttgtcactaacaagttaaattagagatgttatttatttaagaagaaggaaaaaaaaccctagccaaacagcctatgaatacatatgctcacatcccctactcctccaactcctaatttccccgtctccagagggcacagttgtaaaccttgacgaaaatccaatcttctgtgcgggaatttccccccaccgcttgccgcccccgcgacagtgagtgggagctggaggagctctggtcccgctgcccgggagcacgcggagccgggcgaccgcggtgcggcagccagggaggaggggaggcggcgggactgggcgcgggcgggccgccgccgcgacccgggagcggggtttgctcaggaaaaggcgccgtcgcggcccccggccacccctccctggccccgggctccctgcccgcgcgcctcccgggcctcgcggcgcgctaggcgcaccgcggcggcgcgagcgccgaatgggagcggcgacccggccagcccggcagccccgcgggcggcagccagggcgaccgcggaggcggcgggcagggcgcgtgcgcactgcaggggcgccagatttggcgggagggggagtgtccaaagctctttgtttgatggcatctctgtttacagagtttacactttaatatcaacctgtttcctcctcctccttctcctcctcctccgtgacctcctcctcctctttctcctgagaaacttcgccccagcggtgcggagcgccctgcgcagccggggagggacgcaggcaggcggcgggcagcgggaggcggcagcccggtcggtccccgcggctctcggcggagccccgccgcccgccgcgccatggcccgaagaccccggcacaggtaacggggagccgggcgggcggccgagggcgggggcgggggcgcgcggggcgccaggctcccgggagcaggtgggaattcgttccgggatcatctgaggggctgtcagaccctccgaggacctggagcccctgcctcggcagcagaagccgctccagagactgatgaatggaagagtctttgcgggaaatgtatccggacgttgggaagcacgccctgcggctcattttgcaagttgcatggggatacatttttctttagggggaaaaagaaagcacgttccagccgagggcagagcggtgcccaccagccccggggagcccaccaggtgcctggcttgatgccgcgggtgtcggcgagggatccgcagcgtaattgctggatgcattgagatatgtttggacttggaagtgcagagcatatggcagatacagggaaaatgctggattgtttagtagctgcaggtagttcatttaaatttcattcattctttatggaggcgaggaccagtgtcagctgacaggcggctgaaaagcagattttagggggataaaggggtctctacttttgcaaattgtcttaagacctggttttggaggttcgaatcatttttctctgaaaggcttttacttccactgcaaacattgcacgcgcacccacacgcgccgccgtcgcacatgtcactgcacttagggaggctcgccgggaagatgggtgcagtcccttcacatttttggccggacagatgggaagagggagaggaggaggaggagggaaatcctcgtccgaactgtcagttgctcgttccccagtctccaccggcctctggactttcccagcagcacacgccggggctccctgcgagcggcgggtgccagggctagctcggcagccgtcgcagtcgccactcggctcaaggggacagaggccggcagcacccaaggccgctgccgcgcaaccgggacgcgatccccgcgggctctgcccccaggcgaaaggtccctgcgcggcgcgcacacgtggatgcggctgaggtcgccgcgccttctcgcaccctccttcagccgccttaggtcgccccggccgaggcgcggtgaccggacagatcctcgcgaaggagttctaaggcgaagtccatggaggcaaagcaaatccattcgcctttccttagattgtttgattttctcctactggtttgttgttgagcctgcgggcgctggtccccgcgcggcgctgggaagttgcaaagagcgtgggtggagaccctgcagcagcacccgcgggctgggctgggcggggagcagcgccggggcttggttgggctctggggacgagagggcgacttgggggagctccgggctccctatgcctactccggagcctggccgcgcaggacggtgtgctgcccctcgagggctccacttttcgcctttaggacttcacaggacagctaccggggtcatctgttttttttttttttttttttttcgagagctgaaactggcagcaggaggagggagtcgggcaggggtgctgggaggaggcgcggcagcggctccgcgccccgaggtctcggccgcccccgcggggcggggccgcgcaggttccctgaggctccaggtagcccagaggggaggcggctgggaggggcgggagccttgaacctgcctcaggggaagagaaacccgactgcgggctcggagccgtttcttgcaagggcgagcgtcaactcggcagggattatattaaccaggtcagcgaaatgagtttgaacccctccgaatcacagtagcggccacaaggcacttcctcccgctcccctccctcttcctaacccccagcacctcttttctttttcgtttctttgcacggtttgtttccttgacagaatgtaacattcatagttgtactcttgtaaccacaccgggtctagcaggtggggagtcgagtgcatcaaccctgaaatcagcctttgaaaatcctctgactgttgggtctgagatcttgtcagagcagataaaggaaaagttatttcaggttccttagtagaaattaatcatgcttctaggacgacttagagcaagcaaatcgcatgcaaagttcaaaggcgagcctgggtggccagcctggcagggaaactcaggagctgggcgcgtgagcagccccggactcgccctgctgcgtcctggccccttcaggtcctgcagaagtcactctccaccttgcccccaagaccttagttttgcacatctttgcctctgtgcttagcttttaagaggcacggaaggacatggcatggtcatgtattagcgctggaaagtaccttagaaataggatccaagcaagcccttattgtaaaggcgaggaactgaagtcttgagagagaggaagtgatttgtccaagtcatacagctaggtggaggctagactagaacctttgcctccagaaccctagtcctgttgattcccgtgctctcacctgacgttggctgccccctgcgggcggctgaataggttgcttgttcctgggttgttaaaccgctgcggagagagaggtgctcaatgactactctgaaaaatgtgctcagttctgaaaatgtgacctctagatccagccaaacctgaaaagttaattcgacttgaatctatgactgcagtttcagattcctctggttttcttggtgtctctcacatttcacaagggactgcatttggggtctttccaaggagttccctatgaatctttcaaaagatgcagacttacacctctgggctttatagctttttttttttttttttttttttgctttatcatatcgtgttttacatttttgtagttcttgttcagaagttgtttagtgcctcctgttgacagtggaaacagaactaggctattgtttcaaaacacagacactaaatgaaaggaattattacagattataaatatatatttcctgggattttatttggtggtggtggtattttaaatttggattacatcatgtcgccattcaacctggactatcagattgttgcttaaaataatagctttaaattatgagaacccccaattcaggatttttggtaagcacttcagcttcacttgtagggggctggtaatatgcataccagtgagttagtttgggaagacaaaacctgtaatgaatataacttttctttttaaaaacaatgatttacattatgatatggctttatatcattgtttttattggtcttagtttaatgggtttcccaacattgcaatgacaaattttagtgaagtttctaagatagtatttttcctattttaagttttataagaaaaactataaaataaaccgtgtctgtaaaattattgtcatctgatcagttgattagattaacaaacattatgattatgattaacaaacagtaagcatatagttacttcttcaaaagtcataaaatttcctaggttaggttaactaaataaaagaaaaagctttcgaaaatagtaatgggttcttttaaatccatggcttttttctggggaaatcccttctggattaggttacattttataatatttcaaacaccattccatcagagacagaaaaaacaagagtaagtaagactctgactaacaagtggcctaattattcacttagttactctagaaactaagtattgtaaacatgggcacaagttggatcaaccaggcctggagttgtgagcaatttggtattaattttatttacaaaacattaaagcttgatcactcaatgttcttatctttgctttggttttaaaatcctttcctcttagattctcctaatcctctagactttatgggatcactataattctgttttgcgctgtactacttcttgatttttttcttcttttaataaaacaaaaaccccattggaatagcatagttgaattgtttattatgtttgagaaatattatttaaacgatgtgacagatgccaaagattttgagtgtgcacttatataaaggacatgggttcttgttccttttcttatccttaaccttaagttttcaacttaaaccttcactggttggaaggtggccaaatgtgtaacttgtccctggtctaatagtaacagcaggttcagacatgcaggggaataggaaggtgccaggtccttggccgtgtctgtggatacccataacagcagaaccagtttacaatactagagcaacagaatgcagcaaacaatcttgttgtgcaagttttcaaagttttgtcttcataacctttgaaaagattgttgaggagttttgtgtaagttttgtaatccagtagtagtctaaatcctcttgtttcagcccacgtctacccattcttatttctgcagcatatatagcagtgacgaggatgatgaggactttgagatgtgtgaccatgactatgatgggctgcttcccaagtctggaaagcgtcacttggggaaaacaaggtggacccgggaagaggtaactaatcattttatcaagacgcagaaaatagatagagtgtataatttataaaaaacaaaatttcaactaaactacaggtgctcaagctcattagcaggctccttgagatcttatcctagcccgcatgtgcagcgtgccctatgccccccacttcattatattatccatttccacactatttgcagttctttgaatgtcctcttctcattttaggcttcatctgtgtttccttttgcctgttgagttctcatccttttgtcccacctcttcttcctacttttacattacccatgaaggcatcacctcttctgtgaagccatccctggcttcgccggacaggattggatgcatcctcctgtgatcccatgcatgggtgcatgttctactttattgttgctgggacatatatacctcctccagctgactgcaagtctgttgagggcagggctcttgtctattcatctttgtgtttcctgaattcacaaatgcttggacccaaaataggatattaataaatgttctctcaataagtgaatgacttgctactcccaaaaacaaaacaaacaaaagaataaaacaaaacactcagagaactcatctttttacagtgtattgatttaatatccttgatatacttaacagagccatctatatgaaggtatgttttaaaatcatccgataatggatggagacacatctgcttctcctgtttctttttcggctggcttatcaaaagtttgattttgtaggaatggaaaaatattttagaagcaaaattattaatatgtggagaaaagtttctctaatgttcttaaaatttttgcaactaattttagatgattcatgttacaataaatggtattggctcttcttcagtttcactgttctctgcttcatttaaaccagagctccttttaacaggcaggtaggattcccagagaggcccataggaaattcatattttacctattaagattatccacttggataatccttatgatacggaaattctgttgtcaacattggtttcctaattcttgtgtctgtattgtaccagggacctccactgtgtgtgaatgttacctttgcagaaacataagaaggaatgcatttatatacttatgaactggtaggattgtgaacagcatataaactaaaagaactgattagctggaaatgtttaatgtcttttatgttctaacacatctggcctatctaaatctaactgattttcttatatagctttcaaatttaattttaaaaatggtctttatttctttataaaaagttaaactaactggaaatattctatttcttgctcaagatcctatttattaccataggtaaatgtgtactgaatctagcactggaatgcattttttcctaacagagtaaagcagttatttataataaacactcaatatatgccaggcattatgataaatgttttgcaaaattgcctcatgtaatccccaaataaccctgttaatatcagcctcatgttaataaattgccccatgtaatccccaaataaccctgttaatttccattttatagatggcaatactaaggcccagaaaggtaaaatggtatacccgctttacacaattaatagttgagtcaagatgccaactctggtctgattctaaataaatctatactcccaagtccgtatattacattaatatctcctgtattcggatactttagagagactttttattctagattcgttccctcattcactttaacttgaacagagttatatagtaaataactgatatcctaggattacctttaaatgtcttaggatgaaaaactgaagaagctggtggaacagaatggaacagatgactggaaagttattgccaattatctcccggtaagttagtaagtttttcttataacgaaaggaaagcttctcccaaagatttctataaaatattctaggaggagttattaagatagtgtataatttactcacatttaagaagtgggagaaatgccctacccataacttatattttatattataatgcatataattaaattattagaatttagattattagaatcgattattataatttagattatcaaattttaaaaacagttgcttcttgttttatcttttcatttataggataattagtattttgatgatttgttacatggtagttgattaaacttgatatttcctccaagtcagtttttcctgaattccctatttttgtcaatagcaatacttttggcaccaaggtttaaaattctgaagacctttcttgacttatcacattcccccaacccctacatctaagcagttactaaggaccctggaattcctttatagtcagtcccgtccttttcattctcatggctgtgctgaaggttgggctcctgccctctcatttggactatcatataacttcctaactggcttccccacttgtagttttccatttttctttcttttttttttttttgttttttgttttttgttttttgagatggaatctagctttgttgcccaggctggagtgcagtggcacgatctcagctcactgcaacctccgcctcccaggttcaagcgattctcgtgcctcagcccccttagtagatgggatcacaggtgcccgccaccatgcctggctaatttttgtatttttagtagagacaaggtttcaccatattgatcaggctggtcccaaactcctgacctcaagtgatctgcccacctcagcctcccgaagtgctaggattgcaggcatgagccaccgtgcccagccagtcttctacttttccattcatcccaaacaccattggcaggtggaacttcctaaaatgcagctgtaccttatcttttcaaaaccaaccacagtgacagaatctcacaaattaagtaaactgccttgacttggcacacagaggccctcctctattgccccaacttacagctccagttctgtttcctgcttcctctctctaagcaggtttgcttgaatttatttctgctttacctcctctgggcttttgctcctggtcttcccacctcctagaatattctccctttatgtcaccaattaaagttctgtccatccttcaaagtccttatgaagagctcttcaagactcctcccaaggaaaccatttctcctcctaagaagatgcttctctcctcacttcagtatcattttgctttggtcttttcttccaagtgaatcaaattcagcatctgtgatagtcagtcatctacttgtcttttccttcttataagtttacaaactcctgtaacataggacctatcttttatgcatcttttttctttctgcaatataaatactttggtcctggattgaagcacatctcttgtctgaatgggaagcaaactttagtcttttagggtggtttccatgaaagcctgacaacatagaatctctatcaagcctcaggctatgtagatactctgcaaaagtatctgaggttaaggttaacttggcaggcacatgtgtagtatgatggtcctttagatcatgtggcaggaatgtttccctcaggaggcagagtgtctaattttagatgcaactttgatatattacttgcatgttctgtagcctgtaagtaatgagggatagatgggctctaaacatgctctaaaatgttcttaaatattttcactgcatatggtctatgtgtgattcctattacaacaaaaaattcacgtgcttatcacatcatatctttatggtggtgcatactttatttgtctagaatcgaacagatgtgcagtgccagcaccgatggcagaaagtactaaaccctgagctcatcaagggtccttggaccaaagaagaagatcagagagtaagttctttcttcattggtgtgtgactcataattaagaatattcccaaaatgctaatattttcctatttgaggaagcaggtaaaatgggcaaacaggaagtagaggactctattcccatatttccagtgaatgaaagcaaattttggaaattttctaaagatcttgtaacactgaagaatgattatactgactcattacataactttaaaacataggttatttttgtgtgtttatctgaaggtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacggtaataatatgtcaaaaaatatattgatcgggaagaatgagggagtgggtattgaacattctgctttaaatgtatggtgagtaaattatatttcatcagtcgtaagtgttttattagataaaccagctacatagcttttagagattgaagacatcttagagtttatttggttgagaacttccaggatccacctgacagtgagccctgggtgaagacatttagctttccccagcctcaatttccccatttccaaaatgaatcatacagggccagtgttaggatcaagtaaaatgaatgtcaaaggacttggtaaactataaaactctaaatgcatagaaagaaactgaagacagtttgtctctggcagttcacgtagctggttaagttactcaaaggaactcagctaccattttcctgataaccatcattcatttcttttattttttttaattattattttttagagacagaggcttgttctgtcacacatgagtgacagagtgcagtggcatgatcatagctcaatacatccttgaactcctgggctcaagggatcctcccacctcagcttcttgagtagctaggactacaggtgcaccccactacacccagctgattttaaaatattttttgtagagatggaatcctgctatgttacccaggctggtatcaaactcctggcctcaaacaatcctttcacctcccaaagtgctgggattataggcatgggccaccatacctggccaccagtattcatttcattataccactttgcttaattttttacttcattgattaaagaaataatgtatttcttgaattctcatactacttccaggtttttaaataatgtcagggtaataatgctttctttttaatgaacaaggcaagaaaatgacctcattatgagggataactatggaagctcattttgtcccatttttcccacttaagtagtatataacagattttgttcctttggaaagcaatacttttaatgataaatcttgcattaaaatgatgtagatcaaaaatattaaaaatagttttattcttgagcttcataatccaggagaaagtttatatagtattctctagtgatgctccaaagcatttgcacccttgtggttcagtataaacttagaaattttaagaggttggtaaaaaaaggcctttcctcccatatggcctgagaggatacactgctgattcttctcaaaattaacagggctattgaacttcctctttctttagcatacattcccccacccccattgaaatagaaaaagggagacttaaacggtttttttgaattgagaaactgttttcctgagaatggaaagactttagtaaaaatgcgttgccttttgaaaatatactgggggttaggatctttccctttgggatcccattttccactctcgtctctgtctgattcagaaaacaattggggtggctttcaaagagtaggaggttttttggtctcagaagttctcactagtgctttgagagataaagagtgaagtattcttcatcagcagcatcttatcatccaccagacttcaccatgtccctctcgtggtgtgtaggccctgctgtgccacattcaaaggagtaatttccccaaggcagctggaactttacattgtgttggagtcttgtaccgcgaccggtcagaataaacatgaagcgttatcgtattgaaaatactcctttaccaaggaaatggaatggttaaaagatactgatatttctagaaaacgacatgcattccagattgtgtaactaagagaaatctaactaggcaatagagaaagcctgatctcagagggtggagaagaaggaaacaattaaaaagagaaaacaactaataggcccaagggaaaggtctctgttagaaacagttttctgtcaattcactttaatctgaattgaaatttttgtttgtgaaatttgtgtgatatatttctgtgcagaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtaagccattcctgtgaatctagtttaatgagagagacggttagtttagctccaggtaataatcatactttgcagttgtatacttttcagagaactttcctgagcatgatcatggccagtcttcacctatgccctttgaagtagatagggtgtaggtatggtgtgttacccctggtttatgtctccagaaacgaggatggtaagcgctttgcccagggtgacacagctcatagagatagtgctgactagaaaacgagctgtccgattctaaattgctgcttcaaatctaatttgaaggcaacctttgaatgtaaatttacttaaggtactattgaagaataggggaatggagtcgcatttgtagatgtaatgtttttctcttccaaaacgaaaagggaaggtagtattatgtttaaagaggagagagtttgacactgaaattcagtggttatggtatgtttcattctggcagtgatcaggcagacatgtcttaatttattcactcagtaagtgtttaccttcttactctgagtcaggagcagaactttgtgacattcattttctgatgtctccttttagtctccgttggatcagtgtgatcccttccttatttctagatatttatatttagggaaagtgataatccataataggtggaaaaagaagaagaaagaggaaaaaaatcgagaaactttaatcttaagaataacaatattaaatgataaaacttacccaagaatagagagctcatatgcaaattatatgcaaaacatgttcataaatagtttttattcttctctgtccatggatttgactacaaactttacagaaaggtctcagatgaataaattatcataagaattcctgtgctttttattaaaactcaaaattattccaagaaaaatatttttatttacaaacagctggtgccatcaatttttcccatagaaacaattttgaaacattcattaatgtattttataatatattttttattgtttttttcattgtgtttttctctaattaaggaacacttcccaaaatttaaagtgctcatcaacacctcccaaggatttttcaccatgttcctttagctgtttagccattttaaaggcctggctaaatttcacattaaaaggttttaaaaatttgtttagtgtattttatcagtaaagtgttttttttctctcagtcccagaacgaaacctcaggaagccaagtcccctgaagcatatgtagccctgaatgacgtggcctttgttttgtcttttgcatctaggtctccagtcatgttccataccctgtagcgttacatgtaaatatagtcaatgtccctcagccagctgccgcagccattcaggtaagatcattgatcattcactgttcaaagcaccacttttaagaaatgcttatttctttcatctaaacacatatttttacctgagcaactaaagtaaaaaggaaagggaacatggagaggagagcagagtcttggccagcaatctattaatcttgtcttctagaatgagtttgctctggaattttctgattctttgatgttgcaaggtgaaataactcatcagtcagcatccactctagcctgagatttcacatcactcccttaagtctgaaataacattcacaaagatttctgcaggagccaaatttggttggtggtgttgtcacagtgaggctctttgggctgtgcggcacctcatgaccatattggctacacccattgtatttgcagcttccaatcagacctttgtctttatttcccttactttgtaatttcagagacactataatgatgaagaccctgagaaggaaaagcgaataaaggaattagaattgctcctaatgtcaaccgagaatgagctaaaaggacagcaggtgctaccagtaagactgtcatcatgtgcttgaatgaggggatagcagctttgcctcagtttacctaagcgctcttctcttctaaatattacacttagcaaggctccatatatccattcagaatgtctcaacacaagaagttgcttgtagtaaaatgtagttggtatcagattatatgctgattaaattggaagcagtctttttgtaattgcaataaaaatgcaatatccacttatgattgttatcatcaatttttttcttcagaaggactataatcagtttaaagactagcaaagataaaatgaatgaaaatctgcattttctacagagctatgtatctatatggtaccattttggtttttttctattattttgttaacctatattttcatattttataatttcagacatgatttgatgcatgttcagtatatacatgtaaaaggttatatataaaacctcttcataaataacattagctgctctcttttatttgcatgtgtgaaagttatgtgggccattactgaattctgacatctttagcgactgggcagccaactgggatggctccttgtgctttgcaacatacatagttaaccaacaaagacaataaaagagaagtgatgcccagtaggtattcctaggggtaaatttattttttgttaaataataagatgtttatgtgcacatgctagttcgaccactttttaactttagttaatgttttgcaatttctcctgttgtgtggtcatactgtaaggagacttctgttaatttgctcttctgctttcctaaccacgttgatttggcagtgcttcactgcatcagtgcaatctgtagcattagaaagggatagaagcaacaagaatatgtgtagatcaaagcaactctaactcctgagtcctctagcttttttgtggttagaatgcaaataggacagttcttcagttcttcactcacagcaagcatttatggacctttggcaaattatattaaagtggaattttaagacaatatgataattatacttcgaaatatagacctatgatttgacatttttacaaaatgataacaaggtaatcatataggtacaacctctagcactattaaaaacagggtcttgcattgataaaaggaaacatcttgacaactgtttcataggcgtaagtttgggatgatgcaactactcttatctttcctccaacagcatctgataccttgtgcaacttcattgctaagttccttctccctttcttctgtcctctctttatttctacacccttcccccttccttagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgtaagtagaattgtgaagggaagttaacgattctggaagataaattagaaaacccatttcttaaatcattgccattttctatagccaagctgttattagcatatattaatgtaaaggtagaagtatgattttcatcttcatgaatatgttttttcaaagatctgatttcatagcctaccgagagagacaaaagtatttataaatacttacaaaataggacttttgaaggaagagttttttttcacattttcacacttttccttcaaaagtcatatttttaaaaatagtcagattgatgacttataaagcagagcttggattatgggaacggaatggtgtttgagttacttttaacttttttttttctttgcttacttcatggtgcttctctagaattttgtcttgcttttgaacagcacattaatgatttggcttactcagagctgaaagcaatcttttagtgtatttgaagtaataatcagctccttggtcatacctggctctttccacaaaatggtgattattgattactggtcccattgcttcactgagatgaatcatctttcgtgaaacaaatttgtattcagcacctcctcagcgaacacttggttcctttcccagttgattaaaaatcatttattgcacactcattggttaggagatgaccattgccgtaatatgccatctagaaaaggtcttcattttgctttccattgcatgcagatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcaggtgatgatggcacacactatctcaaagttctgtgcctcccacattgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcaggtagaacacaatttctgcacagctgttactcattttcaacagacacctgagccttaataatctagaaactaatacttcggaacaaatgactaattactgctgcctttgctgatttcattctgtcgttgaatctagctgttgctaagttatactgcctcccaaagtttaggctgtctgcaggctaactgttgattttggcatcattctctctcttttacttttgggtggttttgaaagatagttgcatgaaacgtacttttatttccttcaacactagagtttaacatttctgtccctttctttttctcccatctgatccctccctttaaaattgttaacatcatttcttcctcgttgttcatttattcttatgcgattcactgacccaggggaggagggaaccaaattgtgtttatataacatttgggttgcaactagaaaatttaaagctagaaaatttaaaggttccaattcatctttaaatggaagagtttgggaagaggatgagaaacaaatgcttaaggaaaagaacatatttttaatttcagtttctcaacattggctcttttgagttgtgccatactattttactagtgcagtttttgccaaggaatatttttatttcatacagcttttttaaggcatgaaaatcacaattcttatcagagatttgtgttcctaaattatttaaataattaaattaatagataatttggcactttaaaacatttttccaattgtatctgttgaatttgttttaagaacagatttaggtatgatataggtatatacatttgggaaacactgaatcaaacaaagttacaagtaggtttcttagctgggcatagtggcatgggcctgtagtcctagctactggggaagctaaggcaagaggattgcttaagcacaggagttcaagttcagcctggtgaacatagcgagatcccatttctttaaaaactttcttttttttaactgcaggccttctcagagttattaatatgccgttgtgccttgtgaatttccaggaggagattatgatatgttgtgtttcccaaatttattttaccttggaattgtttaaggaacacctagttttttcccagaactttagtgttctgagagacacagtttattattcaagaattttccatataatgtaaaccttctgtaatactaattttggttcatagattattaaagagaaaaaacaaagtatgaaaggaaactattaattattaactattattttccccaaaatcactaaagccttttaaatgttaataaagaacacatctcattctctttaatgacaagtgtcatttattgagagtattttctcacagttttgcaagtttttcagcaatgaccctaaattttatttcttggaaaccacacccaaatcctgggtgctcaattgaaataaaacaataccctagtcaatataacatgcttgttagcatctttattatttaatatagtgggtcaggaaaacattcttgttatctaggtgtgatttttaaattggggagaataaagaattaccatctaatctaagtattttttctttctctccatatttagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtgtaagtctttggttcaggaataaaatgatttatcttatttacttatatttaattaatggaatatagttcccagatgtctgatccacttgtatgtgcataattttactgaccatttatatataatcatgtctattcccacattgaatatatctgtcctgggcatattacaactacctacaggtagaagatgggaagataaactagattccttttgtaacttactccaaaatttcctatatatgcacaagtagttttcataaaacttttccattcggtttgtttgttccctccataaggccttcttatgaaagccagattttcaacctcctttcctctctaattgtaagcttcagaataagaacgagtatggtttcttacctagtttgtatttttatttaattttatttgtttattatttatttatttttagtttgtattttttaatcttattttttctttttgaatttatgtgtagataggacctcttctgacatccccaggaatattatatgattagaagccaagggatgagtaagcagtcatttttattcaataaagccttaatcaattcagagaaatggtagagaaagtgtgaattatcagaaaccttgaaaagaaatgcactgttatttcgaagtacaaaaagtaaattttaaaagtttaacatgttttgtagtatgggctctgttttcatgaatagggaaacctgatttgtaaatgacatcaggtcttcttgatgctcatagtcttatacagatcataggcactacatgtgtcttcagagccattaaggaaagatgttaaatcatttaatgcttttagtcttcgaggtataatattttgaaatatttgaaaatatgtgatatgcatattctctttttcttaacgaataacgtgattaatcagcacaccccaattccatatccggaacagagtttattgtattcagtggaaaaatgttaaatgtaacaggtaaagccatgtagggacatttattcttttgtattgagccactgcttgttttctttttaaagttttagaaccccagctatcaaaaggtcaatcttagaaagctctccaagaactcctacaccattcaaacatgcacttgcagctcaagaaattaaatacggtcccctgaagatgctagtaagttctagaaaagtttttggatttcattggtttattagtcccattaggagttctctctgatgcaaaaatacccactcttccgtttagcctcagacaccctctcatctagtagaagatctgcaggatgtgatcaaacaggaatctgatgaatctggaattgttgctgagtttcaagaaaatggaccacccttactgaagaaaatcaaacaagaggtaaacacgcaaccctttggaagcaacaagctgagaatcctgccccctttattccttgtgtgcagcttgatgtgtctgccattggcactgtgcaacaccacgacttttcgtgcaagattttcatacaaggtgcagcgaaaaggtactgccagactgtaggcatcatcaacctttcctttgggaagccaagccatctctatctacttcatgtttggacagaaaacatactagagagtatcaagaaaagggagggaaagaggtttttaatgtacttttaaacattactgattatataaagttgatatttcatttttagatgtgaagaattggaatttaaattaaaataatagtatctttaattaattgtattaaaaaaagggaggctgggcgcggtggctcatacctgtaatcccagcactttgggaggctgaggtgggcagatcacaaggtcaggagttcgagatcatcctggctaacatggtgaaaccccgtatccactaaaaatacaaaaaaattagctgggtttggtggcgggcgcctgtagtcccagctactcaggagtctgaagcaggattatggtgtgaacccgggaggcagatcttgcagtgagccaagatcgtaccactgcactccagcctgggagacagcaagactccgtctcaaaaaaaataaaaattaaaattaaaaaagagaatctaacctgcaaggatcaaagttttagcttgttggcaacagctgttttccaccaggttagatacagtgcttcttgaatttattttcatgtaaagataagtatttttttttatagctaaaaatctgatttgattatttagtaatggagaattttaccagaatgtgattaaaaaccagtcttttgtcaccaaaagatcttttatgtcaccaaaataaaatccttgacggatacaacactactaggtgtatcattaaaatatattcttaatagaataaacacctagaatcagaacattggttgaaaacgtaggagctttacaggggcagtaaatttggagctagtcacatttcaaatttgccatcagtgtttctttgttgaatccagaagatagagcaaattgagctgatagtgtaagttagcaacatagttttataaaagtatttgagggactggccagaaatatactcctgactgtacatgtttcataggaagttctagaaacaacaaagcactttctatatgcttttaggtggaatctccaactgataaatcaggaaacttcttctgctcacaccactgggaaggggacagtctgaatacccaactgttcacgcagacctcgcctgtggcagatgcaccggtaagtacgtgtgcaccagcccccaagttgttatgtgacactggtgcctcatgaaatcctgtgtgtggcatagggctgctgcggtttcagcactccctctttaacacatcttatttctaaatgttctcctgcacatgatttttaaaaaatgattattaatgtagagtataaagttgagattttttcatgtattagaaacattgcagactttttcattatttgttttctcattatttgagtgccttggccatttaaaaaaatctacatggatataaaaactatgttcatttatatattttcctttatttgtcttctaaataatattgtcttcttgttaagttgtctcttgtttggtttgtgtagcatctcatatggtatcaaccacgttgtctatagtagatgcccagtattgtacccaattgctttgggttactaccaccatttttaaagtttataatttgtgaagggttgtccttatgtcttaaggaaaatcagagctaataacagctgctaagatttatttagtaggtactaagtggtaagtactgctctaggggctttcgatgaattgattcagttaattctcacaattatcctgtaaggttggtattatttttattaatttttattttttttgagacggagtttcgctcttgttgcccagactggagtgcaatggcacgatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtgagccaccgcgcccggccaggtgggtattattatcatttctattatgtcaactggaaaacagaggcacaaagaggcttagtcatttgctcaagattgtatacctaataagggatggtgctgggttggaactcagaaggtcttgttctaaattccctacttttcaccattttttgccaataatttatagctctaaaatattgatagttctgtaccaatatatgaaataaagtgttctctccccagaacttagtaaatcttctattttgaaaggcatgtatttattaattcatttagcagatgttttttgagtgcctaacacatgcctagaactctgggatcccaaaggagctttgtgttgtggtgatgtttgccacaatgggattaaggttcagacatagttgatttctccttttagctcatagtggggagaatttctggcagatgactgcatttttttatgctaatgtgtatcatctcatagtaatctactctccacagtgttagaaaaatgtggctctcatattatccaacctcatttaaatttcaaattattctcttccctttagaatattcttacaagctccgttttaatggcaccagcatcagaagatgaagacaatgttctcaaagcatttacagtacctaaaaacaggtccctggcgagccccttgcaggtaattactattccaacattggtattttaaaattcattcactgaaaaactgtcatctttggtggtggtggtggtggtggtgatggtagtgctggtggtctgtttttcgttttcaacattttagacataggggagtaatgcttttatacaattcttgatgtctagaaaaatccaataattcctttttgctactcatatgagacatgctagaaatttttatcagtgcagattccccaaagcatgatgaaatgaaacatttcttactgtgactgagactaagatgtattacacgtgtgtcactatcttcttctgccctcaaatgttttataaaaatatatcaatatagtttactttatgttccaaattttttattttttatgctgtatccctaggcaaccaaagctcagagactgttccaattttaaatgaagtctgaaattagtcagacagaaaataattgcaatgtatttgactgtcagaataagaaagtcaactgtcaatgttgtgaggccgatctgaagttgaccatctgctgtcaggttttaatatcaaaagagatttcccttgtaaccctaaagtgggtgtgtgttgatgaaatataaccaattccaaattaatcctgagccaaatgtaaataagaatgcaaattttgcttccctaaattatttaaagcagtttctgacattaaatagcccaatacccagccacctgcagagccctctcctccatccccctgtgccatgcagagggaaacttcataaccctagaggaagtgaagagcctggattcagaagctgaaggtcatatttcttgctgtaagttaaatggcacgatcataggacagcagcctttgagtctgcccattaccttaaagggatttcccattcttgtgatagtttctccttccaaattgtgagaatctgaaaacttgcccggtaagtatttgtgatgcttagtttttcagggttttttgttgatgttgctttgttttttgaaacagggtcttacccggtggcccaggctggagtgtagtggggtgatctcggctcactgcaacctccgcctcccagattcaagtgattcttatgcctcagcctcccaattagctggaattacaggtgtgagccaccggcaacccagccgtttttttgtatttttggatagagacaaggttttgccatgttggccaggcaggtctcgaattcctggtttcaagtgatctgcccacctcggcctcctacagtgctgggattacaggtgtgagctaccgcacctagccagtgcgtagtattattgtaaaataaggattgcaagcacattttgtttaattaaatcagattgcttccttcctggcctctctctgacagcaattgttttggtaaaatggctgtggactggaatgtgagacagggagtcagtatttatggggaatctggacaagttcctgcgtcagtgaggctggagttggccccgtgtggagaagactcagaataccacaaagaggccagacgcagtggctcatgcctgtaatcccagcactttgggaggccaaggcgggtggataacttgaggtcaggagtttgagaccagcctggccaacacggtgaaaccccatctctactaatcccagctactcgggaggctgagacaggaggatcgcttgaacccaggaggcagaggctgcagtgagccgagatcatgacactgcactccagcctgggtgacagaatgagactccatctcaaaaaaaagaatatcacaaataattgggagatgaggaagagaatgaactccacccagacataagaggaacccagaaagggagttacaaagatttcaaggcaaagggcagccatttcaaaattttcctgaaagctgttcttaggtccagaagaaaagcttttgcttttttttttttttttaattattcccacctaagttacttggctcttggtttctagagaacagaattcaactactgctattcgtgttttaattaagttagattaagttttgcatatattttctaacctagtctggggccaacttgtatttgtagtagtacagaaaaagtctgttctaaatttcaaaaagccaacacatcaatatacttggggacaattaccattacataagttgaaacccatagttcagtattgagctttatcagtatatttgtattttatttaatggaaatattggttatctttgaaactcaaaattaagttatagctctattttattaatctgtattctcctgtctatcagtgagtcatattggcactttatgaattctaacatctgtacactgagattaagttgtgtatggtgaaggtaatatttgtcaattctatcaaactgaataattgagacttgaaagttaattttagagtcaatactcctgtctaaaccatatagtttactggtttacactgaccagatatattttaataatctgctataaagccaggctcagtggctcatgcctgtaatcacaatactttgggaagccaagactggaggatagcttgagaccaggaatttgagaccagcctgggcaacatagtgagactcagtctctattaaaaaataattagctgggctgggcgtggtggctcacgcctgtaatcccagcacttttggaggccgaggtgggcggatcacgaggtcaggagatcgagaccatcctggctaacacggtgaaaccccgtctctactaaaaatacaaaaaaattagccgggcgtagtggcgggcacctgtagtcccagctacttgggaggctgaggcaggagaatggcatgaacccaggaggcggagcttgcagtgagctgagatagcgccactacactccggcctgggtgactgagcgagactccatctcaaaaaaaaaaaaaaaaaaaaaaataataataataataataataattagctgggtgtagtggtacatacctgtaatcctagctacttgggaggctagggcaggaggatcccttaagcccaggagttcaaggttacagtgagctatgattatacccctgcactctagcctgggagacaagaccaagaccttgtctctaaaaaaaattttttaaggccagccgtggtggctcacacctgtaatcccagcactttgggaggcagaggcgggtggatcacaaggtcaggagtttgagaccaacctggccaacatggtgaaactctgtctttactaaaaatacaaaaaatagccaggcgtggtggtgcgcacatgtaatcccagctacttgggaggctgcggcaggagaattgcttgaacccaggaggtgaaagttgcagtgagcccagatcgtgccattgaactccagcctaggcaatagagtgagactctatctcaaacaaacaaacaaaaatttaatctgctataatagatactaatttattttaagaaatacttagtgaatgttgttctacatacttgccaattgggaggaaaaaagaaatattcactaaatgaatgaatgttatacaccaagtatctccttcattttatgtcatggagttctagcttctgatatcacagaaatatgtgatttctaaaatgtttcagactattgtgataagtattggaaaatgcatcaagtgactctaaatatttaaacatacatcacctatatttcatataatcctgattcaataatatttctatagattttttatgcaatttggtaattttgtttgtttgaaacacagtgctatttcatatatttctattgataatccaatttgacctaattaggcatatttctcacacatggtattattgaacatattgcacatttattaaatgatatgtattttacttaagagtactttatataatctataatttttgtaatttgtacttataataaatcaaatattaagtgggattttagccaaaccatctagacatttttgtcataatgtttttattaaaacagcaaaataggagtttcaaaatattttaaaatttgaatacttctaaaatgtaaaatgtttgcaactggtgtaatgcagttgattgtctatccctctaaactgtctaaataacttaggttcaagaacagtttattgaagaacataggaactgcgcaattctgtgttttatcatttcagttttaatcaccccggcttgattatggcaacaacattttagacaagcaattattactatttttgaggcccatatactgggccattatggttttgcttctaacgtacatataaatgcacatgcaatatatataaattatgtttgctgttttaaaattagaaatgccgagaagctatgtgtttgacattttattataaattttgtacacacatagatgtatggaaaatatactatgttctagagtcaacaattgttatcattttgccatatttacctcatctctttttttttttttttgagatgaaatctcattctgttgcccaggctggggtgcagtgacgcaatctcagctcactgtaacctctgcctcccaggttcaagcaattctcctgcctcagtcccctgagtagctgggactacagatatctgcctggctaatttttgtatttttagtagagatagggtttctccatgttggctaggctggtctcgaactgctgacctcaagtgatccacctgcctcggcctcccaaagtgctgggattatagatgtgagccaccacgcctgggctacctcatctcttttttatgaagtttttatttttattttttaattttttttttaatttttttttttttttgagacagcgtcttgttctgtcacccaggctggagtgcagtggcatgatctcggctcactgcaacctccacctcttgggttcaagtgattcttctgccttagcctctcgagtagctgggactacaggcgcttgtcaccatgctagctaatttttggtatttttagtagggacggggtttcaccgtgttagccaggatggtctcaatctcctgacctcatgatcggcccgccttggcctaccaaagtgctgggattacagacatgagccactgcacccggccagttttttattttttatttttttgagacaaggccttgctctgtcacccaggctggagtgcagtggcaagatcatggctcactgcagcctacctcctggactcaagcaatcctcctccctcagcctcctgagtagctgggactataggcacatgccaccatgcccagctagtttttttttttttttttagagatggggtctccctgtgttgcccagcctggcctcaaactcctgggctcaagcaatccttctgccttgacctcccaaagtgctgggattacaggcaggagccaccctgcccagcctgaagtattttaaagtaaattccaactaatataacattttattctcatgtacttccagatgtgtctctaaaaatagacatttttatatataacctaataccatcattacatatttaacaataattctttaatcttctcattctcaggtatatttaaattttcccattaatccaaaaaagaatcaaaattgaaacaatttcacacattgcatttggttaagcctcttaaatctcttttactctctagtccagtgctgtctaatagaacttctacagtgatgtgaaggaaatatctaatatgctgctatccactatgatagccagtggcttttgagcacttgaaatatggcaagtgctgctgaggagcagaattttcaatttgaattaatttaagttgctttaatttaatagccacatttccttactctcttactggaatcagccatttccccatggtgctctgaatcctcttagtgagaaatggtacatagacaccaaaatcagggtgctaagtctgtccattgttatgtggtttgtcattgagatacaaataattttttttgttttgttttgagacagagtctcactctgtcacccaggctgcagtgcagtggtacaatcttggcttactgcaacctccacctccttggtccaagctattctcctgcctcagtttcccaagtagttgggattacaggcacccaccaccacactcagctaattttcgtatttttagtagagacatggtttcaccatgttggccaggccaggctcaaactcccaacctcaggtgatctgcctgtctcagcctcccaaagtgctaggattacaggcgtgagctgccacacctagccaagactcagtgaattttaataatccagagctctccatgtatcccctaatctataatctacagtgcttaaatagaggcttttataagccattatgtacactcatgttatgtttgtttttttaattacttagtctttttccaaaaggaatttgcaacagctacataatcttataattgttatgtttcttttatattttcacagttgttttaattttaaattgtaaaagcaaacaggatattcttataataaaaatgttctgagatgtttttcatatttgtgtctttcatgtggctcagaatatatgagattttcatgtcatatcattgtcagtattcagccttttctccacattgtgtggggtagaggatagagtctagaagcttataaaatggtcacaaatgaggaagtagagaaaacattcagcctagaaagcgtgcatttgtggtatgaaaggcactgtggaatgctgctggattctgcccttcagtagttacccgagagagaccgaggcagacgcatagctccctcctcagcaaggagaaaagagttgcctgctttcctcagcgtgctttccatttcctttgttttgaaaaaagcacattatgctaatcaactttccttaaggtagacatttttattggtagatcaaaaaccgtgctttaagttataagccttctgaacttctgtatttttctcttaaattataatttccttttattcctatttaaaacccaagtgtaaaagatgtgttcataggctttctactcactcacttgcctctttttcgtaaccacagaatgacagccttaaattttaatttcctgacttggcttgcccatggcctgacttttttaaaacaaggagtttaagttaaagaaatttctccagccattattatttaaacacatttacacagtatcaaagaatttaaaaatgttgctagcagttgatactcccctcagctttcggttcagcgtgttttagattgctcctattttgttatttgtctatgaacttttatatttttcaaaaaaataaggcaagccctttttgcctgataggcactgctgagcagtataataaacaagcatgggggcaacagaacctgggttccaggctagactccactgttttcaaacggcatgactttaattcatcaagtgaacacaattaagcaaagtataagtttgggaccatggaatatccttcactcatcacacaggttactgtgaagatcaaatggatataatattgctttcaagatggcggcacacttgccactatacacaggtgatattattaggcagagtcgccacatagtccctgtccttgaaatgcaggcaaggagccctcaccaaaggccagggtggttttttgtttttcgggtttttgtttgtttttttcattgtggtatattatttcctctggcatgctattccctgtcccactcttacagaactgtgtcagtgggtcaccaaaagagagagctgattcaactgattccttgaaataaaggtagtcagacctcgcggtatgatggagatgaagcaactgatttactggttttctctatttttctgctgttcgtgttgtcatttaaacagacatggaaaccgtctgcacacgacagagatctttccgagcctttttcatctagtgtgctgtgctgacccgctcccctggatgcctgcacactcatttggttctcccttttggtcacttttttccacttaccctggcagaaattcacgtggctgtcagtagtaattcagtgacctgctttcaaaaaatgttataaattaagcagcttttctgtgtatagcttttgggttgaactgagaagggctaagtgaagggagaagctatgttgagctcagagtcagaatgccctgccccagacattttgagatgtgaatttttcatttgttttgtttggtgacacttagagagaataaacattctgagataaaaatcttccttgggcaggccagcaaagatagaattgctttagagcaatttggcacttggtcttaatcttaatagtttggaactcatatgtgactaaggaaaaggatattgcaaaaagttgtgccaccctaggctatatgatataaacttagaaagtctatcaacgtgaaaggtgaagagacctctagagacatcggggacaaactccaaatttgggaaaggtccatccacatttgcaattgttagttaggcttgggaagtggagtcattggtggatgaggcaacttccaatcaccatctcgatttttatttccctaacttttaagattattttctatagaaaatcagtagtgctgaagttggagtcatttaattgatttgtgccaacctagggaagcatttactctcgagaaaagtttggtaaccattaatcttaccttagcaacatttcagtttaagcttatctctgactttccaaagacaactaaagatttctacagtctctcttataactgatccattttttcaaaagatgtccctttgggaaggaattctcatttttagaattttagtccagaggaagtatttttttttcagataggtgaaatagaataagcagaaaattcttattttttactgttttatataccattgatgcctgcttattttaaaacaaaacacaataaaaacatgataccatctgatgagttgctttggttttactttttttttttttttttttttttttttttttttagtttatacaagtttcttattaggtcagcaaattgtaaaacacataatttgccaaggcttttgaagccagcagatactgggtgaagttgctgtatgaatataataataagaaccgtttttgttcagcttgatgaaaaaactattcatgttctaaatgaaaatgtgaagatcatctaattctgacagaaaaccacctgtggacatggtcttgtttctttttatttcttctgttttctacaaaagatggcaatatttatttaaagtgctttaacaggatatcccagttaaagctttgacagactgtttatagttcacttctgcccaggggcaattaaaggcacattacaggataagcgagatgactccccggccacaggaggaggatgtgtgggtaggattattaatgttgaaatgaattatgatagagtgacatgtctgcaagagcaccatgggttagtaacttaacaagaattcatatgcagaaacccataattctcagcagttctttagggtaaatgaaactaaagtttagggagagagaacaaggagaatttgcaaagatatgtatgacagtatttaaaaatgttcttccagcacaaagacattaatcttcctttgtcaaaataattctttctgcatgaaaagttggcatggggctcccaggcttcaggtaagatgggagaaagggagcgtttctttttttttgtaccaaagtactcaatcttctgatcttccttgactttcacgacataggcatatgtctactctgaccagtttgtttcatttattgtggtaagatgtgcttgtcttgtgctttcctggtgcagaaaaggagctgcctcgctcatgcttggtggcctttttgttcctacacacagtggttctcgtacatggtggctaccacatcctggtgtttgtctatactgggagaatcaggcgttccaagtcatcttggctgccctagctctgagcttcaggggatatatgactcagaaatgctatgctttctggaatttggatatttcatttttatttgtttcttggtaaattctcttttgacttaggagaagctaactatttggaaaggtctctcagaactctaattacaaatatatggtaccttctttatattgatctcatttttaaatacctagtcctggaggaagagctaaatatgaatacagtgatgagctgtgtaggggatctcacaggaacacagtcagatttcaagttgaaaatagattcagttgataatacttagtactagattctcctgaatcgactttgggaattctgagtcaacctaaggactatattacaaaggatcagaccttgacttttaggccaggtgtagtggctcatgcctgtaatcccagcactttaggaagccaaggcaagtggatcacttcagtccaggaggttgagaccagcctgtgcaacacagcgagaccctgtctctaccaaaaatacaaaaattagccaggtgtagtgtagcacctgcctgtagtctgagctactgaggaggctgaggttggagaatcaactttaaccccggatatggaggctgcagtgagctgtgatcatgccagcctgggcaaggagcaagaccctctctcaaaaacgaaaacaaaaaagacacagaacttgacttttaacaggaggcatagtaatagcaagcataagattgttttaacatagcatttaagataatttacgcatttagaaaattaattctggctggttgtagtagcttatccttaatcctaaccctatgagaggccaaggcaggaagatcacctgaggccaggagtttgagaccagcctaggcaacatagcgagacccccgctctctacaaaaaattttttttaaaaaacatagctgggcatggtgacacactcctgtagtcccagctactcaggaggctgaggcgggaggcttgcttgaggccaggagtttgagggagctgtgatcacgcccctgcactccagcctgggcaacagaatgaggccctatatctaaaaaaaagaaaaatggacaagaaaattctatattgattgaagcccagctaaatagaaaaaaaaaaattctaataggccattttaaagactttggaaaaattcttagctagagtaaaacagaagcaatcctttctttcctggttctcacatctccattctcaccttcattccccttcccctccatttgtttcaagtatttttcttttctatgtgtgtctttatgtaaatttaaatttacctacaagatattatgatattaagatatttcattctgcttcctgttttgtcacttgttctttaagatccaagtccttggctccatgtgcatctaatccttgccataagccctgcatcgtacttcatattcaccatattgaactattcaccctcaagtagtcactattaaatgtcacactgttgtagcgactacaaatgcaagctcagtaactgaaaagataacattaaattttgttttttaattggtttcctgtgtcaatttcatgtttcgggaatttgtatggacagatagacaccagagagatatgcgtatttcacctgcatgcttgaggctagagaaacatgatttattcagaactatttcaaatactgtaactaacctggtaattttgtttaggaaaacattaaattcggaatagaaggcaattcagaatacctgtctgttatctttgtcttgtcatttttgagatactcagttcctggaaaatattatgataatccatcttgctatgtagtatttcaagttatatgttgagcctctgagcttgcagagtgaacatttctattcatagacagtgctgttgacatcagtggggagatggcacaagctttgtgccctaggaaagtttaaaagctagaacattacactgcaaaccctatgtcaggaaactttgttgcagcaactaggcaaggaaaccctaccactgtacccataccttgttttagtagaattatgtttctttgctaagaagtctggtgactctcacaccccatctcagcactttcctggattccaaggccctggtgccctgagcacacaacttcccaggttccttttattgtttctgataagaactcgaattagaggcagcgtctggtactcaccaggggtgtggtcccatgggtgacattcttgctccatcatttcttacccaggtaaccttgagtatggcgcctaaatcctctcttcctttcaaattgcctggtctgtaaaatggatgcagtgaatggtagctatgccacaggtgttttgtgtgagaattaaatgagaggagttatatcaataacacttagaggcatgcggtgcctatagtgagggcttgttttatgttgtcgtttaaccctttctttctcagccctcccccactccacatcccctcccactggcaatgtacaaattgcagcttcctgcctctttcctgctatctcgctccctggatgacatccctgcgtttccacctctctctcccctaatcttagctgttttcaccctttccccacagcattgccttgacagttcctcagtgtcccatcccctcttcccatggacaacaccacaaacctgcgcacacggcctgttattattcctcctgtttcacctgtgtccattctgtctcataaaggacactgtaggctctgaacagctaaggcctttcttattcttttgtcccatggaaaataatccctccagatagcaataccaggaatagtgccttttctaacccactggtttccttttgagcttacagccaccaaatcttatatctgtttgtttctgttcccctctctgcattgactgctagagagatcagagtcaagcaggaggttacatctagctggggcactgtgctttatgctggtgtttcgtgtgcaaatctcataccatcttcatgttacagttgttccttagtgtccatgggggatttgtttcagaacccgcaaggacaccaaagtccagggatgctcaagtccctgatataaaatagcattgtgtttgcatataatctacacacatcttaccatataattttttttattatttgtatacattcgtggggtacaagtgtaattttgttacatggatgtattgcatagtggtcaaagtcgaggctgtgagtgtatttatcgttggaataatgtacattgtacccgttcattcctgtatactttaagtcatctctagattacttataatagctaatacaatgtaaatgctatggaaatagttgttatattgttaggggataatgacaaggaaaacacctatacatgttcaatacacagcaattatttttttctgaatatttttgatctgccattgattgaatctatggatgtggaacccacagatatgggacccacagatgcagagggccaactgtgtttattttttccaaatttgtttccctgttatgactcttctttatacacatttttaaactctgttgtcttgtatttcttttctaatcatcttacgtccttttggaaaccaagtggggcataaatagtacatgtttgcatttgaggcaacacagaggcatcgcaggagctggagacagcaaagttcaaagccagtccaccacttacctacagagtggccttgggcaagttacctccattttctgtctccattctcgagcctgtctagagagagaatgaacctgcctcccgaggtgatggtgctgttttaatgaaataatgcatgtgaaatgtgaagtgccactgtccctggcatggagatgctgtccttagatattaggtccatcttgtatcttctagtgtatctttaaaaattaaactatactggcttcatgcctgtaatctcagcactttgggaggccaagaccggcagatcacttgagtccaggagttcaagaccaacctgggcaacatggtgaaaccctgtctctacagaaaatacaaaaattagtggggcttggtggcacgtgcctgtagtcccagctgcttgggtagctgaggtaggaggatcacttgagcccaggaggctgaggctacagtgagctgtgattgcaccaataccgatcagcctggtatgacagagcatgactctgtctcaaaaaaaaaaggaaaaaaattaaactatactgataaatatttctaaagtaattgatgaaaacatatatatgacacttagcaggtattgatcaattccagtgcgtgcatgagctgctttgcactgtggctacggcactcagcagtttgcttagtgagtagatggccatagctcactttaggtatctggagaataatgctcattcctgtctccagctttgtaaaattgcctaatagacggaaggcattaaaatatgaagatgggattatatcttatgaagctgcttggaatgggttttccctcttaacaaataatttctgatcatccatatcccttaagaacaccggatttctgggggccagggaggtaagattctatctgacaaagccttcctggtgtcaaccacttgccatctgttggtcagtgctggccctgctgggtctatagaatgagcttctttgtctgacgctcctgttgccatccctttctccatcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctacttttgttttctctcttatttgtcactatggacaacagttacactttaaagaaaatggagcagactcaaagcactttcctctaataattgcacaccatatgcacttcgtgtgaagaagccaggaatcattacaatggagaagaaagaacaagcaaactgagttaaatagttcacaaacaatcacatggacaatggggaggaatcttccagaatgcatcagtcagggtctagcggcatttgagtgcggatgctgtaaggggaattcgttcacaaatgtactgataccacagatgtgggcaggggctaggagagcaacagggtgcaggcctgaaggcacctggaaggccgcctggagggggacagtcaggaaagcaggagcccttgagaggagcactagcctttgatgagaccactgccatcgaaggagacctcacagggagggagccaagggtaaaccctaactttgtttccccatttctcctatctctgcctaggggtcctcactggcagaaccaaccagaagctggaggacaagggagctcccatatgggagccggcctgtgagccttcaagggtatgcggagtcgtttgttcaaaatagccccatttcacagatgaatctctactggctccatcttcagcttagtgttctcttcactatgctgtaatatcccttttaacataaattcctttaaatttcctttactcactctgttccaattctgaattctcatgggcatgatacacttggtgttcatagagccaaggatttgttacgcctaattactagtttttgagtcaatttggtggacttttactgtcctgctgatagatgacgtgacacgtcttcccagtgttgggaagctctttatattcatgccctctccgagtatttttccaagcgctgactctgccacttactagcagtttgaacttagacaagtcactcacatctctgagccttttttccttatctgggcaatgagttctttcccacagtgaaacttttattaagtaatgcactatacaaatgtttgttattatgtacactttccacagtccagtgatgcttgctgtgtagtgtgttgaatgcccatcttgctgataatgtgcactgccaattacacagttatattgagaggtcacttaattattaatgacaagagtgaactcaacatcttacagaactgaaatagatatttatatttccaacacgcttgtaacccaataactagagactaaaaacctaacttcatgaaaaggagtgtaaatttagctgttatggtcaaatactcacacagcacacccagttcacaagcatctccaaaacgttgattgttctgatcaattttgaaaatcatcctgctctctacagcaggaattcaggtagtacaagtgaaaacagtattatatactacttaaatgaaaggctgcccttgtgagttactgtgtgtgaagttgcttctgcgtatgtccatccagagaacaggagagacactgagaagactgatgtgtccccgacctctagatgggactgaaaattcaagataagagagatgcccagggataaacttccttctttctttagaaattatacaatattagaactgaaagggacattagatatcatcagggcttcccataaggggctcactgtcttgctttattgaaagaaaatcagttttgaagccagaccaatctttttttttctttttaaatataggtggtgtcttgccatcttgcccagactggtctcaaattcctgggttcaaccagtcctcccacctcagcctcccaaagtgctgggattacaggtgtgagccaccgcacctggccaccaatcttgatttgaattcagaccctaccctttaccagctgtgtgactttgtatgttttacttaatctctcaaagctttattttacttatattttaattatactggagataaaaatgcatttcaagtcaaggttgttattgtgaagattctgcaagtaaatacattcttgcatctctgtaaaatgttgccgtgcctgttgattagataagtcaccatgatgacttatgatcaattagagaaaaatgtctgttacccagcgatgggaaagtgaatacctccgagacccatgtccccaattgtgtgttaaaactattctatgttaaaaacttactttaaaactcaattatatcttctcaaaatattactaatcattctaacatattttagttaatatgtttctccttgtacaaatatatatgtgggaagtagagggcatatttttccttaagcttgctgctttctaatccaaaaaaaatgtgatgtgcaggtctattacactccacttaaaatacttacaactttggggcttatttttctcctttgaaccattactattataaaaatcaattcttccttagtcaccaagtcctcatccttgaggaaaggaagtcagctaaaatacaaatctctttgtaaaagtaaagtttagcgacttgggaggctgaggtgggaggatcccttgagcccaggagtttgagaccagcctggacaacacagagagaccccatctctgaaaataaataaatttcaaaagtaaagtttacttatatacaattatacctagtaactttgctccctatagcaaaaggaagctaaactataaatcttatggaacttgttagtgttctggtaataaacagttaataattttttaaaattaatattcagtgaaaataatcttggccaggtgcggtggctcatgcctgtaatctcagcactttgggaggctgaggcaggtggatcacctgaggtcgggagttcgagaccagcctggctggccaacatggcaaaaccccatctccattaaaagtacaaaaattagtggggtgtgatggtgcgtgcctgtaatcccagctacttgggaggatgaggaacaagaatcacttgaacctgtgaggcggaggttgcagtgagctaagattgcaccactgcactccagcatgggcgacagaggaatgctccatctcaaaaaaaagaaagaaaagaaagtaatcttgatgctaatatggaaatgaaagaggtggtttgatatttgtctttacactatatttctttaattcaactagtacatgtcgaggctctattttgtgccaggtgctgtgtcagaagttggggttagagctcagaacaacatagatcaaagtccctgccctctgtgagcttatgttcagatgggagatacagatgagtaaaggttactacaatataatcagaatagggataacggagaccacgtagagcaccagatcaagacgtggaggaagaagacaggtttcctacagaactgacacctaggcaggactgacagataaagtcaggcaaaagttggaaaggacagtagagtaagatgtgacatcttaaacttgctgaataaaaacacccaaatataacaagttatctttaaattcatgatgatatattgtatttggacattcaggcagttctactacctgagtatatctagttagtaaattttttccccatgctccaaacaacagtttcacacccctttctctcaaactctccatcccgtttctacccagtccccgcagataactttgactcatacacgaatgagaaaagagaagccgtcaagagccacacctgcatgcctactctgtctcttgttagcatgggtgagcatgcccagctgcagtcatggactggcccatccatctggcctctgcaagccattcctctgtatcctcaggggtttcatcttgtgaatactctctctctccccgacatcatcattgtcttcctctctcccaattattccctcacattaacatggtctacaacttccagcaggaaagacaatgttccctcatcagtatagtttaattttttttcttttcttttttctttttttttgggggagtggggacagagtcatgctctgtcataccaggctaatcagtattggcacaatcagggttcactgcagcctcagcctcctgggctcatgtgatcctcctacctcagcttcccaagtagctgggactacaggcacgtgcccccaagccccactaattttcgtactttctgtagagacaaggtttcaccatgttgcccaggctggtctcaaactcttggactcaagtggacaatatccccttatataccccatcataccaccccatttatctgctcctcagcaaaactgcttaagggaattctgtatggcaggtccccacttccccaggttgcctcccctctgcccactccacatgaactttcattgcccccactcctccatgcctgcctcttcaatgtcaccagtgacctccacttcgccaaatgctgtagtcacttcttgggcctcattttactttacttattggcagcagtcaacagagttgacaccccctctttctctaaccatttttctctcttggcttcaggcatgactctcttggttttcctgcttctcactggttccctctgtttgctgctcctcctcactttgggcctcaagtggccctttcctccttctctctccatcattcttcctaaaggatttcatcagtgctgtggctttaaataccatctcttcacccctgagcccactctgaaattctagactcctgcagcctattccatgttaacatcttccccatataagcatcttagattaagtatgaacaaaacagaactcataatcatttaaatgcttttttctcattagcagtaattggcccttgtatcttaatttcttcatttctcaagccaaaaatttgtcatccttggtttctctctttaccttattaccctccttacactcaaatgctcagaaagacctgaatattctatctgcaaaatgtatcttaaatgtgtctgctttttctattacctgtaataatcttgttagtaatgacacaatatttatgaagtgctctcaatatgctagggaagaagaaagagggagagagaaaagaagaagaaaggtgatgtctgagaggtgagttttgagaaactgaaagagaaacctggaggaaaaaaaaagatacgaggccggagagaaaagcggtgtaaatagagcttgaactttgtccgtagagatatggggagttatggaatggtttctgcagtgatataaaattacttatttatagctgattcatataaataattttgttcaaatccctttttcatagacagtataaaattaaaccttaggttagcagggccaaatgctggcagggcctgaatcttatactcagttaattggattgtacatagtgcacttcctactgcttcttaatttcaaaagaatgtgctttaatcccagaaaaatcttattgaaaacatatcttttgatccgaagttcataagggctgttttcacgttttatagtccataaagtaattagttcaggaagaactgattacttaaaactcttttcttttttaagagcagaatattatcaacaaataatttctctaaaagtttcctcatcattttcaaaagccaaatcttctactgaatttttcgtatggaataatctgattatattttgatattttggtcattaagaaattctgccaatatttgttcttgaaggtgttcttagcttaattttatattttcttttactctttaatctagaatgcatttgtagagtcaatgatcctcagaaacacattggaaatttgtttaaaatggagattcttgacgtcaccctcggattctgatttatgagtcaggtgtagacctgggaaggtttaacaagcttgcagctgattctaatgcaggtggtctgagaggaccacaccaaaacaccctgccttactcccccaaccctgtgttttctgtctaaacactccccaatagctttcaattcctttggggcccataatttttaattaaaatgcccatttgtctatagagtattagaaaaatattaagaccctaactataagtagattttcttaaatccagggaattattatgttccagatgttggtactaataatggctaacctcggccgctgatccatcttttgtttgatttttataatatatggggaagcataattttgtatatatctaaacctctttagaaatatggttcaattgcatatgatctgtcataagggaatttatatctcacgaagttaagcgcataaacaaaacaagaccaaacacacacacacacacacacacacacacacacacacacattttcattcagaaatccttggttctaaaccagtctctaatcaacatgccaaaaacccttgtttcaaatcactttactcctctgtgctttgggatttctatttaaatggggtaagtatttaatcctgtatatagttacaaagcccagggagaacctcagatcaaagacaaaattgaaagaaagctttagtaggccagagacattggagtaccaaggatataattgtgaggttttcctgctagaaaacatcctctgaaatgaacttataagttaacaaatcacccttcgcctgtgtttgggggcagatgttaggcagagtcaggatttgtttccattcggtcacttttctaaagaatacaaatccatccacctattctttaatggtcctaaatagctaacaatggacagacaactcccttcccttccttgcccagtttccgagtcaaggcgcgcagtgttcagtgtatgacctgaagccttctggaaagtggtgattggttagggtactcgccagtttggccttactttgaacatcccaaatttatttccttccccatttcaaatattccgaaatgaaagacattaggagcacgtattctggttaaatacggtgattgaaaatacgaatgaatgccactccatcatgaaatttcactaaatgacaatgagtcagcaaataaggggcataaatatacaagttaaagagaacaacaggtaagagattatttgtcaagagcctgtaactcatttatttattcaacaaatatttactgagcacctcctctgcaagcaacacagaattcaaaacaattaaatatgtattacatatacagcatatatgtttacatataaacaatatataacatatataaagttactggcagagtaatattttcttggatagtcacagatgtattaagaaacaggcttgtttcaaatttgcttttttaataaccatatttctttaacatattctttttcatcttttaccatttctgacatcagattgtgtctttaacatggtctgatttttcttttgttgtaaacttattaaacccatagagtcttataattgatgataccataaaataaaggaaaagcttggaaattaaccagcagaaatttcagaaaggaccccttaggtttctttttttttttttttttcttctgagacaaagtctcactctgtcacccaggctggagtgtgcagtggtgagatctcagctaactttcatcagtaatgaaaccagcaggtgttctgctccccaaaaactttgtccactgtctccagacactcagagccacatgcttaactgtggctcatgggttaatgcatgtctgaactttttcagggtggaaactcccttttttctttagtgtctaacccaatgcccaacatgacataagtgctcagtaaatattcagacaatccacgtatgaatgtggttgagcatctgtgagtggtctcacctccaccctacatgtgttactatggtcaaccacttcatctctgtgggtctctgcttgctcagctataaattatttgggatcagctcagccatagattccctccaactctaattatctctgagtaaatgaagtcatgaaaatatgggaaactgaggcaggagaatagggtctagaggcagggaacctagggctgattcacaattaattcctagaactaaatcaaaaggaaaacccccaacttgccatgcccaactatcaaaaggaccagaggctactccctttacaaccccccaactttttccgcatggcagatgaaatattgaaagtacctctgattggtccccttctgcaaccaatcaggttggtcatgggtcaagtcttcatttgcataggagtataactttgtatatactctattttatcccctcccacaagcaatcagactgatcatgggccaccacttcatttacatagggtgtacaccaagtaagcaatgggaaacctctagagggtatttaagtcccagaaaattgtgtaactgggctcctgagccacttgctcaggtctgctcccaccctgtggagtatgctttcattttcaataaatctctgcctgtgttgcttcattctttccttgctttatttgcacattttgtccaattctttgtccaagacaccaagaacctggacaccctctaccggtaacaaaactacagtgattttagagggtttgtttgaagtgtgtattgctcatgaaggtaatgcctttgatgataacatttgctaaacaccacgtaaaggaagggaggcatttccacactttgggtctcctcccatctctatccccaagccttaaaatttctgcttaaatgggagtcgaaggaacccaacaatactcagttgtgtcacttaaaggctgtgcaacatcgggaagctttctgtatgtcttacagctagttcatatcacaagccagccgtttcatcatgcaaaagtctaaaacaacttacacctactttctaacattcttacggaaaaaccaatactgttgaacagaggtggacaaattatagctcctggccaaatctggcccacttcctgttttaataaatgcagttttattggaacacagccacacccttttatttcccatattatctatggttagttttctgctgcaatggtggagtgaaatagttgcaacagagaccatgtgacctccaaaacctgaaatatttactatctggccctttacagaaaaaaagtttgtgaccccagccctagaagaaaagtaatcaaaaatcacaatggcagtattagtggtgaagataatggattctgcttcagttaaacagtgtaactgagcttatgatttttcttttccttcttttttttttttttttttgagatggagttttgctcttgttgcccaggctggagtgcaatggcgcgatcttggcttaccgcaacctccacctcctgggttcaagcgattcctgcctcagccccctgagtagctgggattacaggcatgctccaccatgcccagctaattttggatgtttgtagagatggggtttctccatgttggtcaggctggtcttgaactcctgatctcaggtaatccacctgcctcggcctcccaaagtgctggtattacaggcgtgagccaccgcacccagccgtgatttttctattacctaggtccttttgttggctacacaccatgactgcttctgtttgggagttgagaacatctggtaggttaaattggcaatatttgactgatttgacctacaatatgtggtcaacttcatgtgactcaacctaatactttggcttccttcagtgtgttcagtttcaattccccgctccctttgtagtcttccagctacctcagtgattcttaatcttagctgtgtattagaatcatctgaagaacttaaaaaaaaaaaaatcaatgcccaggtcacacccaggaccaagtgaagccgaatctcaagggggagaaaccaagcccttggtaattttggaaagcaccccaggtgattctgaagtgcagtaaggcttgagaactatggaactaccaagagcttttggcaatacgcatgtgctaggtgctatagactccttccaattggagaaaagaatgtggacaattgtaataaataattggggcaagccggcatagtggttctcaaacattagcatgcaaccaatcacctggtgggcttgtgaaaacacagatttttggtgccaacccctcagtttctgattctgtaggtctg

SEQ ID NO: 1047 - DNA, 3225 bp, Homo sapiens
ggcggcagcgccctgccgacgccggggagggacgcaggcaggcggcgggcagcgggaggcggcaccccggtgctccccgcggctctcggcggagccccgccgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggatttgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtgcgagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacagttcaagttgacttgggatatatcattcctcaacatgaaacttttcatgaatgggagaagaacctatttttgttgtggtacaacagttgagagcacgaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaaacataaaatgatttatctggtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttcatgttctatgttttgttttgtgtgtagcctgactgttttataatttgggagttctcgatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 1048 - DNA, 1923 bp, Homo sapiens
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggatttgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtgcgagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 1049 - DNA, 21981 bp, Mus musculus
  misc_feature (1845)..(2002): "n" at positions 1845 thru 2002 can be any base
  misc_feature (4602)..(4936): "n" at positions 4602 thru 4936 can be any base
  misc_feature (9884)..(10000): "n" at positions 9884 thru 10000 can be any base
actattggtaactgtgatggttaactttgccagtttcactgggccattaggtacccaaatatttgttggaacattctagaagtatctatgagcatattttgggttgagtttaatatttcagtctataggttgagtaaaacagactgccctctgttgggaacaaaaaaaggggtccaacatccagccagagttcctgtgctctgagcaggcagacgcaggcagaactgccagacactttccactcagccccaggtggacatctaagcctctgaccccactcggcggggggtggacaaggggcagcccccaactggggaccctgaggtgacaccctgtcgtcccggggttataggagagagggaatagggaagaggttcccaacactgaccagagtcttaatggagcagagactctctatggtttaagagctttattatagaaatgcagggagaaagagagaaggtagaaaaggagagagagagagagagagagagagagagagagagagagagagggaggaagaggaagaggaagaggaagaagaagaagaagaagaagaagaagaagaagaagaagaagaagaagaagaggaggaggaggaggagggagaggaggagggagaggaggagggagaggaggagagaagaagacaaggaaaagaaagagaagagagaagacaaagagaggggagaggggggagagagtgaagggtaagaagtaagagcataagagtaagagagagaggtgggggctgaacagccctttttatggtctttactgctgctaggtaactggggaggagtttaacctgaaggtcagaatcttgggacattgcttatgtgactactgaccatgcttctcttgtggaggctgtgggaggtggtaacttaggcaggggccagagctccaggagcatgagggaacgcctactgtgtcatgaaggtaaattatgaccatcagggttcagacctcagctcgaccggagaccagcctgcaattccccacagccctccctaaagtgggttaaaagacagaaaagaattaaatatctgatcctctcccatatctacaagacgtaacttcccttgtccaaccatcttgtagattggatgttgtttttcccttgctttttaattagaactatgtcattggtcctcctgtgtcataagtctacaaagtgcatgtgtgctggctaatcttgtgtcaacctgacagacaactagaattatctgaaaggagggaaccttaattgagaaaatgcctccataagatccggctgcaaagcattttcttaaattgtgattgatgtggccgggcccagcccattgtgggtggtgccatccctggattctgggctctataaagaaagcaggctgagcaatcattgaggagcaagccagtaagcagcacccctccacggcctctgcatcagctcctgcctccaggttcctgccctgctttgagttccttcctgtcctgactttctttgatgatgaacagcaatgtggaagtataagctgaataaaccctgtcctcctccccaacttgttttttggtcatggtgtttcatcacagcaagagaccctaactatgacagtatgtcttaggaattatcagcctccataatcaggagcaaaattccttatagcaactcactaatatgccaatggtcaaaggaagttagtgaccaaatccagagagtaaggggtagaaaagtcttacacgggaggtaccattgccaggaaggttggattatcaagactcccaacacactggctgccaacaaggaaaccccaaatatcggcagaattctcactgattggcacttgcctggtaactatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgcgcgcgcgcgcgcgcaacatgtgttggcatgtgtgccactggtgtaggcatgacagtcagaagaaaacattagggagacagctctcacaaagggtctctgttagttttcctgctgtgcttactatcacaggttagatagctcacaaccactcaggagtctcctgtctctaccaccagctcacagccactaggagtctctgccaccagctcacagcctttcaggagttgcctgtccctgcctcctgtctaactttcgagtgctgagatgacaggtacctacatctagctctcttatgtaggtcctggggagtaaactcaagtcattaaccttgttgtagcaaatgattttacccactcaactgatggcccagttgccttgatggtctgtgtggttggttggctggactttttgtttcgagataggatctaagctagataacttaggctggccttgaactcattatatagcccaggctggcctccaactcagtgcttgccatacttcaacctcccagatgctaggactatatgcatgagccatcaagcctagcaccgtgcatatttaaattgtatggtttgtattatacactatatagattttaacacatggtacattgggaatgatgtcgatttttaaaatacatatatagtaggtaatgtcacacacaaattttctttcatttaaggttacattacacaatgcatggtggcacaagcaagtctttaatgccagctcttagaagcaggaggtaaaagaatccagagttctaagtcattctaactgctcagatagttcaaagccagcctgggttgcattcaaacttgtctttaaaaaaacaagtgactcgacatttgtacaacacagtgatatttcagatgatgtttgtgaaattgagttaaatttgagtgttgtaaggatgagccttcatttatttgtcccgacaagccaaatcaacttacttatggaactaacttaaagcagtctgcttctgtaagtccaggctgtccttcaacttgtgtttccacaagctcttgcctcaaccaagtgctgagatttaggtgtgtaaaccatttgaaattatttttcacttgggctgtgtgggacaaacagcccacagagtcttgtgcttcaaggacttcttttaaaaaaaaaaatcataagctactagtctccagttactcggccagacacctccctcctcttgccttcaaatttgcctctttacaaaagctgctttgctggcagttcagtatgaatttattttacagcatatacaaggttttctggtagcttgcagttcctgagaactgcaaccgaaggctcttaagctgagcgggggacacacagtagggcactcactacgttgattggcagttgaagtggcagttggtgtggagtcgtcgctgccacgggtactcttatctttcctggccacacccctgggcccaggaggcagctctgaacagatggtgagtctccggtgccaggtgtgcagcgcgccctgcgctgtgtgaggcacagggctctttggtccttgccgcaccccacccatcctatgcccgcgagcgcccccagcgcaatgtgtgtctcggtgctgtccgcacgcgcggttagccgaaggtgaaaggctgggaaaaaaggaaccctagtgccaggcagaacccgccaccgggccagctgctcgtggcgagcacgttcctcccctcctctgactcccatcacttggcagccaccccaatcgcctgctcgcccctctgcagcagcacacacgccttcgcacttgctcccctccctattctcttttctgacacttcgtggcttacatggaccactctccagcgggatgcccttggtccccgcccgtctcttagccttcaaggtggctctcctcgttccctaatatttggggaactctaggcggctttttttttttccataatcgtaatcatttgcttgcctcctgggactccaaactgtaattgcttttacgtgtctgtggtctcgaggacaaggaatccactgagagatggtttgggggtgctgggctgggaagaggatgctctattccgattccgagtaccgtttgcggggtgggggctgcaaggaggaaagtgcgctcagcctttcctttatccaccctccccccgtcgccctcggcaagggctttggggcgccttcgaggtcctctgtggacacacaaacacctcaatcttcctgatcaggctagagcctggaggtggggaactatctggttccttcgttctgcccctgggaagaagccctggccgctgtgcgtgcactgcccctcccgcagtcacagtgagagctgaagcgtgagtcccagaccgatgcagatggcacgctatttagtccaggagaggctcacagagggtaaggggctgctgggcacccgagtgcacccagggaaccaaatggctgtcggttccggtcagtggcggaactgggccccagcggctaggtccaggctggaatcggggggaggggtgcgtagggggagggactgggcgagatcccccctcctggagtggctgctccagctgccacttgcaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggggggcgtcaccagcccattcctgaccgtaaacctcctcagaaggcagtggtgaaacgccgctgcgagcgtcgcccgagccacgtttacagtaggaaagactttcctccgaaaagcaccaccggagtcgattgcaatttagctcctcccagtaagagtcacagagaggcaaggcgaggccggtgcaccgggagtcctaggcgagcttgggcaggacccctgttgctgagctccacggggcgggcgtgccgggctacggaaaccatttcttttcaggagcagggttggcctttgggactcctgtggtcatgcaccgtgtgtttctgccgccgccgaagcagagcgcgcagctggcggagaaaccgcattctcgctcctacccgcccgagggagatgacccgtgacctcccgagtgaggttaccagatccgaaaggggcgtctcggcttccccagccatgggggttgagggggtggggggtggaaggtggccctgaaaaaagtggacgagcaaacagggagcagcaatcggttaccctaaactttgtcttacggggaatggggggatgcccagaattcaccagcacacccaccggtccttgaaacccggagaagtgttgggggttcactggttcaggagaccaggaagggacggttggatcttcccccacgttttcccacgtcgctgcatgctcaggcaggctcagcgctgccacctggcggctgcctctcccggactgggaggagctgtctgcacgcaccagttccacagatcttgaagggtgtgccaggcctctatctggggaaagggcagaagctccagttaatgcttcctatctatgtggcccgtgcagacacacttgttttctgcttgttctcaagagtaagagggaaatgcgttggcgttgaacggcatgggtataaagagctgacttgagcctgctggttatgaggggtgagaaagtggtgaaattattagaaatatatgtttcttatctctgtgtagtctaacagtgaatatgaacgacagctttcatttatcctgcttaatatttttcgaataagaattcaacacactggtctggagagataactcagcccttgataaaggctaaggctcacaaccaaaacctaaaaaatactgtttcaatacagcccccctttcctagtccagtttcaatacaacttcctcagcaccaagaatggagtagtgcaaggggttggggggtggggagcaaaatcagccccagtgaagggttgacctgaaaacagggctgatggcattcagtttcccagagcacttccagtcaacgaaattaacaagaaggcgtcctccacctctgtttatttgaactgaatgttcaaagccagaggggctcacacactcagtttctacagccaaagcaaagcacgattcttggaaaatagtgccaagccagactcgtgaaactaatttccatgcaggttttcctccctctatgctatcgggacacattaagaagtcgaggtaaaccttcatccataccccatccataccattctgtagatgtgaggttttatgttgtgcaggtgtgtaggggcaggagaagcacattagcagttattaccctctcatgtcgaatggattgcatttaatggaataaaataaatatctgccttaattcaagacgtgaaagatctaatatcatttccaataaagaccattagttgatgattctaaggcaggacttgtttgcaaaacaatcctggctctctgttcatagaactacaaggggagcggagggaaagagcactgagcactgacttactaggggccaccaaatagctagtatctggggggaacggggaggtctctgatggagaactgattacaaagcttagggcattaggtaatgagacccagaaatcttaatatcatgatttggtattaagtccagtgcattctggtgtatatgtactttaatcaaaagctatttgtcacatcttttgtcacatgtttccatgctctaagaacaaaaacagtcacacttcaataactccaaactgtcaggtatatactctacaggattacattgtacaatggtgtaactaggtcaacggatgctaccaacacatattttaccaggtctaagagaaacatagacacagggggtgcatctcatagtcagggggacaaggaggacctttagcagctcgtgagttggctcagccggtacaggcctctctaggccaaacctggcaatgtgagttcaatccccagtacctggatagtggaaagagagcactggccgcacaagatgtcctctgacctccatctatgcacagtgccaagcagtggactcgcatacaaaaattaacttaaaatggtttatccccttttccttaaaggccttttgtcctttgatggcatatactattacagtacaccttaaaagtctgttgggttttctgacatgcatctaacaagaaaaatcagggcaggaattacttttttgatatgctctttaaattaaatatgtgcattaagcatgagtgtaactatgaggggtgatttacaccactggaaataccaccaattacaccaacactcatctttgccaaattatccaacattgttgaatacagattgtacaaggaatacatctccttatttttgtcataataaaaatactgattttgtagacaatagaccttttaggataacccagatgccattttgatggcatcttaagaaggtacatctgtgggtatcagaaaaaaaaacaaaaaaaaacaaaaaaaaaaacacatatgccttgcaaaacacttttcttggtggaggtttttttcttgaaggagtgcatactattttaggatttcctcctctgggaattaaaaaagggctgtgatgggtagcaaatagtcaaaaaaaaaaaaaattacttgctttttacccacaaaacattcttgcctgcagttgatcttagagacccagtcagctgtctccatagggtactctttccagtaaatgtctaattcttgacaccctcggcctccttccagcctaaatactctgaatgtgtgacaaggtaaatggaaatataccacccagcactactgtgctctcaatcaagagctggctctaagttggcctcctctgttactagcctgagggaaatcagtttatcatcgtattaaaggtgagttttcactagagtcccaatgctcagatcttgggaaaagggtggtttgtgtaactaagttgttctatattctaagtattatctgcatgtgttcgctctttgagacaaggacttgggtagctggagctgtcctggaattctttttttttttttttttcccttggtttttcgagacagggtttctctgtgtagccctggctgtcctggaactcactttgtagaccaggctggcctcgaactcagaaatccgcctgcctctgcctcccaagtgctgggactacaggcgtgcgccaccaccgcccagcttgtcctggaattcttaagcatcagcggatgatcttgaactcctgatcttccctgaaggcacctcccaagtactgagataacaaacggggaccaccaaaggggctttcgattacgtttcaccaccggtgaccaccttcccaccttagtctctcgaacatcgtgctgctcttactagaagtggcatttgcattagggagaactcggaatgtgtgttagaatccagagggctcaggacacacatccgtggtttataatcacacactcaccgggcactaacacaagccctctataaagctcacaaggttcccaaagcacagcaagaggaggacaatgagacccagaaagaaagatcaggagagggacttgagataggtccagcagcccactcccctgtgccacccctttctcttcttggtcttttaggcccaattgcttcaagtagcacagacacacgggagacaatgggtaagaaagagagggggaaggagagcacatagcgaacccatctatcctttggatattgtggaaaacaaacatttagaaagtgaagtcaatcccatcctgtattcaccatgatcgccctatacagaaatcacacaaagtctcttattgaggtaattatgggccactgccttagcgttccacagaaaatacttgtttggcctacccaggatttataggggaagtgaaatcattaaataactagttaacctctgtttggcaaaaagagtaagtaattactgaaaaggggagaaagaaaaaaaaaaaaaaaccctgcctttcacaaacagcacagatagcatcctgaagggatttacacaatacaccaacgtttgttctgtacccagagttgttaaaataattgtgatgacaggtgtctaggtaccactttcttaatggttttcaatatccattgatttattattgtggctccccccacttacatctctagctctaagaaggggctaagaaaagagattttgcaccaaaggctgattctttattcctgggctgaaaagaactaataaaaataatcactcggcttttaagcagaaagcttccatttacagtatttcacccttaccccccctccaagccccttgttatctaacataatggctagaatacatttccgtctctccccttaataacttcatgcattaacatcctcttcacacatgcgcgtgcgtgcgcgcgcgcgcgcgcgcacacacacacacacacacacacagaggcaaacgcgcgcgcacccagcaaaaggcggaggtgggggggaaagaggcagcagaaatctcagctgtacttctagcccttttaaaaagtttgctctgtaaattggaatgaggtcagatttggagcttctcattgcacgcggagattattattgcatcgggttccaagccaatgggaaggacgggggaggggcttggcacgaggaagcgttagttacagcggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgggggaactctgccggtaaccagctccccttcttgcaggagggagggagaaacatacatttattcatgccggtctgttgcatgcaagcttcttggcttcctaccttgcaacaaaataattgcaccaactcctcagcgccgattccgcccacagagagtcccggagccagagtcgctttggctttgcactgcaggaaagggacttaggcgctagagacgatgtcgctttcctgagctaccgcgagctctcgtgaactgcaatcgactgcttcagggaaaggggtgggggaaagacttgccccggaggcggcgagaaacttgcgtttggaagatactccggctaccaacgtttggagaaactcctcgccgcggccgactccagcctcggtgcccgcagggagcacttcagcggtgagggaggacggagggcctcggggactctaggttggcggcgggaggcggccgcccctggcccgcgcgccgctcaggggaccctggtctccgccccggggagcccgcagggcccggcgaccgcgccgcgagcgtgtgagcgcgcgtgggcgcccggcaagccggggccatggtacaacagaccaacaacgcggagaacactgaggctctgctggccggggagagctcggactcgggcgccggcctggagctgggcatcgcgtcctccccgacgcctggctccaccgcgtcgacgggcggcaaggcggacgaccccagctggtgcaagacgcccagtggccacatcaagcggcccatgaacgcctttatggtgtggtcgcagatcgagcggcgcaagatcatggagcagtcgcccgacatgcacaacgccgagatctccaagcggctaggcaaacgctggaagctgctcaaggacagcgacaagattccgttcatccaggaggcggagcggctgcgcctcaagcacatggctgactaccctgactacaagtaccggccgcgaaagaaggtgaagtcgggcaacgcgggcgcgggatcggcggccacagccaagccaggggagaagggcgacaaggtcgcgggcagcagcggccacgcgggaagcagccacgcggggggtggcgcgggcggcagctccaagcccgcgcccaagaagagctgtggccccaaggtggcgggcagctcggtcggcaagccccacgctaagctggtcccggcgggcggcagcaaggcggctgcatcgttctctccagagcaagctgccctgctgcccctgggggagcccacggccgtctacaaggtgcggactcccagtgcggccactccggccgcctcctcctcgccgtccagtgcgctggccaccccagccaaacaccctgccgacaagaaagtgaagcgcgtctacctgtttggaagcctgggcgcttcggcgtctcccgtcgggggcctgggagcgagcgccgaccccagtgatccactggggttgtacgaagatggaggcccgggatgctcgcccgatggccggagtctgagcggccgcagcagcgcagcatcatcgccagccgccagccgatcgcccgctgaccaccgcggctacgccagcctacgcgcagcctcgcccgccccgtccagcgcgccctcgcacgcgtcctcctcgctctcctcgtcctcttcctcctcctcgggctcttcgtcgtccgacgacgagttcgaagacgacctgctcgacctgaaccccagctcaaactttgagagcatgtccctgggcagtttcagctcctcatcggcgctcgatcgggacctggattttaacttcgaacccggctcaggctcccacttcgaattcccggactattgcacgcccgaggtgagcgagatgatctcgggagattggctggagtccagcatctctaacctggtcttcacctactgaagggagcgcgggccggggagaaggtgggccaagaggcaggagaggagagagggaaaaaagaaaacaaaaaacaaacaaacaaaaaaacaaacaaaaaaatgttaaaaagaagaagaaagaaagaaacagaaaaaaaatgagttaaaaagaatagatggagagtagaaggagaaaggggaaaagaaaaggaagaaaaagtgcatagagctggcctggaacacgtcccgccgttggagaaggagcgcgggggcgttagtggacccgcgctcccatcccccactctcagggctggggactcgaaggaggcggagagtagacgggggcgacctttttttgttgttgttattgatgttggtggtggctaaaaaagctacttcgagtttcctccccaattttgcttgaagagactcccccccaccccacccttccaacgagcttccggacttggttgcacccccagcaagaaaagaagccaagcaaagcttctaaagaccgaaggaatctttccctcacccccaccccctcgccttggtgatttcttgtttgattttgcctcatggtcaagaaaggagggggaaaatccagcgtgccccatctcctacccaccccctctttgtattctctttgtatttttccccttcttaaaatttctttttctgcaatgaagacagaaagaaggctctggggtgatgcgtttggcatttgtgttgagcttaggggagcattggcatggagaaactccacgctggcgaagtcccgggctgggctttctcctcctccccccaccttttttccccttgtccttgcagctggagatgtgctgggagtagcaggccagcctcggaaatggacatggggacctcgtggaagccacagcaacctggttggggatgcagaaggacccggagcacagagggcgttggggttcccgggcctccgcctggggtctgtgcaaaaataaagaattaaaaaaaaaaaaaaaatcagagaggtgaggctacccagagccggcgggaggacaggagactgtgggatgtggtccaggggccgcggagtggtttgggggggaaaagagatttttttcttctcttaatgggaatcgtgatggtgttgagttatttcactggtggggttaatatagcatgttatcctgtctatcttttgaagatttctgtataagactgttgagcagtttttaaaatagtgtaggataatataaaaagcggatagatggcgctatgtttgattcctacaacgaaccgatcaccagctccttttcatttttaactctttaaaaggattcaaacgcaactcaaatctgtgctggacttttgaaaaaccacaattcaggaccaaattttttctccgtgtgtgtttattccttataggtgtaattgagaagacccgtttatttttaccccctcacggactctccatctttgtatttttttttcccttgtaaatgtaatcagatgccattttatatgtggacgtatttatactggccaaacagttttcttattttgtcccccctttttttcccttttcatttgctttcttgtcttttaacctcgtttctttatcttcttttttattttctttctttttcttcgtttttttttttttctagtgttgttacccacgccattttacgtctcccttcactgaagggctagagttttaacttttaattttttatatttaaatgtagacttttgacacttttaaaaaacaaaaaatgacaagagagatgaaaacgtttgattattttctcagtgtatttttgtaaaaaatatataaagggggtgttaatcggtgtaaatcgctgtttggatttcctgattttataatagggtggctggttaatatctcacacagtttgaaaaatcagcccctggtttctccatgtttacacttcaatctgcaggcttcttaaagtgacagtatcccttaacctgccaccggtttccacctttcaaccccctggtcttataaggggaggagagttcagcccagcaccataatgctttaaaaaaaaaaattttttttttttaacgaattgctgttctgtccagaggtttttaaaactggtgcattcacagcaaaaagggattctgtagctttaacttgtaaaccacatcttttttgcacttttttttataaagcaaaaacgtgccgtttaaaccactggatctatctaaatgccgatttgagttcgcgacacaatgtactgcgttttcattcttgtatttgactatttaatcctttctacttgtcgctaaatataattgtttcagtcctatggcatggtgatagcatatgtgttcaggtttatagctgttgtgtttaaagattgaaaaaagtggaaaacatctttgtacatttaagtctgtattataataagcaaaaagattgtgtgtatgtatgtttaatataacatgacaggcacgaggacgcctgccttttaagaggcagttccgttaagggtttttgttttaaaactcttttttttcctttctttttttatttctttttttttaaccatccatcctgtgcaatatgccgtgtagaatatttgtcttaaaattcaaggccacaaaaaaaagcaaaaaaaaaaaaacaaaaaaaaaaacaaaaaacaatatttgggggaagagaaaaagaaaaaaaatcatgccagctaatcctgtccgtcactgcctgtcaggttgttcctatataccttctgtaaataactttttttgagaaggaaataaaatcagctggaactgaaccctaaatcttgacttttgtcatccttattcctgggatctctcctttcactgcaggctgctgctttgctgctttgcagcttcgcggtggcatggaagctggtgctgattcagttaagccatcttaatggcaaaccctaagttcctcttggccagatttcgcaggcctgaccccgagtgatggcattggccacgtgtgtgtcaaccctccctccgcacgccagccttcgaggaattctctgcgtctactgtacatcagcaggcaccctttgtctggaaattgcaaagaggggggaggggcaggcttctctgctctcaatccagccggcaggctgaacttttttaaatgtattttttgcttttgtgtctctaagccaccatcccctttacacaccaagatttgttttgcacagaccaagaagaacaaatgagcctgttaaattattaggtcttctaggagaaaagccttccatagttacaagatgggaaaaccaaaatcaacttaggcttgctttgttggggtggggtggaggagtccccttaaatgcaaaggtcagtagggtgtggtgtaatccaagtacttgagaggcaggccaggctcaaggatcctgagtttaaggcctgagtggactacttgattgaaactctgtttccagaactaccaaagttactatggccctaagctgttcatcttatgccccgcccaacatgggcgtcactgtgagtaaaatatagcctacctgctcaccactggaatgacaggccaagtaggagagtgtagatttttataggcaccagacacagcattagtgaagcctgcatgcagctggacagtagtcggtgtttattttagagatcaacggtctccatgggcaaatagaagtatcttcccttcccaaggctcatcttcacaaatgtgtgctttccatgtttcctagtctttccgccctggagagaaagggttaacatgcagcacttggaaacaatcctttctgaggatcggaggcaaggtgcttgcatcctgggatcacaacagaaagaagacttaagggccagtaccgcaagcatttttgcacagtaaaaaagccatttgctaggggttggctgtgatcaacttacactacatacttggatgaagtattcaagggggggaaaaactgaaaaagcaattccctctctaaatactgttctaatatcatttttccctgagaccttgaaacagtatggtgtaaatttttcttttttaaaagagctttgggaaagagttgatatgcttgtttaatggttgattattatggtgaggataatagagcatcttagggtcttggagaagaaagcctttgatagttacaagacggggtgggggtggggatgacttaggcttgctttgttagatttggggtgggggtttcccctcaaatgcaaaggtcagtagggtgtggtgtaatcgaaacacttagagacatgccaggctaaaggattctgactttaaggccatagtggactacttgagaccctgtttccagaacaacaaaagaccttgttccttcccccttctcccccgaccagacaaaaacatcgaaatcctactgtaaatgaatcctgtatgaatcatttttaagtgatgcatattttcaaataagtttgtatttttgtaggctcttctgctacagccttgtttattttcccctgactttgcatgggaggagcaagcagatgctttcaaatattttctttaagaatcctaaggctcagggtgaaagtggagcagtgcacttagctagcgtgctagaggccctgggttctgttcccaggcccctgaaaaaaacaaggaattctggcacatcacccttttctctttaaagtgttgataccgcgtgcttcctagcaggggcgtggcagatgtgaaccactggaaccctgtattcaggaaggagacttacatgccagactgtgcaagggaaaatagatattagaaaaccacttcacggtgactttcagatggtgtggctcagcagaaaagagtgagctccagctagcttttcgctcttgttcttaagacccggcttcaggccctgtgctcagtcagcaatgtggattagtgacacttgtcaccattgtcagttcttagctgaatcccctgaagagccatgaaaataaataaataaataaataggcagcctccaggctcctctggtggggtgagtgcctgcaggggcctcaggttactgctgactctagtctgagtaggtgtcctaaggaaagaacagagttggaaggccagcaaccactcggtttatctgctgtatagatgggatcagagtgcttcatcataaatcaatcgtttggttggttggttttgggttttccgaggcagggtttctctgtaaggccctggcctagaactctctcagtagagggggagcgccttgaacgcaaggatcttcccgtctctggaagtgagtgctgagcctgaagatgcgcacccaacaccacaccctctcacctcggatcttaacccactgacctagaaggttttggatagcagggcatggcggtgctgtccatttaaaaaagaaaacttccagaaaaatctaagaccccccaaatctgttagatttctcaaggtggaagttttctgtcatttttttttttaatggatactttgagttgtttttttttttgttttttttgtttttttttgttttttttttttttaaagatttatttatttattatatgtaagtacactgtagctgtcttcagacacaccagaagagggagtcagatcttgttagggatggttgtgagccaccatgtggttgctgggatttgaactctggaccttcggaagagcagtcgggtgctcttacctgctgagccatctcaccagcccttgagttgtttttaagattgattttatggaagtgtttgcgagtggtgtgcacatgtgcatacaaggagcctcacaacagcaaggtgtcctgttgcctggagctgcagtcacaggcaggtgagccacctaactccataccaggaactaagttcaggttctctggaagaacgggaagtagtatcaactgccagagcctctccagctttcctgttgattgtggttcacagccctggccccaggactataaatacacctctggcttctgatctcttgtgtttcccccacacacacacacacacaccccacccccggcctctctgattcatcctagaaaacaacctgaaaatccatgtcggtttttttttttcaccctgcccaccatttgaaagctggggtgggcagcttgtctgcattttcaccccacccaccatttggaagctgagttgggcagatgggggctaggggtgtgtgtgagcatcttttgatatctgcatggtgtttcagaccacactaaccatcattattatcctttgtccagggtgaggtactcggttctcgtgcagcttgtcaagactctgcacaaaatggtggtggctctcctcctccaatctccaccacccaccactgcagcacgaagcctttcctggggaagctctccggatggtggagcccaggaggcagaggcaggagggtctctgtgagttcacaaccagtctgcataatgagttccagaacagctcagactacatagaacaggattaaccctttaatgcctgtttctccacacttactttgtagtgagttcttgcataaaacctgttcttcaagcttccaaaatatattcatttcccaaaatatttgcattttgtgctatctttggcaagcagcgttgaatttagtcaaaataatccatgtgtgaatactggctctgagctaggctggctggagcacggtggtcaagtttcttagtcccttggagcctccgttctaaatcgttccatagaaggccacctgactgagaaagctgttgtgagaattgagtgtgaccccatatgtggaacacatgcagcaatgcctggcagcaatctgtgctcattaggtaccagcccttcaccttgtgcggctgattataaaaaggtaaaggttgtgcaagccaaccacagtgccagccactcagaaatcagacagcactaaataacaataaatatgctgtctgcttctcaaatccttaatattagtatgaattgaggacaaggctagagctggagcccagtggctaagtgctcgtgaagcacacatgaggccatgaggccctggattggcctcccagtatcaatcacaataagacagacctggtgaagccatgccagtactggggaagatagctcaaggctatctttggttaaatagtaggtctgggggcagcctggactttgtgagctcttgtctgaaaacaaaaagaatggtttgggagcgtgtgtgtgtgtgtgtgtgtgtgtgtgtgtgtgtgtgtgtgtattattgggaattgaaccttgagtctgggacatgctaggttctcttccatggatctaagtcccagccagaattctttttatttttttaatatatttttaaattattgctagtgaatttcatgcaagtatacaatgcaggttttgatcaaatccatcctctacactccccccgccccccgccccctagccaggactctttaaaagagcagaaccagaccacagtcttaagttctccatatattctcagtgcaaaccaaagtgaaaatgactaccctcacagtgtgttagcatgatctcaataagtatacaggcaaaagattgataccaccctttttacaaggagatgtggcgatgattcagtagtaaacctgagatcatagaatcagaaggggaagaagggtggggctgtggctcagtggtaggattcttgccctaacatgtatgagaccctgggttggagccccagcactcaactgcattaattaggaaagaagaggaagggggccctggaatcttatttcctgagcccaagaatgaacttagatccagtgtctctccaagtgtggtggcacatcattcagaagacaaaaacaggaggattgcttggcgaccaagtttaaggccaggctggcctacaaagtgtattccgggatagttagaactgttacataatgagactctctgtctctagaaaacaaaagcaagccaggagctggtgggccgtgcatgcctttcatccctgcacttaggaagcagagacaggtaaatctctgagttccaagccagcctggtttccagagtgagtgctagaccagccaaggctacacagagaaacgctgtcttgaaaaacaaaacaaaacaaaacaaaaaagaaagaaaaaaaaagagagagagaaaaaggaaggaaaggaaatgaaacaaaaatgaaaattaattaaaacaacaacaacaacaaaaacaatcagaataggtgtccccgtttgagaactagagaagcataggtgggaggccttgagtctttggtaaggattggccatcacctcaaccctccacatccttccttcagctctgatccatttctccaaggctgtcttgtacatctcagtttgaagtgcaagcttaagtaatttgtgtgtgtgtgtgtgtgtgtgtgtgtgtgtgtgtgtgtgtgaatacatattagttgaacaaatgtgtgttaaaatatgaatgcacggtcttcatttcaggagtcagcaaggcagaagaaatgatctagctatcagtagtggatcttctgctctgtcattcaaaaggtggggtgggtgaccacgctgctggttattcagaatgccttcacacagaggctctaggctacccatcctatcctaatgagattggccgttgctacagttaacttgaagggttttatggtttcctgcatgtgttgttttcctgcttaatgttaaaaagaagaagaagaaaaagctcacgtcactaaactgaatttcccagggggcttttgtatcttctgcagtctggcttatgccttggttatgatgagatacctctatgtgtggatatctgtagatacaggtgataacaaagttagcccattttctttgcttctgacagtttccattcaagacagttggtttaaatggagtcctgccaacatgccaggcacaagtcaagtcgtggcatgagctttgcagccagagcctttccttcaacctgcagactttgtggtaaaggccaaagttacaactgatttatacaccaccttgctttgaaccgcccctaagacactccagtgacaagacatcgacatctgattggaaggttttggattttatttttaatgacttggagagaaggaacaaatgaagtataatttactcagccctcttgcttctttagttattttcaatacaattatttctctatttcctgctccagggtggagtttggagggagggaggaagggaaggagagagggaggaagagagggaaatggaagccctgtctgtcaactttagcaggctcattctgtagtgaatgcacagtatgtggtggtggcatccaagttaaggagcaggcaattgcttttctaagagccaagcagcctgtgccggcttaaaggatcaattaagtcctgttgtctgtgtggttaattgtcaccttcttaccagtggctgtcctaactccctcagctctggcacctaaaacctgtgaaaatagtttcctgcaactcttcgtcctccctcccacgcctctcactttctcacccccctttcccacactccctatgtgggccttttatctctcctgtttgccattccccggagaaggcagactttgaataatttatctaaagttcctgggaagttgtggggctgtagtctcaaaacacacagcactttgttcctcccccagatagaaaggccagaagtctgtctttgacctagcccctcctcagtgaatccaggaaatgaagtaggttactaaagccatggaaagtcctctgtgtttctcaaatagtttagccagagtattcccaaatcgtttcttttaaggtattggggggggggggggtcaaggtacaatccgaacactcaggatatggaggtagaagggttgagttcagggccagcctttgctatgtagggaatttgaggcttagctgggctacaagaagacactttgtcttttttttttttttttttttttttttttttttttttttggtttttcgagacagggtttctctgtatagctctggctgtcctggacctcacttttgtagaccaggctggcctcgaactcagaaatccgcctgcctctgcctcccgagtgctgggattaaaggcgtgcgccaccacgcccggcaacactttgtcttaaaatgatga

SEQ ID NO: 1050 - DNA, 2069 bp, Mus musculus
agagcagcagagtgaggggaagagggccgtctccctcccggtttccagttcttgcacgctgtttcttagagagtctgcagtgggggaactctgccggtaaccagctccccttcttgcaggagggagggagaaacatacatttattcatgccggtctgttgcatgcaagcttcttggcttcctaccttgcaacaaaataattgcaccaactcctcagcgccgattccgcccacagagagtcccggagccagagtcgctttggctttgcactgcaggaaagggacttaggcgctagagacgatgtcgctttcctgagctaccgcgagctctcgtgaactgcaatcgactgcttcagggaaaggggtgggggaaagacttgccccggaggcggcgagaaacttgcgtttggaagatactccggctaccaacgtttggagaaactcctcgccgcggccgactccagcctcggtgcccgcaggagcacttcagcggtgagggaggacggagggcctcggggactctaggttggcggcgggaggcggccgccctggcccgcgcgccgctcaggggaccctggtctccgccccggggagcccgcaggcccggcgaccgcgccgcgagcgtgtgagcgcgcgtgggcgccggcaagccggggccatggtacaacagaccaacaacgcggagaacactgaggctctgctggccggggagagctcggactcgggcgccggcctggagctgggcatcgcgtcctccccgacgcctggctccaccgcgtcgacgggcggcaaggcggacgaccccagctggtgcaagacgcccagtggccacatcaagcggcccatgaacgcctttatggtgtggtcgcagatcgagcggcgcaagatcatggagcagtcgcccgacatgcacaacgccgagatctccaagcggctaggcaaacgctggaagctgctcaaggacagcgacaagattccgttcatccaggaggcggagcgcctgcgcctcaagcacatggctgactaccctgactacaagtaccggccgcgaaagaaggtgaagtcgggcaacgcgggcgcgggatcggcggccacagccaagccaggggagaagggcgacaaggtcgcgggcagcagcggccacgcgggaagcagccacgcggggggtggcgcgggcggcacgtccaagcccactcccaagaagagctgtggccccaaggtggcgggcagctcggtcggcaagccccacgctaagctggtcccggcgggcggcagcaaggcggctgcatcgttctctccagagcaagctgccctgctgcccctgggggagcccacggccgtctacaaggtgcggactccccagctggccactccggccgcctcctcctcgccgtccagtgcgctggccaccccagccaaacaccctgccgacaagaaagtgaagcacgtctacctgtttggaagcctgggcgcttcggcgtctcccgtcgggggcctgggtgcgtgcgccgaccccagtgatccactggggttgtacgaagatggaggcccgggatgctcgcccgatggccggagtctgagcggccgcagcagcgcagcatcatcgccagccgccagccgatcgcccgctgaccaccgcggctacgccagcctacgcgcagcctcgcccgccccgtccagcgcgccctcgcacgcgtcctcctcgctctcctcgtcctcttcctcctcctcgggctcttcgtcgtccgacgacgagttcgaagacgacctgctcgacctgaaccccagctcaaactttgagagcatgtccctgggcagtttcagctcctcatcggcgctcgatcgggacctggattttaacttcgaacccggctcaggctcccacttcgaattcccggactattgcacgcccgaggtgagcgagatgatctcgggagattggctggagtccagcatctctaacctggtcttcacctactgaagggagcgcgggccggggagaaggtgggccaagaggcaggagaggagagagggaaaaaagaaacaaaaaacaaacaaaaaaaaaaaaaga

SEQ ID NO: 1051 - DNA, 1323 bp, Mus musculus
atggtacaacagaccaacaacgcggagaacactgaggctctgctggccggggagagctcggactcgggcgccggcctggagctgggcatcgcgtcctccccgacgcctggctccaccgcgtcgacgggcggcaaggcggacgaccccagctggtgcaagacgcccagtggccacatcaagcggcccatgaacgcctttatggtgtggtcgcagatcgagcggcgcaagatcatggagcagtcgcccgacatgcacaacgccgagatctccaagcggctaggcaaacgctggaagctgctcaaggacagcgacaagattccgttcatccaggaggcggagcgcctgcgcctcaagcacatggctgactaccctgactacaagtaccggccgcgaaagaaggtgaagtcgggcaacgcgggcgcgggatcggcggccacagccaagccaggggagaagggcgacaaggtcgcgggcagcagcggccacgcgggaagcagccacgcggggggtggcgcgggcggcacgtccaagcccactcccaagaagagctgtggccccaaggtggcgggcagctcggtcggcaagccccacgctaagctggtcccggcgggcggcagcaaggcggctgcatcgttctctccagagcaagctgccctgctgcccctgggggagcccacggccgtctacaaggtgcggactccccagctggccactccggccgcctcctcctcgccgtccagtgcgctggccaccccagccaaacaccctgccgacaagaaagtgaagcacgtctacctgtttggaagcctgggcgcttcggcgtctcccgtcgggggcctgggtgcgtgcgccgaccccagtgatccactggggttgtacgaagatggaggcccgggatgctcgcccgatggccggagtctgagcggccgcagcagcgcagcatcatcgccagccgccagccgatcgcccgctgaccaccgcggctacgccagcctacgcgcagcctcgcccgccccgtccagcgcgccctcgcacgcgtcctcctcgctctcctcgtcctcttcctcctcctcgggctcttcgtcgtccgacgacgagttcgaagacgacctgctcgacctgaaccccagctcaaactttgagagcatgtccctgggcagtttcagctcctcatcggcgctcgatcgggacctggattttaacttcgaacccggctcaggctcccacttcgaattcccggactattgcacgcccgaggtgagcgagatgatctcgggagattggctggagtccagcatctctaacctggtcttcacctactga

SEQ ID NO: 1052 - DNA, 22801 bp, Homo sapiens
tatgaagtttcctcttagcactgcttttgctgttatctcagaggttttaatagattgtattactattgtcattcagttagaagaattttttaatttccatcttgattttatttttgacccagtgatcattcagcagcaggttacttaatttccatgtatttgcatggctttgaaggttcctttcggagttgatttctagttttattccactgtggtctgagagagtgcttgatataatttcaattttcttaaatttattgaggcttgttttgtggcctatcatatgatctatcttagagaaagttccatgcactgatgaatagaatgaatattctgctgttgttgggtagaatgttctgtaaatatctgttaagtccgtttgtttcagggtatagtttaaatccagtgtttccttgttgactttctgtcttgatgacctgtctagtgctgtcagtggagtactgaagttccccagtattctcgtgttactttctatctcatttcttaggcctactagtaattattttataatttgggagttcaagttaggtgcatatatatatagaattgtgatattttcttgttggacaaggtcttttatcattatataatgtccctcattgtctttttaaactgctgttgttttaaaatttgttttggccgggcacagtggctcatgcctgtaatcccagcactttgggaggccaacacaggtaaatcacctgaggtcaggagttcaagaccagcctggccaacatggggaaaccccgtctctactaaaaatacaaaaattagctaggtgtggtggcagatgtctgtaatgccagctactggggaggctaaagcaggagaatcacttgaacttgggaggcggaggttgcagtgagctgagttcacaccattgtactccagcctgggcgataggagtgaaagtctgtctcgaaaaataataataaacaaaaaaataaactttgttttacctgatataagaatagatactccgccgctgggcgcagtggcttacgcctgtaatcccagcactttgggaggtcaaggcaggtgaatcacctgaggtcagaagttcaagagccagcctggccaacatggtgaagccccgtctctactaaaaatacaaaaattagtcgggcgtggtggtgggtgcctgtaacccccgctactcgggaggctaaggcaggagaatcgcttgaacccgcgaggtggaggttgcagtgagccaagatcatgccactgcactccagcctggacgacagagtgagactccatctcaaaaaaaataaaataaaaaaaaaaagaataggtactcctgctcgcttttggtgtctatttgcatagaatgtctttttccatggggttattcaattttagctaactcccatatacactatgggcattggtgaaaatactgactgaatttttaataaagatctagagtcattaagaaaaagttaccttcctgcatgaacttatattttggcatctatcaaatggcattgtaattaatacaactctgacctctattactgcataacaaactacccaaagcatagtgatttaacgcaacttattagttctcataattctgtggggtgtcaatctgagtgattcttctgttgtacccatctggaatcgctcctgtggctgcagtcatctgacaaaccaaccaaaactggagagtccaagatggcctcagtcacatgcctgggatgctggccttggaggggcaccttggttttccctatggggccttcaatcctcgagtaagatcagctgctgaaggtagttcacaacatgatgttttcatggtctcactggagtaggttcacaacacgacggtttcaatggacaaaccccagtacatgggcacttgtgaagtctgtttgtctcatgcttgctaatgccccatttcccaaagcaactcagtgaccaaatccagaatcagagagaaaaaggtccacataaaagcacacgtactaggaggacgatttattacaagaatctaccacatccactgtaaatttaagaactcagaatacaagtagcatcctcattatttagcgtttgcctgccacccatagtgcataattcacacctaggcagtagtactcctagggagaatttttaaatttttggacaacattttgggtgttctagtgaaatacagccctaccatgcatatttgaaatgtatattatcttattataaattacctactgtgtatttctcctttaacattgtagtttgaacattatggtttcttttttaattttgtgcatagtaagttacgtaatccacagattttatttcaggagagtaaagttatattacaaaatatttgttacaataaggcagcggtttgggtctgatatttttgaaattaatgagttaagtttgagtgttttaagtactagccttcagttatttttgaatcgtgatagccagataaagtgtcactaaattatttttttaacttggaatgtgggacaggaaggatggagtttcatgcttcaggaagcagtgaaaaatcacaaaacctctgtactgctagacccaacacttttccagatccccaaactatctctatcaccctcctttcatggcaaatttgcatatgcattattgtcagaattttgaacttattttacaaccatatacacagaattcttttctagcttgctgcttaactgaacagatggtgcagtttcccagcccagcagctggaggggaccgaggatgcgctcggcacacagtaggagcaccataaacgttgattgactgagttcattgaggcggttgacgccaggccatccactcccacgcggtactcttatctttctccaggcccacacccctggcccgagaggcggtagctgggagcagatggcgagtcccgggtgccaggtgtactgcactccaggcgcggtctggggcactgggttctacggtccctgccccacccctcccatccctatgagttcccccaaagctgtctgcgccaagtgtgacgtctgactacggcgggaacatgggaggggaagggctggaagaaaggagatcggttgcctggcgagggggcccgtgcgtcctacagtcgctacccgccacgcacgcgtccctctcctcctgacccgcgtcacttagcagccaatgcggtctccgtgccttcccacttccccgcaatcaagcgcctttcttcctccgcctcccctctttctgttatctgacattttgctctgcttccctctgcccactccccagcgggattccctccctggcagacgcgcgcgccccagcccgccctcgcacaacctccaatagcaggtcaactggcttgtaacgctggcttagggttgctcttgaagtgtttttccaaaagcgaaatcacccgctttcccccacggggctaaaactgtaattgcaacaacgggctgttgcgttgggggtgggaagcccgtcgggcgtgccccacctagaccgcctgctggggccactggggtggttttgccgccccctcaacccctgccaccccgggtcgagtaggcagctccacccggacgcttgcgccagggcctgactgccgcggctgccagcggaaaggcagagaccagctgatccaaggaggacaaagcgagccgagaccttccgcagagcttggcttcctcgtaactgcgcccagggcgcagcctctccctgttaactacctgccatatgttcccttctctcagacccgaaaccgcctcctacaggtgctggggactgaatctggagcttcgggcgcggcccttgacaagggcgcctggcaccctggggcgcctccgtggccctcgcaaactcagagagcccccaccgtccagtctttcctgcacgagcgagggatcgagggaaggcgccaatgcacgtctgtccctccgtgatccgcgcagaagggacgcttgaagactggggtgcaatgaattgtcgacttccctcagctctcagcccttttcctccccccgcgcgccgtgcacgcgcagcctgctctgcccttctgaaagagacgctgcagctgcgctctcaatggggcctcagcctgcggggtccggggaggggatgaagtgggtggttgcccagccggtgtacgaaggtcgtgtgcctgccgaagagtgggtcccacacgcacagcgcgcgccgtaccaaccaagcaaggctcacagagagcatttagtcgtccagagcaaaggatgctgggcactcaagagagcagggggccaagtggctgtcagttctggtcagtgacggaactggacagcatctccaagggccaggggatggggtaggaggacggaggagccaagctcctgggaaacgacccccccaacctatccgcgaccggttgcaaattcaaaggagggctgggagcccgcgagggtgcgggaggtgtcctcgcttgggctgcgtctgcgcccgcgtttgtgtgtgtgtgcgcgcgcgtgtcttcagctccttccccggtcgtaaaacctaaacggaagacgggtgttaaaatgctgctgacaggatcgcctgaaacatgtttacagtaggaaggactttcctccagaaagcacagtctgagtcgattccaatttatttcctccctgtaactgtaagcgaaaggagaggttcggctgccgcggcggagcgaggctgagcaccattaatccttggcgagcttaagccagggagagcgccgtgcctgcgagaccgagtcgctgcgctccggaaggcgttctgcctgaaggaaacctcttttttttttttttttttttttttttttttgagtagggagtggcctttgcactggagtccttaagtaaggcgcgtcgtttctctgcagccgctctcggaagccggagaaactgcattcactttagcaagaagacagggaaactgaaattgataatcccccgagttgggttacctgatccagacaggaagctggtctaggcttcccccgtcacccggagctcctgacaagtgagcaggaggcggcgggtggttgccctaaactttgatttatgaaaaaaaatcagaattcatcgacataccctgttactcgttgagcgtttaagcctctaactaaagaaggtacagtggtagggagtggtaggggggtcgggagaggaggaagggggagaagaaagaagactgactatccccacgatttcctacctcgcctcgcgggcgcagggaggctcagcgatgccacctggcggctgcttctccccagattgggagccggctggctgcagacaaacccaggctctccccgggtgccgtgcctctgcctctagaatagaagcagaagcctgtattcatgcttgcaatccaagtggccctgcaaacattcgtcttctgcttgttttcttgagaaaatcgaaggaaaggaataatgagttggcattggcatgaacagcttaagcctactgtgtgctagtcactggttatgagaggaaaatggtacaattgttagaaatgcaggtttcttaactcttagcttattctagtgataaaaataaatgctaggtttcatttaccccagaatcctattttgatattttgcaaatatgagttatttccatatattatttttcaatgcacgcacccccacccccattacgcgctgagcccagttacaatgcaatgtcatcagcccaaaaggatgaagtgcaagttatgtttgtctacttgactgagaagtaaatcagcctcacatggaggcttcttttccataaagtgtggaaccaaaaaaactggcgcctttcagttgacaaaggccaatgacatcagatttcccagggcttcttccttgtcaggtaaagtaacaactacacagtttttcctcctctttattttatttgaactgaatacttgtcaggtctgactagcgcctacaatcatagtttctataaccaaggcaaggcaaaatcttgcaaatcagtgcaaatccagatttgttaaactaatttccattcaggtccctccctccatgccaaaggaatatattaagcagtggaatagaatcttatttcatctatgccccataccattgtatggatgtgagattttatgttgtgtagatgtgtgagagcagaagaaatgcattagcagatattacacttacatctcaaatggaattccatcatttaagggaataaaataaaatacctaattcaaaattggaaatgtctaacatcattgctaacaaagacagtttattattctaaaccaggattttttttttctgcaaaattatcttggctttctcttaatacagctaaaagactagcattaagaattacttcatgtactgcaaagccagcagagggaacactgcgtactgatttagtaggggccaccaaatatctggtatttggggaaaaaaatgtcagtaatggagaactgattacagagcatatgaagttagggaatgagaagggagaaatcttttctcattatttggtattgagaggtccaacacattccagtgtgcacacacttagttggtcacaaagatgactttaataaaagggcattcgtcatatgttttcttacattctaagagaactaacccattagaacagatctatttcagaagtctaggcacttgtgtaatatataaatatatatgcagtaattataaagtcaatggaagttactgataccatatttcatcaagtctaagaggaaatttttcttttcatttcaactcttcctgaaataaggaggcatcctacatctagggggatatcacagtttcattggcagctttcttccttggtggaatgtaatataatggtgtgtcttaaaatttgttggatttgttgaaatacagaaaatacatgtaacaaaagaatgaggccagtggctgtgttttagtacaccctttaaaaaatccatgtgttttaagcagaaacatatatgactgctttaacttccactcttccctatcatattcgatgatggaagcataaatgactgagaaatataatcaataatgttgatactcaacttgactgaattatcaaactagctacaccctcaaatcattagttagtacaaattcaaaaataaatattcttttttattctagtgaaaatattgatcttatagataatagccctcttaaaataatttttttttgtcagattggtaacatttaaggatgtgtttctatgcacaccagagaaaatgtagtatataacacagcaacactgttatgcaaaaaaggtgcctgtgtgtttttggtttgggtttttctttttttaaggatttgtttctccttttttaaaaaaattatgtaatacaagtagctaatcgtcaaaaattatttgcttttacccacaaaaacagttttgcttgtggttgatccttacagatccagtcagatggctacatagggtgttctttccagtaaaattctaagtctgacaacctgggcctattgccagcctacatactttaaaagtttgacaagatacatagaaatttactacccagcactagtttaatctgaatcaaaagccgacttaattattttggattgactttacctaaccacttatggttagcctgaagaatattagtttcctattatagtgttaaggaaagctgatttttactacaattctaattttcagacactggaaaacaagtaatttctgtagccaacgtttattttgaataccttggcatcctttctttgccacattcttcttagtattcttcatggagttcctttcttttaaaatcaatggaatggcagggttgccactattgtccttctatggttcacatcaatgatctgtgattactttttttttttttttgagatagtcacacgctatcacccacactggagtgcagtggctcaatcttagctcactgcaacctcctgggttcaagcaattctcccgccttagcttctcgagtagctggaattacaggcgcatgcatccctgcccagctaattttttaattttttaatttttagtagagacagggtttcaccatgttgaccaggctggtctcgaactcctgacctgaagtgatccacccaccttagcctcccaaagtgctgggattacaggcgtgagccaccgcgtcctgcctgttattacttttttacataagtggctattctgttttagcctcttgaacaacatgcagcttttactaggagtgtgtctggcatttgaattagaaaggaagatattagtattcattgagggcttacaatacatcaggtgcttcatagtcacaaattcattgaaccctcacaacaaccctctataaagtagctcctagtgttcccatataatagatgaggaaaactgagacttggccacatccccatagttacaaaccattaagaaggattagcagccaggtctactatgaatccggaggccccattctcttctgctaccagttatcacctccttctacagtttctctttgccttggtttttcagttcccttcgattcaagtaacaagaggaaatatataagaaggaaaggaggaagatggctttgggaggaggagagggaagagagtgaagcaatctttaattttgaaaacagggaaaacaaatatttagaaagtaaaaccgatttccatcctttacatgccattatacatcctatacaaaactctggaaatctgcctattgaggtaattacggagcactacctaatgtgtttcaagggaaagctcccctgtttgggctatgcaggatttacagggagtttaaatcattaaataaccatagttgacccttgcttggttaagagagtaagcaattattgcaaagtcctcttccctgccttccacaaacagcacaaaaacggttctgaagggatttacacaatacatcaacatctgtgctgtacctagagttgttaaaataattgtgatgacaggtgtctaggtaccactttcttaatggttttcaatatccattgatttattgttttgtggctttctcttcccctttacagctttggctttaagaaagagctggggaacagattttgcaccagaggctgattctttattccaatgctgaaaagaactaataaaaataatcacttggcttttaagcagaaagcttccatttacagtatttcacccttaccccgccccgttccaagccccttgttatctaacataatggttagaatacatttccgtctctccccttaataatttcatgcattaacatcctcttcacacactatacacacacgcacgcgcgcacacacacgcgcgcgcacacacacagcaaaaggaaaaaagaggcagcagaaatctcagctgtacttctagcccttttaaaaagtttgctctgtaaattggaatgaggtcagatttggagcttctcattgcacgcggagattattattgcatcgggttccaagccaatgggaagcccgggggaggggtttggcatgaggaagcgttggttacagcagctgattggctgcagccaagactgtgaaaggataaagaggcgcgaggcggaattggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaatcttgacttttgtcgttattatgcccaatgcctaagattggaaaggccctacagtatctggacactacacaatctgccttagctttaaaaaaataagttctcagaggagtcttgtcaaatgctaccttatcgaggaacattaaatgtctcttggccagatttcctctgaccctgaaaatgatggcatcagctgaatatgtgtcaactcaacacatgctttctaggaattttctgagtttaccatatttaaaaacgccctttgtcttggaatctgaaagagggggaggggcaacgtggacagaattcttcacagatgaaactggctagatgatctttttttcaagttggtgctcctggagctgctttctccttgatttgcccatgcttacctccagcagtggctgtaattggttttcgtgggttaaggacaaataaactgttattatcagtagattatacaggaggaggcttttaccgattatgaaatgcaaaacgtatgcatttatgcattttttttctcaagcagaaaggttgatgtgctacaatcttcattttttgccatgcccaacatggtgttaatgtaagagaactgcagcaataaggatgacctggagaagctggctgcatgtgggctcagaggaaagccccctctccaaatagcacttactttggctgctggagatttgtgctttttctaagaatcaggaaggattgttgagactgcaaggtgaaaaagtacttggatttcttaaggcccattactcttgggtttggaacatacaacttgctaagtggcactatttcctgtttattttgagagttaacaattgctattaactaacaaaagccatcttccaaatgttaattaaaaatgtgtcttttacttgtcttgagtttttcagcactggagaggaggggttaacaagcagaagtgtttggaaattatcccttagtcatttggattgcttgtagataagggagtagtatcctggaaggtacatctggaaaaagagaccttttgaagactagtctaacaggagggggttttgtggttgtccaacgaaaagcaataatgcacccccaaaaaccagtataacttgtgtttcaatataatttatctcttaaagatagctactagttttcaacatttttttcatgtgtggtgctcatatatttagttttaattgcatttgcgttctgcaattggaattccattttttaaaatgaccttagaacaacatggcatctaagtttcttcaaagatctttgtaaaaggaagaactcttctttagaaaagtgcttttaatttttgttcattgcagtgataatataatggtttagcttttttcagatccaaggtatcaataccatgacataaatgaagccttaaatgatgccttttttaaatgatgcatctcttttaaagcatatttttatttcggagggttctcctgttagaactgtttcttttcccttgactctctatgtaaaagcagatgttttaaatatttcctttaagaattttgataacattggtttaaaaataaaagctgaaatgtgtgtgtccttcctgtcaggtggtaaagtaagaagcatttttgtacaatgtctttttctctgagtctgttttcattcgtaagggatacttacttgttaggtggtacaaggcatcctaaacctgcgaaaccaaacagtttagtgtgatttttttcttacagataatttggatcaatagaaaagagtaagtttcagattttcttttaagaatatccagcaattgcttctggccctgtgttccatcacaaatgtgaatcagtgatacttgcttaagcaagttttgtcaattcctagttgaattcctttaagtgccaagaaaaaaaataaaaagcatgtaagctgagagggtgggcccagctcctgggaaggcttttagggtttgtgtttaccctgcttttgagggtactaggggagctaagggattctgaggaaagcaagaaagcaaagggttaaatggacatcaacatttaccaagggtttcctgtgtttgtagggtacacacaaattagaagacatggtctggggaatactatgggtcagaatgcttaatcatgaatttaaaacaaattcagggatcccaaggaagtatttgaaaagagagaaatgtttaaaaaaaaattttttttttttaagaatacaaacccatctggccgggcgcggtggctcacgcctgtaatcccagcactttgggaggccaaggcgggcggatcacttgaggtcaggagtttgaaaccagcctggccaatatagcgaaacctcctctctactaaaactacaaaaattagttgagcgtagtggtgcacgcctgtaatcccagctactcgggaggcttaggtaggagaatctcttgaagccgggaggctgaggttgcagtgagccaaaatcgcatcagtgcactctagcctgggtgacagagtgagattctgtctcaaaaacaaacaaaaaaatacaaacccatctacccatttggatttctcagagtgtaaggttggtatgctttatttctctttctggtggtttttgttttgtgcctcctcctggcacccctcctattaaggcctacaaaatacctctctaacccatattcactagggtttactcctacccctctgattcttcctgaaaaatgatatctccatacgcatttctcaattttcactatcatttgaaagctaaagtggaggggtgggaagaaagcatctccagacatccgcatggtgtttcaggctctgccaagtgtctaccaccattcccctgtgcccaggataaagtgcagaattcacatgctgctcttcaaggccctgcacaaaagggttttaagcccaactttccagttcttccaaattgcagtataaccaaactgctctttcctgatagactggaattcttgaaggacagaaactaggcattgaatacttcttgcattccccagtttgctttccctgcttcttttcacataataaatgctaaattcttatttcttgactttacatggtttccatgggttcctaagagcttccaacaggcatttgcattttatgctgcttgtggtaagcgccagcgccggattgcatgaaaacctggattagaatgctgcctctgagaccaacaagctggaggaccttggacagatttctcagcctttttaagtttccgtgttttaaatcgtcatatagaaagagagctatctaatgtagacagctgtgttgggaatagagtgcagcggcacgtgtgtgacatgtcgtaatgcctggcctaccccatgggctcggtgaatgctagaacctgacctcatgggtggttctaaaaagctaatgtgtgtaaagcctaacacagtgccagcaacacagaagatgctttaaattctaaaaatggggagcaaagcagcgtggccggggtccgagctggggttctgtccccactgggctgtcgccccagctggactaccaccatggaactcagggccgaatacctcagggagaagctgcagcgggacctggcggcggagcatgtggcggtggaggacaacacgaccctcaaccattgcgcctgtagcttctggcggtgtcggccaagttcgaggggaagccgctgcttcagagacaccgcctggtgaacgcgtgcctagcagaagcgctcctgcgcatccatgcctttgaacagaaaaccctaatcccagagcagtgggcccgtgagcggcagaaatgagggactgggacctgcacagccattaaattacaaatctggaaaaaaaaatttctaaaaataaatctcctgaatcaatgtttctcagtctgctacacgaatccccagcatcagaattacctggagattcttgttaagggtagcgattatacagatcgccagccaccgtcagactgtggggatggggccttaatgagccccccatagatttccagtgctcactgaagtttggaaatcagtaccctcactgtattttagcatattctcacaataagtatgcaggcgagggattatgacgccctcattgttttaacatggagaaattgagttgagaatggcccaatggctgatctgaggtcacaagatcagaagtgccagaaagggtattggaactctatctcctgagccctagaatcagcctagaacttatttctctaaatagatgtcttctccatttctacccaaggcttggtcccttggcaaaaattggcagtccctgcacttccctcagccctctgactcctatccattttctcaaggatgcccttccaccatccttgttaaaagtttaagtttgggccgggcgcccgtcgctggtgcctgtaatcccagcccctagggaggcgaggcagggggatcacctgaggtcaggagtttgagaccagcctgaccaacatggtgaaatcccgtctccattaaaaatacaaaaaaattagctgagtgtagtggcacatgcctttaatcccagctacccaggaggctaaggcaggagaatcgcttgaacctgggagacagaagttgcagtgagccaagactgtgctattgcactccagcctgggcaacaagagtgaaaatccatctcaaaaaaaaaaaaaaaagtgtaagtttaagtaattagccaagttaatgtgtgtgtgtgtgtgtgtgtgtgtgtgtgtattccagttaaacaaatgtgtgctaaaagatgaacccagggactgatttttggtagaagtatccaaggcagagaacagaaataatataaatatagtgcctggaacttctgctttgttgtttaaaaggcagagcttccagcaagtgagaaaattggaaattattcagagcacactcagcctttatagagagggctatcgtctacccattatatcctaatgagattgaccgttggctacagttaacttgaagggttttatggtttcctgcatgtgttgttttccttctctatgttaaaaagaagaaaaaaaaaaactctcacatcactaaacggtatttcccagggggatgtctgactaggctgctgcattttggtttgggccttagttaacaatggacctctatgtgtgtatgtttgtggatacaggtgataataaatttagcccattttattttcttttgacagtttcaattcagggcagttggtttatggggtaccgccaaacaagccaggcctaagtcaagtcatggcaggaagtttcttgtagggccttcctttaccctgcagattttttgttgaaggacaaagttctaagtcatttgtggaccaatatacacagctgctttgcatcatacgtaagacattctaagggtattccatttgagtgttttttttaaagggcaggacattaagaaacaaatgaaatatcatttacttagcccacttacttctttagatatttttccaaatacataattctttggattagtttttaaacacataatgaatgtgctatttcctgacataacatgcagttgaaaggcaagtgaaaacactattatccttagtaggtaggctctctccaggcagtgaatgcccagcagtgtagggcgatggttggctaatacatgtgatgcatgtaactgcttttataagagctaagcagaaggagcctgttgaatgatcagttagctcccgttgtatatgtggttaattgttactttctttcctaccggcccctgccctaacttcctcagatcaacacctaaagcctgtgaaaatagtctcttctggaacccctgaccttcagtctctgcccctgctttctctcttcccattcccacactttctatgtggaccttttatctctcctgtttgccaatccccctcagactttgaataatttatctgaagttcctgggaagttgtggggctgtctgtagtctcaaaatacactgcactttgttccttctctaggccgaggtaggtccaaaagcctgtctttgaaagaggtggtactaagtacattgagggatttactaacagttttaattttttggatgagcacccaatgaatccaaaagctggaggaaagaaaaaataaggggcaaaagatgaaggtgaatactactttgtaattctgatatctcccaaagaatgtcaagtaaattaagggaacactgattaagatttccagttcctattgttataacaatgtattttatacatgtcttttcaaatacatgagagttttccttgagtagttactagaagtggaaagtgctggatcttagtcttatagacataggcttttgacagtttccgtaccctggagctggttaggcgtaaagtggtttgaggagagaaaaactagtgatatgtctaaatgaacacaggttaaaaagtaaaccaaactttgaaacaatcattttaacccccggagaaggtgaatagattattttaatatgtaagcagatacatctgcaaatcatactgagatgatttttctatcccaagtgtctgataacatatatgaatagaaaagcgaacaattacagaaacagccttgacactgacatggtgacaaagtatggggattttagtacttccgaaataaacatcagaacagagatcaactctcttcggtctttttcttcttccattagaactcatcaggctgattcccatttctgcattactagccttacttttttttttgctaggctctgtgatgcaaggaacagaatcactcaagtaacctgaaatcatggggctttattacaaagagacacggggctttattacaaagaaacacaagactacaagggaactgaaaatgtcatggtagttctgggagaaatagtgttcaagatccacggcagctctggagagattaagtggttaccaatttagcattaagattatgcagataattaatattgctcaggtattctcttagtattcctgtgtgtgttgattttctcccaataccaaatcttgcttctgttctccatattttgtccttcatattcccttttaagacagctctgggccgggcacggtggctcaggcctgtaatcccagcactttgggaggccttggtgggcggatcacttgaggtcaggagttcaagatcagcctggtcaacatggtgaaaccccgtctctattaaaaatacaaaaattgttgggaggccgaggcgggtggatcacgaggtaaggagattgacaccatcctggctaacacggtgaaaccccgtctctactaaaaatacaaaaaaattagccgggcgtggtggcggccgcctttagtcccagctactcaggaggctgaggcaggacaatggtggtgaacccaggaggcagagcttgcagtgagctgagatcgcgccactgcactccaggctgggcgacagagcaagactccgtctcaaaaaaaaaaaaaaaaattggccgggcactgtggctcatgcctataatctcagcactttgggaggtcaaggtgggcatatcacgagatcaagagatcgagaccatcctggccaacatggtgaaaccccatctctactaaaaatacaaaaattagctggacgtgctggcacaagcctgtagtcccagctactcgggagactgaggcagaagaatcacttgaacccgggagacggaggttgcagtgagccaagatggtgccactgcactctagcctggcaacagagtgagacttcgtctcaaaaaaaaaaaaaaaaaatttgctgggcatggtggcatgcacttgtaatcccagctactctggaggctgaggtaggagaatcgcttgaacccgggaggtgaagttgcagtgagtcgagactgtaaccactgcactccagcctgggtgacagagcaagactacatcttaaaaaaaaaaaagacagctctgcatggcagttatttcatcaattacttaccaagcaatgaaacggctgctttggggttgtgtgcctacttttggacaaatcacttattaatgtattatattcttcactctcccatccctctttgttttgcttttgttcctagggtctcatggccctcatacgtcctcttatattttttctttgatcttcatatactaagggagggtgaaccccaggcttcatggaacatccacccttcctcctctaccatccacaatatcctcatttcaaacagactggcttggcttttatctatttaaaattctaaccttttccctatagctcgaattttggcactcaggcctagagatataaagagtagagattaaatatgccacattctaaagggaagccaggtgatgcccttaccccagtaatccagagcagaaaggatcctaccatagtcagtattcccctcctcaacacgg

SEQ ID NO: 1053 - DNA, 2797 bp, Homo sapiens
ttccccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctcgttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcctttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaaggg

SEQ ID NO: 1054 - DNA, 1425 bp, Homo sapiens
atggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactga

SEQ ID NO: 1055 - DNA, 53963 bp, Mus musculus
  misc_feature (205)..(999): "n" at positions 205 thru 999 can be any base
  misc_feature (18095)..(18178): "n" at positions 18095 thru 18178 can be any base
  misc_feature (44333)..(44457): "n" at positions 44333 thru 44457 can be any base
  misc_feature (47101)..(49467): "n" at positions 47101 thru 49467 can be any base
  misc_feature (52233)..(52252): "n" at positions 52233 thru 52252 can be any base
ttaagaaagctggggccactggacagtggtggcccacgcctttaatcccagcaattgggaggcagaggcaggcagatttctgagtttgaggccagcctggtctacagagtgagttccagggacagctgagactacaccgagaaactctgtcttgaaaaaaaaaaactgaaggagaggaagaagaagaggaggaggaggagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattacccttggctgcacagcatgtgtgggcgacacgagaccctgtctctaaaaagaaacagcagctgggacctgaacctgtagtcagtagcttagctagggcggggtgggggaccgggctgataatcagggatgcgctgtgaggctatttgtgtggaagagggaagggaaggaagaacagcagcagagaacaaccaaaagcatcagcctaggagaaagggaccaactggtctacctttactccctacctgtcaatgaccttactcagtcacttcctgtcactaggcctggttctttaaccatgaaaggatggagctggccaggagctctctatgaaccctttctgatgatcttcaaaagaaatgcacccccccacacacacccaaataaataaataaataaataaataaataatgctcaggagaccagtgggcaattaaattggttctacctattatagtgtctctccctgttgcccactgattccaccctacagttttaagacttcagtccatagcccactgtggttttagcttaatcataaggcctatgtcctgcctccctcatctgtgcctgtggtccagcctgggtcatgttaggaggccctgaaagctggcatctgctccagtcctgccttgtaccaccggtggtaactcagtcctcacctctcaaagtctctgtttcctcatctactagcagagctggtaaccagttcagatatgttctacggtgctaaactgatgagtgcttattggcctgaaggctagctccggctcgctgcatatgcttcacaaaatcagcctgctttgaaggatccactctgagcctatgcagacctcagtatcgggagaactggctctaacatgttactgttcagtaaacgagagggtcacagggttttatgtatactgtgaacactctaagaaataaaggaagggagaaagggtgggagaaggggaagtgagaaagaacaggactcaagcccatagggaggttgtgagtacttgcggaaactgggcagggatgtgctggacggaaagggttaaagcctgagccggcctctgagggtgagggtactgaaagagaagtaactccctacaacttggaatgtcttaagctgctactttagtaacaacttaatgaccttcaaaagctttctctggattgaagagaaacagaaattgcaggtcagatctgggaagagcagaaaaagcccaggaaacatcctgccaaaaagacttgagtcagagaccctggaaggcggagagaggggctatctttccgttggagtcataacagaagcaaccttcccaggaccccctagaaagtccggtgctgaatggatggaactagaaaacctcatcctgagtgaagtaactgggaaagataacgacggcctgtactcacaagtggacgttagccataaagtacaggataaccatgctatgatccacagagccaaagaggctaagtatcaaggagggccgaaaggaggatgcttgaatctcactgagaagagggaataaaatagacatctggggtggagggagggagggaagtgggtggaggcgggtggataggaaagcaggagggatctcaagtgtggggaggatggtgggagacagaactgggatagagaactagaatccatgtatacgtgggggagggggaagcatctctgggacaaggtagaaatctaggacaatggaaactcccaggaatctgtgaggatgaccctagctaagactcctagcagtcagggatatggaacctgaaacaggcacttcctgacaccaaacgagacttccaatggagagatgggaataccaacccagccacaaaaatctttggccctcaatttgccctgcctataagaggtggtgggataaggagggagcagaaaatgaggaagtgatcaaccaatgactggcccaaattgagcctcatgccatgggagggagcccacccctgacgacagtattaacaatattctgccgtacttgcagacaggagcctagcatagctgtcacctgagtggctctgcccagcagctgatgaaaacagatgcagagaccccccagtctaacattagacagagctcggagaatctcacggcaaagggggaggaaggattgaaaaaagccatgtcaaagacgccgcaagaaaacctacagaaccaactaacctgggcacaggggggctcacaaagactgaatcaccagagagcatgcatgggacagacctagtccccctacacctttgtaacagatgtacagcttggtcctcgtgtgggactccctaacaacaggagcaggagctatttctgacactgttgcctgcctttggatccccataactggacagccttaacagaagatgtgatatgacatggcatgttgatattcagaggtctcccttcctctggggaaaaaaggaggggcataggaggaggggaggggagaaggagggactggaaggagagggggtagggaaagctctgatcagattgtaaagtaaacgaatcaataaatggatgactagaatagaatagaatagaatagaatagaatatagtgctagaacagaccttgttcacagatccatgtaacacaaggtcgtttcaggggactagagaggacaagagactggcccacgaccacgtagcagaagttggctataaaagctctttactggtccctggttctgctgcttccaacctgtgtgcagaccattgctgctgggaagagcatgtagaaccctacctgctgagtgttttcttcttaaaaataaaaaaacaaaacaaaagaattattatgctacacaccagggtgcatgcttttaattccaactccagccctcgggacacagaggcaggcagatctctgtgaaatatgaatccagcctggtatacatagtgagttccaatatagtcagggacacatagtgagaccttgtctctaaaaacaataaataaataaataaataaataaataaataaatacatacataaataaataaatacataaataaaaagattgttattattttaaattatgtgtatatgcgtatgggtatgtgcccatgtgtagagataatctcttgtacactgtgtaaaaaacagtcacctgtcaatttaaaaaaactgaccaatgagcttaggcagaaaatcaggaggtgggacatccgggagatagaagagggagagggggatgctgggatagagacagacaggagattggccccaccctcaacccccaaatgaagatataggcagcagcaacagagtatcaggtaaccagcgacgtgacagaacttagaataaaataacaggatgattaacttatgagctagttgggggataaccaaagcctatggcatgagtgtttataaatatatttgagtctcaagagtcattattccagaagagggaccaggaggaaaaaacaggagctcacagaaaacacacaactacacccttgagtggaggtccctgaggaggtcagaagagggtattggatcccctggagctgaagttacaggcagttgtgagccatcagatgtaggtgctgtgactcagactctggtcttccacaagagcagcgagcgagtgctcctgactactgagcgatctctccagcccctggtttcctccttttcctgacctgcctgggaacctgaggtgactaaggcaggatgcttttcccaaggacacttaagtcaagtgctctggaagcttccagcttcttccatgaacaaggtcaacttttccaaactggcggagaaaggctccgaggctaatgtttttaatgcacgcctttgtttgcttctgccctgactgtggcctttttatattttatgggcttaatgttctaatttcgtgctagggccctgaggcaattcaccgaaggatgtgattttagaaaatccaggaaataaaggaattgtccgccaaagaggcatctgacaatgaattttattagggacaaagcaaatcaacctgtcgccagactgaggtattagcatgtcctggtttaatgtaggtttgtctttttaatttaatactagctctccgttcctgccggggtcagctggggatacatacccggctccttcttggctcacactactgcttgtagaaagcaccctggcctcttctcaaggcacttgccagtagtgaccagagagcctactgtgcacagcctctgagctgggggcaggtccatgtgctcagacagggaccacgagatcctttttaagggcctgttcattatcgtttggagaatgccccagaggaggaggaacttgtggggagaggctagtgcgaaagagcacgggtctttgaatgcttgcctgctcattccgcacgctcatcagcctaccataccacatcacatcatactacacatgactgtgcaagtgaaaccccaggctcatcattcacccacctgccggcgtctactttccaggtctctagttgcccgaacctatggtggccctactctctgaaggctgtatccctaaaacctgaccctttgcatccctctcctaccaatttaattcctaggggtggggtactgtggttcttttgggaacaccttagaccccacacccttttgtttcctggcggtttgacaaaacccctctgagtgtttttctttgcccgaatctgggcaggtaagccctgccttcagagaacccagcagactggccaccgtagctctagctgcatcatcaaatccatcaggccacccaggatcctgtgggcaagttgcttgactctctgaatgctggctctccctccttccaactcctcaccacctcttcttcactctcagcagaccttgcctcccacttggaagaggaaaatagaagttcaagatgaaatctcccttaacctcccactgcaaacccacatccacatgcgctcccattctctccacgagcctgctttgggcttctattgaagtcctccctcctccgttctcagaccagcccttcacccacaccaatgcctccctcccacgtaccctcagacatcgcttcccagcttcctaaaatgccccccaccaccccatctctctcccctggatctaagttgatttttaaaccaacttcggtctcttccatctcaaaacactcctcccccaataacacacacacacacacacacacacacacacacacacagagtgttagttctttttctcccctccacgcaaacctgcccaacagcccagcatctccccagccctcccacacttgtggtaccattgtccctgccctgttctgcatgcagcactttctgagtcagtcttcagtgatagcaatcagaccaagcatgacccatgtccatctcttctggccttagagcacttcccagcatttcacattactgaaactctgcgctcagctccctcgtgagccccctctggctttgctattctgctgcagcaggcttgtcttttgaacagccctacctgtgggcatgcctcaaaaacacctctggtactaccttctttctctctgtgtgttcttggtgggcatggtgtctacatctagagtcccaaagaacttctttccattgacaaatttctttcttttctctgactcagacctctaatttgtgcccaaaccaggtttcaaagtacctactagggacctgggactctctggacacttgcacaggccatgtataattcatatggtgtcctgtccctctagggctcaaattgcccctgctctccaaccagcctcaagctaaggaaacctctaaaatggagtctgtcttgtgctgtccctttgcgcccttcagtccccacatcggagtcctcctgtgccctgccagcaaggccttcacctggggtatatagctcagtggggagttcttgtttagccttcacaaggctctgttctccaaccccagcaccccatcctgggcagcacacatacacacagaggaaagcaaacatctatttgccttttgccctttctagccacagggtggatgaagtaggacagattctgcttctcctctgccattgcctccctcaacccttccccaagcccacttcctgctacctcatctaaaaggttccgcctacctgtctgcacagacaccccagaagacacacaaacaccccagaagacacaccctgaactgcttcttgcttaccatcccattccagccggagttagtggtggctgggaccagctctggggacctccataggtcattgttctatgccacagatgttgctccaccctctgtttgctaccctgctgcctgcacctctcaccattattgattttacccctcactctactctctggacacttgcacaggccatgtataattcatatggtgtcctgtccctctagggttcaaattgcccctgctctccaaccagcctcaagctaaggaaacctctaaaatggagtctgccttgtgttgtccctttgcgcccttcagtccccgaatcgaagtcctcctgtgccctgccagcaaggccttcactcgcctctccccttagttgtaacctttcccagggcagaacaaggttaagacagagtgtcactgtataggtagccatggttgtcttgaacttattatgtaaaccagattcgcctccaactcagagcaagcctctggtctctgcctctggagtgctaggatttcaggcattggacaccacccccagcttcagccataccatctgcctcaagatcttctaccaggtgcccctctgaccaggtgcctctgaccaggtgcctcttttaccaggtgcccctctgaccaggattctgctgatccagactccctcacacctagctcaggtttcttcataaacaccatttcctctgggaatccttctacttcccctaagaagagagagattccttcttcctgttattttacagtaattgctaaggtactcagttctattgctaaggagctttctaaacatttctgcttagaacgcccttccccttcctgacaactcttggaggtagaaaatggtaattatctccacttctcagataaaccaaggcacagagaatgcctagaattgccaagctcacttaataagaaacaaagccaaaatttaaatccagatcgtgtgacttcagtgtagctttcagacaccataccattccacaggaagaggctatccaccctttggtgtacgctacagctatttgtttaacaggtacctctctcattagccttggaagttctgcagacgtatagaccatgtggtctccagtagtaggtattcaataaatatctgcctggtgtctgaatgtagattagtctcctgtgtcctcacacactacgtaccacccattcctgtcacctggtcctgtgtgcttctccctggaatgtgcatttgtcacttttcttgtccctgtggccaaatatcacaagaacaacttatattagaaaggtttattatgggggctggagggatggctcagcagttaagagcactgactgctcttccagaggtcctgagttcaattcccagcaaccacatggtggctcacaaccatctgtaatgggatcagatgccctcttctggtgtgtctggggagagcaacagtgtactcacatatataaaataaataaataaatctttaaaaaaagaaagaggccaggtggtggtcgcgcacgcctttaatcccagcacttgggaggcagaggcaggtggatttctgagttcaaggccagcctggtctacaaagtgagttccaggacagccagggctacacagagaaaccctgtctcgaaaaaaaaaaaaaaaagaaagaaagaaagaaagaaagaaagaaaagaaagatttactatggctcacagttcacaggccatgaaggaaggaaagatggtggcaggagctttggttacatgtcagctgaccagaaaacagagaaagaaaaatacaagcaggccctacccagacatatccacaggagtatctcttaggtaattctaaagtccagtcaccactaaggattaattatcatatgtgcttatgtgggtcctaaactttcgtagaaatgtatgttgacacatatttctagagtgaaagctatcagcagatttccaaccagtccttgaggaacagccgcctcaaatattcccagggtactcccattctctcctggtcagtgcctcctcaacaaacacagtagcctacatccggagtcttttctgtattttggactttcttcttcccaattctacagcctagcagtacagggttctgtttggggttcccttaccaaataccaaggtggttctcacattctgactcactcagtacctccagcctctctgtggtgcttaaaagttcctgctgtctttggggctaaatttaaatgtctcttgggggttgggtgctcctcctccatgcttccatgagctctgacttctctcgacaaggtgcaccagacatctgaactgtaattactaggttattcactgtgtctcccacatgggtgatttttgagtcaactgtttgctttgtttctctttacgtgctcctagcctagctaggcgcgatccaaacatatagagctcaggtaagggtttgtttagagattcaacacactagtgacatctcatgcctcattcatggatcctaaacactgtgtgaaatgaatactcggaagctggggacagtgatcaggaagttcaaaactgaataaaggcgccgcaggcatcaaaaaacctagacagtaaatcccttcaaagggtaagaattaagatgcaggagactttttttttttttttttttttttaaatcatggcggcccagagggcgggtctagatcgggacacgccttcgagccaatggcagagctagttagccttcgtggctcagccctcttggatgggattgcccactccagctgcaagactacacttcccagcgtgccgcgcggcccggtgacgcggagccggaagtgaggaacatgaggttctagggcgcgagggaagcggctagcgggggcgagggggcgtgcacgtgaatcccctggccagatctctggcatggccgaggccaggaagcggcgggagctgcttcccctcatttaccatcatctgttgcaagcaggctacgtccgcgcggcgcgggaagtaaaggagcagagcggccaggtaagcgtcagatggcccagtacaagatctagagagcagtagcccgctcccctcccgggagacctggccagcgggagtcagagatgcgggctagggtggaggaagaacattaagctctgctctactccctgcgacttatagccacttcccagggctcagtttccccatgggtgcagtgggcgggccggaaactggtccaactagtgcagctttgtaattcccgcccgggttcccggtagcggcaggtttaagtttccctagtatctggccacgtggctctatgcagtttccctgggacaccacatgggagtccagctggagtggattgtcaccactgttgttgggaacacggagacgaaggtcccctaagttgatgatctagaatgcagggcgtgcaggcaggcccttggctgtcttcggttatgacaagacttgaacccgtggtgcggtgatttcaaagttcattcatttggcaacttttgttttgttttgttttttcgagacagggtttctctgtatagccctggctgtcctggaactcactctgtagacaggctggcctcgaactcagaaatccgcctgcctctgcctcccaagtgctgggattaaaggcgtgcgccaccactgcccggctggcaacttttaatttggccctgtcgtgcggatgatgaaatgggacgcgccagtttcagactcctctgcccgtctcacagcctaatagctggtacaaaaaaaaaaaaaaaaaaaaaaaacccaaagtgactgtacagttaacatattaagctatagaacgagaaattggagatgctaaaacatgggtggaagaacctgggtgggaaatatccaggactgcttccctaaggatgtagtagctgatctgagatctcgagggagatgggtattagaagctctgatgcgaggcttctgagtgtcctagccaccagaaagtttgctgagcctgaagtttgaaatacatgacttggaatggagtctcccaaagcagacagacaggaatggctgatgggtagtcttcccagaactgtgtgtgattaagtcactggtgaaatggatattgacctggaggatcccgggtgttgtagtgtctgcctttaatcccagcactctagaggtagaagcaggtagatctattttttttgggggggggggcaggggggtgttttgagacagggtttctctgtatagctggccttgaactcagaaagccacctgcctctgcctcccaagtgctggaattaaaggcatgcgcaaccaccgcccagttggtagatctcttaagttcaaagctagcctggtctacatagtgagttcaagaccagccaaggtttgcataatgagaccctatctcaaaaaaaaaaaaaaaaccttaagctggggttgggtgcaccctgagttggcccataactttaatcccatcactctggggaccaaaaaggatggatttctgtgagttcaaggccggcctgatctacatagtgagttccaggacagccaaggctacacagagaaactctgtcttgaaaaacaaaaaaacagacttaaagcccaaagttgctgggcccttaagatgttatctattgctttcttaatcttcctgtatggttctccatgtccattcatactcaaactataaaacagaggaaatgggttatagtgcccattgttgtggttcctgtgcccaagccagagttccctgctctcacagaaaagatgcaaatacaaacaaacaaacatacatacatacttaaatacatatatgtatgtgtatttaagtatgtatgtatgtggcttagcatattgtggcaggtgctggccataataaggctaacaagtgtcagccctcggttataattaagatggtcagagaagctttaatggggaaggtgacgttggagtagagactagaaggaaatgaggagataggctgtgtggttggcaagagagagaaagtctcagtagcaagaatggcaaagccctgttaggaattggtagcccaatatactttgtcatgacgatacagttggagcaggatggaactgactgactgactgactggactgtgcccttcagacctgacagggtttctctgtatagccctggctctcctggaactcactctatagaccaggctgaccttgaactcagagatctgcctgcctcttatctcctgggagtagagggagatactatccatttccctcttacatttatggtgctgtgaagaaggatcctgaagttggcagaggtagaagatgagctgaacggtccaataggtgctctccctgactccaggccaatctgtttcggtgctagcatgttctttcctttgcacatggctctttggagtccattggagctattcttcagtcttaatggtcacacagagtgtgtcctcaccttaggcctggattctacctgtcaacctctgttttaactccgaccctagcactcagtctctttccagacatccactgggttccgttatgtcacgtggaagctttcagggtttgggctgtcttgtatttgggggaagattgactagccaggaagccctgtcatgtggcttccatccctgtactgtagtaggatgctgggtagtgctagtttggactgttgagtgcctacctctcagaggcgcccctttccgatgtatcctattgaaaggtttgtagctggaactgtttgtccttcttgactctggaagactgtgaatggtgctggtgaagcccagaggacctggaagagcaaacggcattttccaaagcacttgttgcaggccctgatgtcagggagcatcaggcccagggacgatgcctatcgtgttgggtattttttttgaagctctctctctctctccatttctctacagaagagtttcctgactcagcccgtcacccttctggacatctatacacactggcaacagtaagtctggtggaatggaagggagggagcagggataccctaacacgtcatctttgcattgagctaatatgtgaatgtgttctaatggcccactgtgggcatacttgtcaccttcatttggtcagttccacctcccccactttccatgtgtgttctgttttaaagagaggatctcactatgtagatcaggctacccttgaactcacggagatcctgttgctgctgctgcctcttgcatgctgggacaattggagtgtgtctgggattaaaggcgcacgccttgggaggcagaggcagcctggttggtctacaaagtgagttccaggacagccagggctacacacagaaaccctgtctcaaaaaaacaaaacaaaataaaacaaaacaaaaaaccaaatgctcacacctttaatcccagcactccggggatattgaggtagtcaggtctctgagttcaagtccagcctcgtctacagagtgagttctaagagtctcaagaaataaaggaaaagaaatggaacagctgggtttttatttttttatttttgttttgttttgtcttttcaagacagagtccctgggtagccctggctgtcctggaactccctctgtagaccaggaattcaaagatccaccagcctctgccacccgagtgctgggactaaaaggcatgagcctgcacggcctggcttgtttcttctaggttgtaatcaatgcggcaggcacaagtcaaaggagatgctagtggtagtgagaactagtgaaggcaggagcctggcgcccaacctgagcgcttaccatctgagctgctgaaaagtgaggttggtagtgacagttctatcatggcagcaccgaaggcaggggatgccaggctccggaggagtactcgggtcagtgaaaatattgcccaccctccctccatacttttcatgctcctctgctgctcgacaagctcggagcacgggtgcgtccttgcccaggtgtgtgggtgttgctttctgtgcttccttccccagcaaactgttggagctgtgccacacacagtttcctgcctctgccccctctgtgggtgaggggtacagagtgggccaaagatctcacccactgagccagtccagagcagcgattacctatcaagtcaaacccagtaaacgagctacatgaccttgagcaacgtttgtgacctcctagaataacatcatctgtaaagtgaactctatcatcacgtattgggaagaagttcaaacacagtgatctatttgataacagtcctaaaactggccagtgagatctgtcctggcactggtcctcagatactacattcttgatgttacagagaacaagcaagaagggggggaaaaaaaatccctgttcttgtgaaattcacattctgttgggggatggggtgggggggtggaacaaacttatacctgtaataaagcctcttctaacagcttcctggcaggtggccttcctaggaagaaggaacctgggtaacacagcccaaactgtggacagcagtgtcaaacccagctaggaagaatggggcttaatgacttcctgccggtagaagggtggaatcaaagttcaagggactaagctgtctgaagacttacagcacgcgtgcgcgcacacacacacacacacacacacacacacactccccactctgcttccttccagactccagttcgatggtggttcctttctctaggtgtgtgccagatactgggtgggatgctgtatgctctctgggggcctgtttgtatagtagtggagtcgtccagaaatcaaccagagaaggaaacgaaactgaacgccagggcggagtgctggggggaggggggaaggggtgtcagcaaagatgcttcacgccaaactcgagagtaacgagagtgctccttcctctttgatgactctagcttgtgtcaagttaactggcaaaaccagtcagagctgggcgtggtggcgcacgcctttaatcccagcactcgggaggcagaggcaggcggatttctgagttcgaggccagcctggtctacaaagtgagtgccaggacagccagggctacacagagaaaacctgtctcgaaaaccaaaaaaaaaaaaaaaaaaacccagtcaggacagcaccacaagagaaggacgcagttctagggtcgggagaacctggatggttctgtgcagcctatgggctgtggccagtcagccgatagtagtgagtgagctgctgccgtcctgtcacctcgtcggctgcttgggaccctgagactggttaaggtgcattaggaagcgggtgaagaacagatcatttctgcactgtgtcggcgccactgtttaaactctgtgtgcccatttcctttgaaagactgaataggtaaacaggtatctttccaaacctcatggatttgtcccatctcccctgccctgcaggacctcagagcttggccagaagcagaaggcagaggatgatgagacccttcaggctaagaagtctcgagtgtcggatcctgttagcagctcagagagctcggatcaggagaaggaagaggaggcagcaaccgaaagggccaaagccagtaagagccctccttgctgtgtgagattgggacccgccttggcagttgcgggcttctagtctgctctaccggggtgtctgcctctgaatcattgtttagtgtcaaacaagaaaaggtggggcttctcagagggaggttgtagtacctgggaggccttcctttggcaggcattttaacccctgagggcaggcattctaatcctctgaggatccaaggatgaatcctaagatcccaggaggctgggtaaagtggcgcacacttttaatctcagcacagagacaagtgaatctgagaatttgaggccagcctggtcaacatagtaagttccaggccaaccagggctacaaagtgagaacctgtctccccccccaatctcccttcccccaaacaggatggcccacacagtcagttgctcagttcacttcacaaggactgtttccacagctcctggatgctgctgctagagattggctaggcatgggggggtgggggggaggcatttgtgcaggtgttgagtccatttcagaaggttgatagttctggcttctgtgtggccctggggctgctttcagacttgctggttgttttagttactgttctgctgctatgaggaggcaccgtgagcaaagcaactgacataaaaggaagcatttagctgaagggctggcttacagtgtcaggggagttcatccatgatccccatagcagcagccaggcaggcatggcaccgtagcagttcctgtgagcttacatcctgatctgtagacagtgaacagaaagctggagactgggcttggtgtaggcctttgagacctggaagcgcacccccgtgatacacctccatccaccaaccaggaaccaaacattcaaatatagtctcattcaaaccaccatactaattgtcctcttattttggcggtatgtggtgggtctggtagctatgtggcctcttctctcctgacagaagcagctagaatgctacacccagcaactggctgtgtctctgtgtcccacaaatatcatattgcttatacagaagacagtttcttgatttttaagtaggttttctgcttataaaagaagtgcaggatttattataaaatgttcattacagaacatttggaagttgttttaagaaaaggcaggggagaagtcacccacattcttgacatctatacccccacaatcttgtctttcattattcctcctgtgtatgttctgtcagatgctcaagaggacattttcggtgcatattttatatcttaatcttaaattataaatgcaaagcaggtccagtttatagacagaagcacagagaagggaaatgtaagaatccttgttgccagccccatcacttcctacccatgtctcttggtcggcagcccataaacctgccctgttgcttccagtcaaacaggagtccagctgtgtgcatgtggactgacccacagcgggcttcaaacagaaatggcaaatgcttgtgctattaggtatctgatagtaatcggtttttttaaaaataccttactctttaacagtttcatacagtatgtgttgatcatgcccatgcccagctcccccggggcacgcccccagtatgtcccctctccttagtaccctctttttgtttcccgagtttgtttttttattgttgcaatcaactggctggatccagttagtgctgcctgcagggtgttgactgatcctgtgtaggtcaccgggctacatcaggttcatgagtatgaccttgtcgtgaccatgtttcatcagctttgcattcttttgtttttgtttttgtttttttgttgttgttattgttttgggtttttttttgtttttcgagacaggatttctctatgtagccctagctgtcctggaactcactctgtagaccaggccggcctctaactcagaaatccacctgcctctgcctcccaagtgctgggattaaaggtgtgcaccaccactgcccagccagctctgcattctttttttttttttaatattttttttattaggtattttcctcatttacatttccaatgctatcccaaaagtcccccatacccttccccccactcccctacccacccactcccactttttggccctggcgcagctctgcattcttaacaccatctattctataatgctccctgagccatgtaggcttgataaatgtcccactgagggctaagagctcaggtgtcactcagtctcaactttgacaagttaggagtctctgcattgctattgcagaaaggtgaatgtgtgtgcatgcgtgtgtttgaaatgttctcatggcaaactgacagtagtaagtcccatcacttatacccccagcctacagtcttgagctagtagtcacttttaagaattatttattttatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnncccggtatctagacacaccagaagagggcatcggatcccattaacagatggttgtgagccaccatgtggttgctgggaattgaactcaggacctctggaagagcagtcagtgctcttaaccattaagccatctctccagccctataattgactttttacattttgggtttttgttgtttccccctagttcttcttgcgacagggtcctgatgtgtaccccagactggcctcaaactcagggacgtcctgcctcagctttctgggtgtctggcttaatttaagagtcctcagaagtatttatgggtaacatgacagggtgtgaagttcttcaaaataatgtatgatggggaagggaaaatgagacattgggtgaactgaggttggctacgggttgatataaagttacaataacagctgaggctgcatatcatacatacacacacacacacaaaagctggagttaggtgactttggtgtacttctgaatattttggaaactttgctcatgtgcagaaaagggagtgtcaaagagccccgaaatgaattcagtcctgccgttcatttcaacacctgtctctttagtgataacttcttcccctgaatgcctgagatccaaagcaccgtttcttaaaaccctcgagagtctgaatctcagtgtctcctactagtcccaggctcctgggtcggcacaattgacgaccacatagcttcctctatggcctggggctggctgcttgaccactgccctgcctgccagtgacttatcaggactgatgatggttggcacccaacccaaagagtagtcaccagagttgggcatgtcttgtggtggtgggtggtaagattataagcctgtcctttccctctgggggcctccagatctcatgccacagaacagctgggagtccctcggggatgcaggcacagtaaccaccatgggttctgggcgaggccttctcatggttctgggctaggcctcaggtcctcatactagcaccaagcaactagtacctgtaggaccattaggtggtgtaaagtctgcccatcttcttagatgagaagagcccaccttgctcacagcgtttgtgtcttgcagccccaagaccgacacctgtcaattctgcaaccgcagctttgccatcaaaagtaaaagaaaaggtgagtttatttccgagttactcattacctgtggaagctgtatccagtggagcatagtctgccgtgtcaggatagggtcgtgtggttcagcgtgtgtctctaggtgtctgtgacttcatctagctatgcctcgggtgccttttctgtgaaacagaagtgatgcctcaaaccacacacttgggcaagtgccttcctctgtcgtccttgcacccactcaccggttgtataaacagctcccctccagtccctggtgtgctactaggccgtcagtaccatcataaggaatgcactgtacacattttctagatcaaaaaatacttcaaaaatgtcattttccagtaatccatacacactgttgcagacacataaatgatgtgtcacccgaaccaggcgatagctatcgtatgtaaaagcaatgatgaaataataatagtatcacagtgaactatagcttcatgtaaagtaggaactactctgacccagaagcagtaatgctcccttaatgcttgtgtggaaggcatctttgtcttgctgtagagatgagatgacaaaccagtggactgtgaaaggccagagctggctgctcttagtctgtgggagaggtgggacactcagagagctcggaagtcgccttgtaggacccagtgtcctcctgatgcttttcacatgtcctgtcatgacagagtgctcatccctcccatactctgtagggaaagaccaagacagccaacaagacggtgaactctgtgtcgcaccctgggtccggaaagacggtggtccacctgctctctgggaagtcacccaaaaagtcagcagagcccttggcaaacactgtcttggcctcagaaactgaggaggagggcaatgcccaagccctcggacccactgccaagtctggtgagacccccagagcctggggcaaggggtcaggactgaacactgtggagagacattctgagtgtgggtttgtctctgacagccagggtcttacaacagccatttccaccttttctgacttcctagactattttaaatttacttttattttatatgcatcggtgatttgcctgcatgtacatctgtatgagatatcacactttgtagttatagacagttgtgaactgccatgtaggtgctgggagttgaacccaggtcctctggaagaggagtcagtgctcttaacctctaagccatctttccagcccgctatatgggctttttagagggtggcgtttccggccttctctctctggtggattatagggaacactgtggtcacctggaaactaaatgaaaaggtgtaggtcttgatgcaaaataggcctttgcccagcttgtcccccattccccaacttgatagcaaatagtgacttgattaactagcaggtacttctagcctttccaagacctcagagaggcctgcaaaaataggtagtgagggtccctgttccagctaggggactttgggtcagagcagatagcaagccctgtacagttgagaagcatgtgctacctaggtttgactaacaacctgcatggaggctctgggaggggagaggactgtgggaaggatccttagtcccctgtgtcccccccctcaggaacggtgtcagcgggccaaggcagcagttccagtgaagattcctccatctcaagcgatgagacagatgtcgaggtaattgccacccatccccagggattgatctcttccagcttctgaccctctcttgccagtgttcagatcccagtggccagtcatcagcccagcagttgtgtccgacagctgcatggttacagacagggctaggcagttggagaatgaggacctcagtactgctctggatatgctgggtatcagagtccagtgctgggagaggaagacacgggagcagagacctgagtaggagtaactgggacatgtggccaggggtaggactgcctcgaggattctgagcccagtggtgaatgtgcgtttggggatagaattggatgggatccttggtctgcagccttgtctctttgtaggatcgttgggggggtggggggtcatcacagggttttatgcaccgaagtgaggtggcctggctcgcatctcaaaaagattgctgtagcgtggcctggaggaagatttagagtaaaattagtgaggcccactggcagactgtcaggtaacagccacaggtgccagtggcaggaaccagtatgccccatatgtatgacatatattatttggcataataaccaacctctaccccagtacaaagccacaagcttataaaaacaaaagacaaaaaccatgagggtgtttatattccagttgttggatcttgggcatgaactttgtaaatcacaagactgtatcacactttcaaaaggttggacatttaagggggtagcaggagccagggatagactgtgcctacgcagctgccccaccaaacccagtggccctgtgtagcccgagccatccccttctgttcaagacttgaccacagctgttccctgcctgccgtctctctgttgggccctgagtgtaataaggcccacgggattcctctgtgtccctttactccaagccttgctcccacaaatccagctcctacgtatacgtatacagcacgtgtacagcactggcaacaggaaaccagcgcggagctcctgccgctgcgtttgaaagagggtggtgccataggctggtgtggggcgtgaggggcagcgtgaaacaggcgctgactggcctgctggctacctcaggcctgtcgggattttggaatgctaaggaagttccaggaagaagttcaagtcagtgcagatccaggctcctctgtccggaaagtacctcagtcagatgctttttagttgagtggcccctcaggatggaccctcttataaacatgtcagtgggcaggcaggtgcggtggccgagttctgccccaaaggtagccaggggtccttataagccttttgtgctgcccttaaatgatctgtgcctttttaggagaagggtgtaagattctgtctgcctctgggagatggaaaggaacatgcttttaagaaggggcttgtattccttttctgttgctaagaacagcccccataggctcatctatctgaatgcttggtcaccagggagtggaactatttgaaaggattacaagggttaggaggtgtggccttgttggagaaaccccatcaccgctgggggtgggctctgaggtctcaaaggtttccaaagtccttttgtctttgtctacctgtggatcaggctgcagctcccagctacttctccagcaacacgttcttccttttaaacgaccaccttggtcacggcgtctctgcacagcaatagggcagtgactcagacgccaaagcaagttttttaagaaaaaagtttagttgaacttatggtttcaaagggttaagagtttgtgacggcagagcaaaggcacaagaactggaaccgctcggagctcgaaccccgattcacaagcaggaggcagtgagaaaacgcagggcataagcctaccccagtgacacacgccctccagcggggcaaacacttctcgtagttgggagcctatggggccgttcccattcagattggcagagagctgacagcagagggggaaggctcttcatgtgctgcatctcttgcctgcttctaggtgaaatctccagcaaaaccagcccaggccaaagcttcagcagcccctgccaaggatcctccagcaagaacagccccaggccctaccaagttagggaatgtggcgcccacacctgctaaaccagccagggcggcagcggcagctgctgctgctgctgtggctgctgctgctgctgcagcagcagaagagtctgagagcagtgaggaggactcagacagtgaggacgaggcccctgctggtctgcccagccaggtgagtccaggggctgctatccgtgacccgctgcctgtagttccccccccccccatgctggcaaagccactgtgtgatggagaactcctgaagagggcccattctagagagagaagcaatggcaactggccagggggcttcggtgcctgtggaaacgtccactgggcccacaccgcagccagagtggctgatgcctttggggagttggggggttgtcctgcacctactctggtgatgatgttaattttcttggttttcgtgtgtggtcagtgtagctgccctcagcacagctgctcggaagagacctgaggctttcttcattctgagtcggtttccctatagcccaagctggcctctaacgcattctcttcctgcctgagcgccccaagtttgggggctacaggcacgtgctatcttgctgtcttaagttttctatcgcttcaaagagtcgtcatcacaaagcaacttataaaagcgagaattcaaatgggtgcttgcagttccatggccgtcctgactgagaacatggtgtcagccaggcatggcactggaacagtagctaaaagccttaaaactggtccacaggcagagagaacgctaccttcaaagccatttagtacaccttctctaataaagccaggccttccaaacgctcccaccgatggaaggggtggggatgggggagacacagcaagtattcagatatcacatgtgtcccagtgagtcctgagaatgttcaagggcttggttctctctttagccaaaccagaccctgagccggcaaccaccagagagaatctcttttgttcctcttctggggcctttcccatggagtgtaattcagatagcagtctcacagtcctgcacacatgctgggcggagcagaaagggctggaaagcttttagaggtagaacaagaagaagtgaaggggtctgtatccaggactggggcaggggtagggggtggggcgggggcatggcagttattaaaatgttaaagaagagttggttgacaacatgaagtggacaaggaaggacccagaaggagatgtgaccacagacctatagttgaagggtgtagaggatatagttggctgctgaagttctgtggcaataacttgggacccagcctacttggggctgcattgtgggtattggttcatgtctgaagagaggagccaaatgcagcttgtgtacaattactgcccctccacacagaaggccttagaaggtccaaagccatttattttctaggaagcttagggcagagcggacaaggccgtcatgagaagactgtagaagcttgtagccaccctaccaaacagggaggcagtggtgagcctttggctgagaacagtgaggagaatggataaagaggaggccagtgaagggactgcatctagaacagtagttctcagcctccctcatgctgtgagccaatacagttcctcatgttgtggggacccccaaccacaaaatcatttcatggctacttcataactgtaattttgctactgctatgaatcaaaatgtaaatatctggtatgcaagatatctgatgtgggtcgtgacccacaggatgaagacagctgatctaggagtcctgtctaccactggaagccctggggagtttgagcctttttccatgctcaggctgttcttgaagaactttgcatacaccccttctctgccttgagcattgctggctagttaatgagccggacagtctcacaagccagtgcttgtacccacagaacagactattccagctaaggatttaaccatttacgtgctagggctctgttcagggccagaatgaaggccactatatggtgtcactgggtgctgaggaggtcagtgctcaggaagccgagggccagccggggtggctggggcaccagtgaagatgagaaaggaaagtgttatctccagaacctctgggcttcttcctgatggcatcacctaaggactgaaaaagaagaacgggctattctttctcttcaccaggtaaaagcctctggaaaaggtccccatgtcagagccgactcggtgtctgccaaggggatctctgggaaagggcccatcttagcaaccccagggaagactgggcctgcagccacccaggccaaggcagaaaggccagagaaggactcggaaaccagcagtgaggacgattctgatagtgaggatgaaatgccagtcactgtgaatactcctcaggtaaagcctggggggagaagggaggcattatagcccagacctgaaggctgctaacctgtctcctcagctggtcccagcccctgtcccttctcctcagctgggcccagcccctgtcccttctcagctgtgcccagcccctgtcccttctcagctggtcctaaccccgtcccttctcttcagctgggcccagcccctgtcccttctcctcagctgtgcccagcccctgtcccttctcctcagctggtcctaacccctgtcccttctcctcagctgggcccagcccctgtcccttctcctcaactggtcctaacccctgtcccttctcctcagctgggcccaacccctgtcccttctcagttagtcccagctcccatcccttctcctcagcaggtcccagcccccatccctttttactggtaaggctccctgctcctgtcaggtctctgcccacatctgcctaatgatttactcctcaatttctcataccaggcaaggacttctgggaagagccctcgggccagaggtacctcagcccccgccaaggagtcatcccagaaaggggctcctgcagtcacccctggaaaggcaaggcctgtggcagcccaggcagggaaaccagaagccaagagcagtgaggagtcagagagtgacagtggggagacaccagctgctgcgactctgaccacgagtcctgccaaggtgaggccaggtgtgccttgtgctctgcctagaaaggaaggcctccttcttcaaaaccagagcacgtcccctgatcttgccctctgtcactcccaggtgaaacctttggggaagagctcccaggtcagacctgtttccaccgtcaccccggggtcatcgggaaaaggtgccaacctgccctgccctgggaaggtggggtcagcagctctcagggtccaaatggtaaagaaagaagatgtctcggagagcagcagtgcagagctggacagtgacgggcctgggagcccagccaaggtgagtcctcagaggtctcagcccgggagcctacatggccctacaccccaggtctgtcgtctgggtctctaattgctgcctgtctcctacctggggctcccactgatctcattccaggcaaaggcctcccttgcgctccctcagaaggtgaggcctgtggccacccaggtcaagactgacaggggcaaaggccactcagggagcagtgaggagtcatctgacagcgaagaggaggcagcaccagcagcctctgctgctcaggtggggaccagggaagagaggcagtctggctgtcctggcccgccccagtcagaaaccccacctctcagaattagatgggttctggttagtaaggagaccagggggagctgcatctcagaacgaattagtccaggagtctcccccaacctccatctgcactttctccacaggctaagccagctctggaaaagcagatgaaagcttcctctaggaaaggcacgcctgcatccgcaacaggagcgagcacctcgtcccattgtaaggcaggagcggtgacctcttcagccagcctgtcatccccagctctggccaagggcacccagaggtcagatgtggactcttccagtgagtctgagtcagaaggagctgctcccagcacccccagggtacaggtaagggctggatttacccaggtaggctcactcccagcccccatggggcatctctggcccttgagaaactctttcttctccttgactttctaggggaagtctgggggtaagggcctccaagggaaagctgccttggggcaaggggtggccccagtgcacactcagaagacagggccttcggtcaaagctatggctcaggaagactcagagagcctcgaggaggactccagcagtgaggaagaggatgagaccccagcacaggtgaggtagggaggaagcagcctgaaccaagactggggatgagctcagtggaggctgcccttggccctaggagcacagaatcctgggactcaggctcaactaagtctcacgttctcacacgctcttgtttcctgagccccctggctctaggttcctacacatctgggtgtgccacgcattctgcccactgccactctagacagaagtctgtggctttggccttggggaagttgccacctggggcaaggtgtgatatagtacacaccgttacagcaggatagggatgtgcagtagggctagccaagcatggtacccgagatattttaagaggagtgtcatgtcggtgaggaactgaaagtcgtctggtgaggtagagggtagactctttgcagaagccaagaaagttggctcgggtcgcaccacaagcaggattaaatggcagaggccaagagccaggttacctgggctcaagtccagttctattcctggggccttggctacagtcccatctgtcatcaatccacccttgtgggtatgggtaaggcctcgcctgccggaagcccggggacctgccttcctggccgtgggctaggctgctgggggcagagttgcaaggcacaccacctggcccgagagagcaggaaatgaaaaggagcttgtcacggtctgcgctatgggggaccttccttaagtcctaactctgtcgtacacatgagaggcattgggagttggagctactttgaaactaactagatggtgatatctgagtgagtcggggcctttctcaggtccacactcaccgaattgcactcagagcctatcagtgtctgtcttactctggctgaggccatagctcctagctgggtggtatagtgtttgcctaccatgcaccaggccctgggttccatctccggcacagcactgactccgtaatgtgggtttgtacaagctgaacaccctgacaggcatgggggggggggtgagattaagcagaagcaatgactctatcgtgttctgttaacctgcccagttcctagttcctgggctgagacggatgcttgagctctgcatttcagggagaagaaagcacagattgacgattctatatggcactcagcttccattctgtagagtagaatttaatgacagacacggagtctagttgaaagggaacctaaaaagcagttgtgtttgggtaggagtatatttaaaaggctttacagtgctgaatttgagtgtgtgttagtgccagttagactacttaaacacgtagtctgtttaatctttgcagaaatcccatagataatgttttatttttacactccttttatagagatgaaagtgaggcctggtaagattaagtggcttcttcttggttgtgttttgtttttggaatcaggtctcactgcatagctctggctgtcatggaacttgctctgtagaccaggctggcctcagactcacagagctatgactatccctgcctaccaagtgctggttaaaggtgtgcactgccatacctggcatcagggacttccttttttttttttttttttttctgaaacagggtttctctgtgtagccctggctgtcctggagctcactctgtagcccaggctagcctcgaacccagaaatcctcctgcctctgcctcccaagtgctgggattaaaggtgggcaccaccatcgcccagcaatctttttttttttttttttttttgggtttggtttttcaagacagggtttctctgtgtagctctggctgtcctggaactcactctgtagaccaggctggcctcgaactcaaaaatccgcctgcctctgcctcccgagtgctgggattaaaggtgtgtgccaccatgcctggcttggcatcagggactttttttttttaaacatttatttattttatgtatatgagtacactgtagctgtcttcagacacatcagaagagggcattggatcccattacagatggttgtgagccaccatgtggttgctgggaattgaactcaggacctctggaaaagcagtcagtgcttttaaccactgagccatctcttcagcccaaaatattggtacatcttttttttttttttttttttggctttttcaagtcagggtttttctgtatagccctgggctgtcctggaactcactctgtggaccaggctggcctcgaactcagaaatctgcctgcctctgcctcccaagtgctgggattaaaggcatgcgccaccactgcctggcttggcatcagggatttcttaaactcacactgctgttagttggaaggaggagccagcatcggctcagtgtctgcagcatcagtgttctttgatgactgctctgttgccctttgcccttcctaattcccttcccttccttccaggccacgcccttggggagacttcctcaggccaaagccaacccacctcccactaagacacctccagcgtctgcatctggaaaagctgtggctgctccaaccaaggcaagtaggaccagaaaccacaagatacgttaggataaaatctcaaaatctgtagtcccacagtgatccagcatggaccacccgctgtcccaccccctgtgatattacagccacacactagtagaaggatgactgccgccctttcctcctccaataccattgctacctctcgattcagggaaaaccacctgttccgaacagcaccgtctctgcaaggggccagcggtctgtgccagccgcgggaaaagcaggggccccagcaacccaagcccagaagggtcccgtggctggcacaggggaggactcagagagcagcagtaaagaggagtctgacagtgaagaagagacgccagcccaggtacccacccagctggacttggggttagagcaccatgtgttttggcccaggcctataggcacacttgacatgcctctccccttgctgtttctccagataaaacctgtggggaagacctctcaggtcagagctgcctcagcccctgccaaggagtctcctaaaaaaggagcccatccaggaacccccggcaagacgggatcttcagctacccaggcccagccagggaagacagaggactcagacagcagtagtgaagagtctgacagtgacacagagatgccatcagcccaggtgagctctgccaggcccgagagccaccgtcaccaactctgctcataaacagatcgtgccccagaggggagaaagaacagatagaagtcctaactccaggatcccttgcctccaggtcctccccaccatgcccctggatgaaatgagctgtaagtcccaaaccaaggccatcctagtataggacatcctaggtactcctacagctccgcaggggcctctgcagcactgggcacggcagtcccatgcaagctgagtcaggttctgctgaggaacctggagccatcctgcaaagacacccctgtcagagtcaccaggaagcttgggctacggcgcaagtctctgtctaagaagggcccgtctcgctcagtgatgcctaggcccaaggagtggaaaagaaagagaagctgtctcatactcaaaccattgtccagttctcggcccggttggttgcagcgagcagtggggcttgctctggctgacagtctctagtctgagctcaggcagcctggtagaatcggtacgtgatggcctctggtgtcgcaccttagggaggtggcagcaagatcagaaagaaaatggttggtccttgtcagtttcagccgaccgtggctttatagaaacaaagggaatgtcacatataagtggagattttgtagcttctcctgagaaacccagtcctacttgccgattgagcacaggccacccgagcagggagacatagagccctccctgggcctcccttaagttggcatcaccaccagctcttcttcactgattgacaagttctgtggctttggaccacccggcccgtgaagaatgctcttaacagggcttaagaagtgtcactcttccgcattttcccctcactgggaaccctcccgtgtcacgtgcttactcaagtcttgtcccctccaaaggatgctatctcccagcctgccagaggcaaagcgtcaggtccagcgtccccagagaagagcatagaagggtcctcagagagcagtgatgaggatctgccctccggccaggtaggctgtagctactctaaaggctgcccctggctgggccaggctgccgctctctgtgagagggtgcagcttcccaacagggatagtctcaccacatgcaggtagcacttcacagctcctagctgtcttctgatacactcctggtgtggtcgggcctcaggcttcacacccctggccccactctgctgcccaggagccttttaggactctgatgttttatgtaaactggagttggtcatggtgcccaggcacctgcctgagcactgttaggcgggcacgttgtcctggcggcctgttcggggccggggttgaggccccttatcttctcgtgaagaagtttgaggaacccagaacactactgcccaagcctctctggtccccatggacagttggggctctagatcctcccttgcgaccttcgttggaatctgtgggccccaccccaggtcaggcctatgcaatttatggcacctgctcattgtctgctggtccccactcctgcctggccttgttcccaagggtgaggtccgggacaccttctctgatttcaggagcccaacatagccaccaagatggtacaagctctgtgtgaacccaggcctttgtagaggcagcactgccctctttctgagggagtagggtatttccatttgaaggagagaggggcctgtgactctgaggcagctcagagaacatttgaatcctggcagtctgcactttctcctgcccagctgtccctttagcccccttccaggcttggcttttgccctctggctctgcagtctttctgaggtacctccctcactcctaaaggacagacagccagtatggaaggttgccttggtttttctctgtgtgagtagacttgcacaattaaaatgagcattatgctaaaattgaacctttaaagtggtcttgcagatctgggggtctctattttgaaaaaaaacaaagccaataattttctaggttcccagaaggaattcagggaaacgggcacagcccaggaagctgtggtttccctctgggagagtgctagcctacgcgggattgctgtcgctgttgggcatttatgaagcacttctctatggagagctgcagatggtccttcctagggctccccgtctggttggttgtttttcattagcctgtccgtgggagaaaaggccgggtagtccagctctgggccagctctgatcccaggttctgtcctgcagctctgtgtaatgccgtgtggagtgtaagcctcaagctgaggctggctggaacccggggtggctacaagttagaaagaagtgggcatgtgaggtaatgcaggcacgagacggcatggctgatccattctgttgtagccatgtatcgtactgcgtcacgcacatagtcatgcgtaacctcccacgtaaattattattaaatgtatcagcgtttgcctgcatgtatgtatgtatgtgcaccacatgcctgcccggtgcctgtggagacgagaagagggtgtcagatccctctggaactagaggtacagacagttgtgaggtgctctgtgaatgctaggaatcaaacccaggtcctctaacctccgagccatctctccagcccccttaaattgttttaaaggctacttcagctgctgttttgccgaaacaaaggcataggctatgtccttattgagtgagaacagggggcctgttaaaaaaaaatctaaattttagaattaagtcaaggcttgcatggttaggtctggctcccagagcgcttccttccagtcctgtatcttgaaaccagtttgctggtcgtcctggacgaggtgcttgtccactctgagagcctcagccttagctccgagtcagactggggtttataaacctcaggtctcctagctgcatccccagaaagtgtcgtttctaagtctcatggggaaggatgagcccccaggtaatagtcatcttcctcctctctgggggggcggggaggggtcctcagggggtcccagtgctgaggacacaccctccactgcactgcacctctagccccacaaagctgctttgagggaagctctcggtgactgtccccttcgacagagctccacctcccctctctgccccagactaactggaataagtagatagaagcccagctaagacagcgggcagtgggcaccgcccaaaagggccccaaatctgcttctgtaagcatcattcctgcaaataggtagggtatccccctaatctgctctcagcaccccaggggggtggaggtgagatgctcaggtggctgtggtggtagcgtcctcttccaccgctttgcctctctgatcaaagcacagcccacacccactgggctttgtgctttccccaggtgaccacacgcagcacccaccacagaatgaggagcagaggcgctacagacctaagcactgcccctgtgcccagcccaccctcatcagccaggccgctgcctcctctatcgcctgcccgctgcctcctctatcgcctgcccatcgcctgtcgtccctgcctcgagatggggtggtgtgggcaggtggggctggaggaggctgtgctgcagagctgcttttaacattccaagacgctattgtttgcctcagtgggtttgctgcctctcttggtccccaacaatctgttcttctgtcttctcacatatatatagatccccctccctccaccgcaagccttctcccactttccatccttctccttctcatcacgtgggaagggaaggctctggaagtggcagctcagagcagccgcgggggaggctgtttggcagggtagggagggcctgagcgcagcggtgccgccgccacacttggtgggtaccatagtgctaaagtttgttgctttctctgtgtctcacagcccctggggcggtgggagcttggtaaagcactgcaggcaggagggtgtccgtggatagagacccagctacccctcaggcagccctctcattagccagagcaccaacagccttcagccagcactggcgtttggagagtagaaagtggaattctagttccctaactactgcctctgtaccttcatcggctaggactctgaaaggaaatagatctggagtcccctggtatgttggtgacatatttgggaatctggtccactgccaaattgaccctcccagtactaggatctgctgctgctctgccgtctcagtgagatacagagcagacccacaggtgaagtgcatcagggcatgttagaacatatctgtaatcccagcatccaggagacaaggtaggaatatcagaggccaatgtggtaggctatacaatgagaccctgtctcaggattaaaaaagtaaaactgaaccctacgcattatcccaacctgcagctgtcccggtcctgagcaggttggctttgtgcacattctacttgagtccttgactttgaagctggtctcaggcccgtcacgtcatccatcagaatttcaatatgcaactcaaaatgataagagtcttcctagtccttgtagacacaaccacaagacagtatctcggctagaaagctgaccggcaagcaggccttgtgcctgtttctccaaagtatctgtctgatgagtggcatttttcatgcttgtcctgtttaagagtgagtctaataaataaggttagtatgtggagatctgttcctctaattccagcagtggaggcagaggcaggtagatttcttcatccaaggatagactggtctacagagcaaaacctgtctcaaagcaaataagggccacatatacacatatatcctgagcgctctagtctgttggctggcctacccatcccaccccccctgttactccaggcagtttgtgtactaaagaaactagttcagtataactggggtctgcatgctgagccacatctcagggaggatgctgtcagggtctctgggggaagggacaatgagactccagggaaatcatacagtcacactgttacaggaaatgctttttagaattccccactcagcaggtggccatctgatgtcactagaagaaaggctaaattagacattccagctctcgccttgcttccttcccatgtggctgtgtggcctgggcgctcctcttctcccctctggacttaaggctttcctgttaggccagtggagtgggtggatactgcttagcttggggtcactgtgaaggtcagctgggctctaagagctctgaagtgctgtgctgtgctgggtgtctggctgttatggggtgggagtgggcctagaagaccccaactccttgaagtttgcattacaaagcccctccctcacccatttcctctccccttcccctgaccaagcctttaatcagaggcgggatgtttctgtttttggttttcaaggcgattaaatcccctccagtttctgtcaaccgtaacagtagtccagctgtcccagctcctaccccagaaggagtccaggctgtgaacaccacaaagaaggcctcaggcaccactgcccagagctcctcctctgagagtgaggacggggacgaggacttgattcctgccacacaaccctccacctatggtaagcgctgctgcagtgggtgctgttcggccaggacgggccccagccacgcatgccctccccactgaggccagaaggcactaaccaggtggcctagcagaggcattggcgaggactggggactcagccttaggcactgtattgttcccttaatgaggaaagctcgtctgcctcattttgaaggaattacattcgaggcttctgtgtgctggctccaagcctgaaagccagagggagcattctggtggctacaggaaccaggctagtctaaaccagagctctgctatagccacctggccgtggggtacactattagcctggcagtgagcttccatccccttagcatagaaaaaggagacaggtaacattttatacttattctcttcccagaacctaaggtgactgagtgtctttgtatgtggcgaggccctctggtagcgcaatcatcttcagttatatatcaggacactgtgtcgtgccgggcggtggtggcgcacgcctttaatcccagcacctgggaggcagaggcaggcggatttccgagtttaaggccagcctgatctacaaagagagttccaggacagccagggctatacagagaaaccctgtctcgaaaaaccaaaaaaaaaaaaaaaaaaaaaaaaaggacactgtgtcgttaagtatggacagcaagattcctactgtcagcaaaatactgctgtttatttggcgagtacatagtggtgacatgagctcacattaggctgtggtaaacatctcagcacccagcagctctcccactggtcctaactgagcagttgctcactgtgacctgcacaagagaaaaagatgagggtaaggcttggagtcaccgccacagcagccattttcaaatgacatggtgacagctgctgtctggaaggcttgggaagccagcgtcccctttatgatccctaagctcagcataggtccgagggaagagtgatctggtaatgccttgctggggagtcctacggctttgtatcctgatgtgcccccccttctcctccgtttcagctctcagaaccagtgtgacgacgcccgcagccctctcacgagcagcttcccaacccagcaagagtgagcagtctagccggatgccaaaaggcaagaaagcaaaggcggcggcgtccgctcaggtactgtcgggtaagagagggctgtggtggggtcactctctgctgccttgccatgtgtcctcaggccacacgccagtcactagcttgctcccagccccctggcactgtcatacaggccaggagccaagctcccaaatcccatggtgttgtccggaagagcgggctgggagcccgaaggcaagcggaagcccctgtcctcccagcttgcctgagtgtggattcgttttctggatttgagacgctgaaaccgactcttgagttgcttgcctctcttagtattcgtaatggaagtggccttactgtttcctccagccttcacagtccagtgcattattaatatctagggcaagattagtggacaatatctaaataaaacagggctcatcccaccagggttggtccaggccagaacctgggtcctccagctccaagttctttgctctggaggcctaatggggtttgttaacgtgagggaagagtctatcgcacacccaacaccctaaggggcaggagaagaaggctgtactgaagcccctcccagcttcggggtgctactgtgccaccctgttacccggtgcatcacaaactagcccaaaaagagcctctggcggccgggtgatccagtgggtagtgagatggcctgagcatctgccctgctgggcaccgaggctgcagcaggcacgagaccttcacggagtcctaaaccagcagagacacagccattacacagaaaaagcagcataaattagttgtcaccaactgctaggtgttgcaaagggaacagcacagaacagagaataatgggtgacctgctttagaaaaggcgggcaggaaggcttctctgggaacatgagcagagcctgccctgcaggaagggaacccagaggtactagagccctaggtgattgacatagggcgggtaagataaagtagcaagggggtcaggccatacctggactgctttgtgtctgcagctccaggaggcttagcaaaggctcatctattgtctgtgtgctcttcctgacttctagcaggatgggaagcaggggtgccctgagggaccacctagccagggacacatcccagaggagacacaggcgatggccactggagttggggctgcgctgtcctcccctgggcccagattagagaacaaagccatagctcaccacctggtacccatctttccagctgcgatggctcctctgttctccaccttggcctcagggcttttcttgcttgaacatccctgcctctttacccatgccagtcatttctggctcagggtagcacagatgctgttctgagaatctatgggtctcagggcctcctcgtaccatcagtggataacagagggaccctgggtctctcccactggtgttgaaagctcattcttaaaaagccagtaagccgggggctggagagatggctcagtggttaagagcaccgcctgctcttccagaggtaatgaattcaaatcccagcaaatacatggtggcccacaaccttctgaaatgagatatgataccctcttccagtgtgtctgaagatagctacggtgtacttatatataataaataaatcttttttttttttaagccagtaagcatgggggaggggcacagcttacttactgtgcaagcatgaggccctgagctcattctcctgtacccacaggggaaagccaggcatggtagtgggcgtttgtaatcccaatactggggcacgttaaccagccagcctagcctaattggtgagccccaagtcacattaaaagacagaaggcttcatatgactgggttctcttctgctccacctcagtgaaaggccagcatggttgtgtgtgtagtcagcagcccctctttcacctccctgggcctcagtgtgctagtgccaggtaaggagccacagtgcccaccagagggctgtgggaaagtcatagaaagccatgcgtagtgcttcccacgtggagcctggcctgccgtgtccttctcactgtaacttaaccttgtgttcctactttaccaaactagaccagcagtgccgtggaaacactccccatgatgcctccccagagcgcacccatccagcccaaagccaccaacaagctcgggaaatccaagctccctgagaagcagcagcttgccccaggctaccccaaggcccccaggagctcggaggacagcagtgacacttcttccgaggacgaggaggatgccaagagaccccagatgcccaagtcggcccacaggctgggtgaggattcccagagggagggtgggagatgaggcacagcctggtagaactgtaggctctggccttctcagcccaccctggccttgtctcatcccctgataatacctttacaacttcaaagacccaactgctgttcgacagctggcagcttcttggtattaagctccggttattgaaggccccaagtcccaggactctgcttcccttggggggagggggggcagaaaagtgggagcctcaggaaccagaggggaaatgatgccattcgtgtgtcgggctaggtgctccagactagcatgggtggacagcaggaggcttcgtgcaggaggatgaggaacagagaaagacccaggcctcggaggcctcctggggagctctgcctggcctgaataacagggccgccagggactcacactcaacgggaaacctctgcttccacactagatccagacccttcccagaaggaaactgtggtagaggagacccctacagaatccagcgaagatgagatggtggccccctcacaggtaactgccaggcagggctggaacttggaagctgcctttagacttcagccaccccctggatgagtgtctagatccccattcccagggccctgggtaaggtcctgtcagtggggtgcctctaatcaatcggatagaacctcacctcatgctctggggcccagggaagagattcagatggattctgagacatgaccagagaagacgacttcttaggtctctcttaaggctcttcctatacaggacagactccagtgactttctcacgtgtggggagtgggtgcgtgttggggtcagtcctctccttccactttcacgaaggttactggattgtactcaagctgtcaggctcgactcgtgtcagtgcctctaccctctgagccatcttgccagcccaaaaaacgttaaccatcttctgtgatggtactagtccattggcaataagaaagtccccttttaatgtgccttacatatgcgttaattcacatagcttagaaggcacaagctgaaggcctatgtcccccgtgggctcagtgccgcccgctcatgcttggctgggttggcctgatccggggtcaccgactgattcccttgagccttgcctctgggatacggctaggggctcgatgcgtctttcacactggacttcttcagtctctcctctcaggttacatgactcccggcttgactgtggctaattcccaggcttcaaaagctactcctaggccagactccaactccttagcttcttctgccccggccaccaaagacaacccggatggcaagcagaagtcaaaatcccaacacgcagcagacaccgcactccctaaaaccggtgagtggggacagcaagacatggagaagcagggctgctggtccctgcttgttatgggcagcatttgtctgtgtcccttccaagagtctcatattcgagcctgtggggtcctctgggaactagaggtacccttaaatgcagctggcgcccaggaccaggttgccagctctgggcagtctgggaacagatatagccagccatttgaagctatttctttaaagcttgtggaggaggccttggctctccgtccgtccctactgacttctcagtcagtggacaagggtcctgggtatagggacccagaatgactcagactaggccagcagccttgtttagagaattcaatacctagaggagaccctggataagggacaggcctccgggggctgctctggctcacactgctgtagccttgacaagctcctgaccctgtgtcttaatcacacaaggtaagagcaatgccatcgtgcagggtcaaaagcagagcataaagaaaactgtcacatgacatttggagggacccaggggaagggactgttgggagtgcccacatccctgacttatataacatgaagcatcccgtcccactcctgtccgcttctccttaaccgcactcactgctagggttcagcccctgtgcccagcatgtaggcattccttgctgcacaggtgacctgggaggccagcgggggttctgggcccaggctctgggggctggtaacttcagcttcccagcgctgggtcagaggcggagctgttgctcactttcttcgccagtgttcttgtctatgtgagaggcgggtgcgagcgacaaggagacattttcgagggggctgtggaaggtttttttttttttttttacacgtgtagtcagcacacaattatcaaaggcaagcagaggcgtagaaaattctaaacaaaggctgcaccagaagccactctggcaggcagtaaacctgcttagtcagccactgcatgcatacacagcatactcaggagtgccccccaatctgcctgtcgccccagccttgatgggctaaggacccatggtgtgtctacagacgggagctgagcattggtctgtaggaccccctcgtgtgttataacccacagttcatggcagaagacatcattgtatgtctagcttcttcctctaaggtgggaaacagccttgagggactgtgacgccttgagggactgtgacctggccaaagccctacactaagttgataaaggcagtcctagaaccagtgtcacccatgtcccacctactgtgccctccgtctcattagcagacttcaggtcctctccttagcattctgggatctctgtcgatccacaaacatagctaagcataggagacagatagagcagagtgacccctggatctcagtttcccatttatgcagttgtaaagtacaccccctcagttgtcatgcattgtgcaagatctcaccctcagctttccagacttgtgacctccaagacctgtgatctacaggtaggaaagaggcctcctcgggctccacgcctcagaagcccaagaagctcaagaagagcacctcaagctcgccggcccccacacagacactgccgaacagcatcacccagcgcctcctggagcaggcctggcccctgagcgaggcgcaggtgcaggcctctgtggtgaaggtcctgacagagcttctggagcaggaacggctgaaggccacagaggccatcaaggagagtgggaagaagagccagaagcggaagttatcaggggacctagaagctggggccccaaagaacaagaagaagaaggagcagccagtgcccagggcaagcgctgtttccccagaaaaggctcccatgacttccaaggcaaaatcaaagcttgacaaagggagtgctggtggcaaggggaaggggtctcctggcccccaaggagccaaggagaagcccgacggcgagttgctggggataaagcttgagagtggcgagcagagcgacccgaagagcaagtcgaaaaagaagaaatccctcaagagtaagtgactgctttccagtacgcgctgccggtgcaacctgggtggcagggccctgccccggctctttatctcattctttccacagagaacaagagcctgggaagtggtttgtccagagtttaacaagtgtctggtggcaaaggcaaaaggagactgtagagctggcctgcgtcccctgcccccacggccccttacaatgcccagtatttagcctcagggtttggaaaacaaactcaaccccggcttcacaacagggagctctctgctccagcagagtccacggccagtccctggggtgtggactgtcccctgggttctcatccagagcccatctttactctagaattcagttctttggtgaaaacagccattcgttgccctccatgcgggaacctgcacccagcaggacttctgagtcactcaccagccctgggcctcgggcagtgttgttttccttttctaaggggaaagcaggctctgagaaggaaagaccactggcgctaggcagtccctgctttagttttgtcttaagacagggcctcacaatgtagccttgaccggcctggaactttctgtgtagaacaggctgttctcaaacttacagcaatccacctgcctctgcctcctgggtgctgggattaaaagggtactctaccacgcccagcatggaagtcctgagcactgccattctgtggcaggagatgtgtcacctgatctctcccaggttcttgtcccttccctcacactcaagattagatagatagacttgcatagttctgaggccagattgtgtagtccacagtcagtaagagtggagcctggcacatggatggtatcctggccctatcagggcctgatgttaagagccgcgagctgccgtgggcctcctgacgctgacccatcagtgtcaaaatctattgctcaggaagctcgctttcttcccacagaaaaaaaagacaaggagaaaaaggaaaagaagaaaggaaaaaagtccctggccaaagactctgcctcgccgatccagaagaagaaaaagaagaaggtagattgagttcctgaggggtctcagggctaggaattcaaacccttccccttctaacacctagaccaggcccatgccacctttccagtcccttaatctaatggaccttgtgaggaggagcaggggaggggtgatgggagagacctccacaggcgggacaatggtcagctttcaggttggctggccagcggggagcccactgaagaaacagccagccagccgcttcctgggatcagaaggcagttctgcccagggctggtatcagtgggtctcgatccttacacctatggggggccgtggatccttcgaagggagttctgtcctggacctgtgggacagcggtggtgaggagaagccacagaactgatagcttgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggagggagggagggagggagagagagagagagagagagagagagagagagagagagagagagagagagagagacttctttcctcaggttggttggacagcagctgctgcagcatgcagagggtccaccctgagggagtctggtgcctaagctagctgccgcccatccctcccttggttttgttcccttttgtggagataaaggtcggcaaagctgaccaaagcctggtttgttttcttctcctagaatcttggcagagtgtgaccatccatccccaggcctctgacctctggccagcgtgaattgggcctggactttttaactttccctccctcagcagaagatgatggctggcgcgtgctggccaaaccagtgaacccgcagggaagctgcagtaccaggaggaagcgaggtgggacacacaccccctctgagtgctacgtgacatgtgtatagtatatctatttttttaagcgacttgcctctctcccttcaaatccaccgtgcccagaggcctccggacctccctccatgttatctgcagagccagcaaggtcccgcgtgtggttcatcccacaccctggacccctggcgcagcctgaagccttgccccatcaatttttccagctattttggttttgttttttaaagaactcagaataaaagactttaaatataaaggtttgccttccccatgcatctgggactcggactgttactggctacttaggacagacagtgtagtgaccctggacatgcacaggtcagtactcagggctccttcctgacttcaagccaaggccctaggtactgtgagtaggacagtttgctaaagaggaaggctcagtgaagctccccagggagggagttgatgcagggacggctccccgtaggaagtggcctataagcttaaaaggagctgaaggtgggtcagacgccaggtagatggctcaagtgaccagggggcctttggaaacaagttacgatgtggagggaggcagtggcgaacagtggtggctggcatgagaagcggggaagacccagtgagctaggccttgagtcaccctctgtctggggaacagttctgtgctggtgacagtaagaagtgggcagagctgaagtatgttggaataatcactgaacattcacctcaacaaaacaaaaaaccagtacagagaaggagcaggtgcaagtctcggggaccctgtgctcagagccttgggacgggcacgccatacccaacagtcagccattccatccattctcaagtgtggatcagagtgtgggatgtaggtctagatcagaatacagagagcctctccttggctcggctgactcgcagaagtatttaaacctacaaaatggaacagcgtccttaacgttcatctcggagtccctggtggtgagggatccgctcccttttcctgtgacagtgggctaaagctgacaagacacaggtcctgcccagacagacagccactggcagcccccacctgcatccattcctgacactaggtccctgtgtccactgccatctgtcatcacacttacgctgtccttagtccagaaatggaattggggacgggaggaatggaagctaggacgtgatgagatgtgattttaaaaccgagcaggagtctgtttctttctgactgttaagtagacaccacgtgtgtctgggacccatctccccagtccatgtacgtagaggattagatttaaggttgtcctcggccttggggtaaactaactggatcccaactgaagaggcggaagcaagagtgttctactttcttcctttattgtcacttgaaccatgatcctacaggctgctgacaagcttggctgagcaaggaacctgaaagggggtggggcttgagggggggtggcaggatgtgaggaggggttactgggaggaggggcttgggttcttcttccttgaggagaaggcagcaaatgtgtccagcctaggttaagggtagggcatcccttgtccctgtctgcgggcctttatctcagagccccacattcaagactactaatgggtcagaaatgggggttccctttagatagcggtagccagcaaggccctccagcgtcctccttctgttctgacttcatttgccgtgtcctgggacgatgaaacagacaccagtctcaagccccagggtgcagggagacgggaagtggggtgtgacatcagggaacataagaagggctgaggcacaggagagcagggggcgctgctgctgtgcagagctggcctctgtcttcacagggtgactgggaagagaagcacaggttgatacagctgggccaccagtttgttgtccctgcctcctctgcccaacatcttggaactgcagatcagtctgtccccctgctaagctcaggtagtactgtgctcccagccaccatcccattctagaaaaaccatcccagtgatagtgatgaatgtcccagtgtcaccagagtctgcatgtgggtggccccctctgtgatccccccccttaccttgacccagttcctgcctggtcactcccaggccagaagataggtcttccatgtccagtggctctgcaagggaagcatcaggctcactgttatttttaccccaacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattagccacaccaagcctggcccctggtcccccatgttggagagcagcggtgaggggcacccagctatggaactccagtcagggtcaggagctgaaccagcacctccagttttttccctctgtctgggtcctctgcctgtcctcacacaaccagtgttccctgctgtaggccaagagccatgtgccatgcactgtgcctgacacgaagcaagcatgtgcaatattaatttgggaaggagaacatggtattgtggccaagtcaatccattggaccttaatttgatttttttaaaagatttatttatttatttcatgtatgcgagcacactgtctctgtcttcagacacaccagaagaggacatcggatccccattacagatggttgcgagccaccatgaggtggttgggaattgaactcaggacctctggaagagtaggtggtgctcttaacctctgagccatctctccagtctcaatggaccataatttttaactcctcaaaagtgaggtggctggaacctggcctagtgatgcacgcctttaatcctagcactgggagccagaggcaggcaaattgtgagttcaaagccaacctgttctacatagtcggttccaggactacatagactcttatctcaaggtgggtaggggatggactgtacgcaacagttaaggaccaccttgtattccttggactaagcatgtgttgagtttatagtgagcctaacccatgagtgagggccggggtcccacgtgacccaggagactacccgctggctctgatactcaccgtgagcagatgcatcacatggtcctgggtcatgttgccgtacttggtaacgttcttcacaggctgtggggaagggaacagggttaccagcattgcagggatcagcagctatagtctagtacgagtcaggtgcttgcactcaacagctcaaatctgccacctcctaacatggaagtgccagcccctcacgcccttcctgcctctatgccctctctggtcaggcgggcagaagcttgtcagagccttcccaatagcagagtttgcttcctcctcccaagccctcccatatgttccttcctgcttcacttcaaattcatggcctcttttttcattcattgtcattgcttgcatatattatatgtctatatatatacaccactagtcctaattaaacctgccccgtctgtatcatgctaacttatgtatgttttcaggactgaccatttggcaccgttcgattgatgtgctctgccctggataaggtaccaatagtaatcctatgagtaacagcatttttgcagccaaagacttggaggaactgagggactataggatgctgaggtgaagaagcactttgcaagctgtgggacttgccctttccccaccaggggagccctaagagttctggcctcctcagtcaccttgggcaagcctctctgaggtgtgccctgctcctcgccagtagttagtgcccagattccttgacaactgttatccttcggcccctccccttggcaaacaccagctaccatttccttcctgccgccttccttaccccaaggagcatgttatccatggacattggacgcatcagcaagggagtagccatccgcatctggctcacaggtttggcagctgtggggcagggaggacagtatgagtccaggtccaagggagtaaggaacccaggggttaagatttgaaacccggtgcgggggaggaagggagatcgggaggggctaaatggagaaatgatgtctgtgaggtgagggacaggtggagcacgcacatttcggaagcttcatgcgaaggctctccagttgcaggttctgggaggtgatggtcagcttgtctaggcggccctgttgctggtacaggaagtaagcagtggtggcctgcccagccaagagcagagccaccaggacagaaacaccggtgtacagagctccacggctgcacctgttgggatggagtaagagcatgatccagagctggacgctgactggaagtggggacgtaagcccggacccacgccctctcagactcaaaccctcccaatagtgaggacatctgctcctgccgccccccagtgtccttcccaggaagatccacctggggcccaagctcaatgggaaggatgagccacgttccttgcctcctctgggctttggtgtctcctctgtgtagtgacagggtaaagtccttcctccttccgagtcccctctaccctagagatctgaggagctaagcccccctcggaagtggggagggggatttgatcttgtttttgctggcagaaaaagataggtgagtttactatgtaagaggaagaagggttttcatctactgtgccgtccccaatccccacggtgacgtcaggtttaaagagaaaagggaaggaagtgcggtaggggacagcaaaagccggatttatacctgaaaaggagaagtggggcctagagtttttacatgtggagcgggaggaacattgtcaggctgaagcagtgccaggcacgtgtgcgtgcacacacacacacacacacatctccaagacaaccccctcacccccacccctgctccagagtccgtctgtcccagagtccctggaaatttgaatagatcttcttccccagtctcccagctctctcatatgtcatgtgagcaaccctcaaacccacagtgttaaaatttggctgtcctccaacaagtgtgtgtgtgcgtgtatactcatgtgtgctgtgcatgtgtatgtgnnnnnnnnnnnnnnnnnnnntatggcctagaagcatcttgtagtgatctccaactgggaaagttcaagagcaacacaggtacctaggcttcatgctcttggacagccagactctcagacttcagtgactccttacagtttgggggcttttttgggctgtgttggggtgcatgcacatgttacaatatggaacacaaggaccctgactgggcaccctgagatttcctgtccagtcttccccactcacccttgggtagggagaactatcagtaatgttatttgcacacatcccctttaagattcaagtgttggggttggggatttagctcagtggtagagtgcttgcctagcaagcgcaaggccctgggttcggtcctcagctctggaaaaaaaaaaaaaaaaaaaaaaaaaagacaaaataacaaaaagaccaaaagaaaaacaaacaaaaaaaaacaaggtaaaagattcaagtggatggatggagttaggcaccgttgtaggaaggcttaacaggggagtgagtctcctgccttttcactgcctttctatttacaacacagcaagaaactcatcattaggggctggagagatggctcagcggttaaaagcgctgactgttcttccaaaggtcctgagttcaaatcccagcaaccacatggtggctcacaaccatccataacgaaatctgatgccctcttctggagtgtctgaagacagctacagtgtacttacatgtaaaaataaataaataaatatttttttaaaaaaaagaaactcatcattagatgccagcgccttgatcttgggattctcagccttcgtaactatgggaaataaatctccagatttttattattattattattattattattattattatttatataaacgacccagtctgtggctttctattatagtaacacatactcagactaagtaagacgaactacattggaaatcctcgtgataagtttgcatcttgcctactccagcaaccaggaagggtaatttaggaaactccagaaaacctgtctgcctggtaacttatgacatcacagacacagctaattctcattggcttgccaaccctctgtatttcctaagccaagggctggagaaaggagatcagacaggagggagaataggtttaaatttcttggccttctgaaggaagatggaacctgggctcaaggtcttctgcttcatctactttggtgactcatggaacccccgaacccctctaccaccccatattcagatctagtcccagctctacctgctaccacatgagcttggggtagccacgtccctctcctttcgaacttcaacctttcagaaggccagtgaacacaggtttgtattgaagatgtgaacagtagccataactggcatcctggcttgcctaactctggggccaggaacaagacacttctgcgtgtggaccaggttagggcttggaatgagcggttgttaaataacgaagagatgaaacataaataacgaagagatgaaacacttggccccacaccggacacacatttcctctaccagtaatactgctctcaggaaggtcactatccataacaatgctgccctccaggaggctggatgtcaagcccagcatcatctctccttccacttttattcaatttaatattattttgtttttctgagatggtctcatgtagatgagtctggccttgaacccctgatcctcctgcctcca

SEQ ID NO: 1056 - DNA, 4013 bp, Mus musculus
tagcgggggcgagggggcgtgcacgtgaatcccctggccagatctctggcatggccgaggccaggaagcggcgggagctgcttcccctcatttaccatcatctgttgcaagcaggctacgtccgcgcggcgcgggaagtaaaggagcagagcggccagaagagtttcctgactcagcccgtcacccttctggacatctatacacactggcaacagacctcagagcttggccagaagcagaaggcagaggatgatgagacccttcaggctaagaagtctcgagtgtcggatcctgttagcagctcagagagctcggatcaggagaaggaagaggaggcagcaaccgaaagggccaaagccaccccaagaccgacacctgtcaattctgcaaccgcagctttgccatcaaaagtaaaagaaaagggaaagaccaagacagccaacaagacggtgaactctgtgtcgcaccctgggtccggaaagacggtggtccacctgctctctgggaagtcacccaagaagtcagcagagcccttggcaaacactgtcttggcctcagaaactgaggaggagggcaatgcccaagccctcggacccactgccaagtctggaacggtgtcagcgggccaaggcagcagttccagtgaagattcctccatctcaagcgatgagacagatgtcgaggtgaaatctccagcaaaaccagcccaggccaaagcttcagcagcccctgccaaggatcctccagcaagaacagccccaggccctaccaagttagggaatgtggcgcccacacctgctaaaccagccagggcggcagcggcagctgctgctgctgctgtggctgctgctgctgctgcagcagcagaagagtctgagagcagtgaggaggactcagacagtgaggacgaggcccctgctggtctgcccagccaggtaaaagcctctggaaaaggtccccatgtcagagccgactcggtgtctgccaaggggatctctgggaaagggcccatcttagcaaccccagggaagactgggcctgcagccacccaggccaaggcagaaaggccagagaaggactcggaaaccagcagtgaggacgattctgatagtgaggatgaaatgccagtcactgtgaatactcctcaggcaaggacttctgggaagagccctcgggccagaggtacctcagcccccgccaaggagtcatcccagaaaggggctcctgcagtcacccctggaaaggcaaggcctgtggcagcccaggcagggaaaccagaagccaagagcagtgaggagtcagagagtgacagtggggagacaccagctgctgcgactctgaccacgagtcctgccaaggtgaaacctttggggaagagctcccaggtcagacctgtttccaccgtcaccccggggtcatcgggaaaaggtgccaacctgccctgccctgggaaggtggggtcagcagctctcagggtccaaatggtaaagaaagaagatgtctcggagagcagcagtgcagagctggacagtgacgggcctgggagcccagccaaggcaaaggcctcccttgcgctccctcagaaggtgaggcctgtggccacccaggtcaagactgacaggggcaaaggccactcagggagcagtgaggagtcatctgacagcgaagaggaggcagcaccagcagcctctgctgctcaggctaagccagctctggaaaagcagatgaaagcttcctctaggaaaggcacgcctgcatccgcaacaggagcgagcacctcgtcccattgtaaggcaggagcggtgacctcttcagccagcctgtcatccccagctctggccaagggcacccagaggtcagatgtggactcttccagtgagtctgagtcagaaggagctgctcccagcacccccagggtacaggggaagtctgggggcaagggcctccaagggaaagctgccttggggcaaggggtggccccagtgcacactcagaagacagggccttcggtcaaagctatggctcaggaagactcagagagcctcgaggaggactccagcagtgaggaagaggatgagaccccagcacaggccacgcccttggggagacttcctcaggccaaagccaacccacctcccactaagacacctccagcgtctgcatctggaaaagctgtggctgctccaaccaagggaaaaccacctgttccgaacagcaccgtctctgcaaggggccagcggtctgtgccagccgcgggaaaagcaggggccccagcaacccaagcccagaagggtcccgtggctggcacaggggaggactcagagagcagcagtaaagaggagtctgacagtgaagaagagacgccagcccagataaaacctgtggggaagacctctcaggtcagagctgcctcagcccctgccaaggagtctcctaaaaaaggagcccatccaggaacccccggcaagacgggatcttcagctacccaggcccagccagggaagacagaggactcagacagcagtagtgaagagtctgacagtgacacagagatgccatcagcccaggcgattaaatcccctccagtttctgtcaaccgtaacagtagtccagctgtcccagctcctaccccagaaggagtccaggctgtgaacaccacaaagaaggcctcaggcaccactgcccagagctcctcctctgagagtgaggacggggacgaggacttgattcctgccacacaaccctccacctatgctctcagaaccagtgtgacgacgcccgcagccctctcacgagcagcttcccaacccagcaagagtgagcagtctagccggatgccaaaaggcaagaaagcaaaggcggcggcgtccgctcagaccagcagtgccgtggaaacactccccatgatgcctccccagagcgcacccatccagcccaaagccaccaacaagctcgggaaatccaagctccctgagaagcagcagcttgccccaggctaccccaaggcccccaggagctcggaggacagcagtgacacttcttccgaggacgaggaggatgccaagagaccccagatgcccaagtcggcccacaggctggatccagacccttcccagaaggaaactgtggtagaggagacccctacagaatccagcgaagatgagatggtggccccctcacagtctctcctctcaggttacatgactcccggcttgactgtggctaattcccaggcttcaaaagctactcctaggccagactccaactccttagcttcttctgccccggccaccaaagacaacccggatggcaagcagaagtcaaaatcccaacacgcagcagacaccgcactccctaaaaccggtaggaaagaggcctcctcgggctccacgcctcagaagcccaagaagctcaagaagagcacctcaagctcgccggcccccacacagacactgccgaacagcatcacccagcgcctcctggagcaggcctggcccctgagcgaggcgcaggtgcaggcctctgtggtgaaggtcctgacagagcttctggagcaggaacggctgaaggccacagaggccatcaaggagagtgggaagaagagccagaagcggaagttatcaggggacctagaagctggggccccaaagaacaagaagaagaaggagcagccagtgcccagggcaagcgctgtttccccagaaaaggctcccatgacttccaaggcaaaatcaaagcttgacaaagggagtgctggtggcaaggggaaggggtctcctggcccccaaggagccaaggagaagcccgacggcgagttgctggggataaagcttgagagtggcgagcagagcgacccgaagagcaagtcgaaaaagaagaaatccctcaagaaaaaaaaagacaaggagaaaaaggaaaagaagaaaggaaaaaagtccctggccaaagactctgcctcgccgatccagaagaagaaaaagaagaagaagaagtcagccgagcctgccgtgtga

SEQ ID NO: 1057 - DNA, 3963 bp, Mus musculus
atggccgaggccaggaagcggcgggagctgcttcccctcatttaccatcatctgttgcaagcaggctacgtccgcgcggcgcgggaagtaaaggagcagagcggccagaagagtttcctgactcagcccgtcacccttctggacatctatacacactggcaacagacctcagagcttggccagaagcagaaggcagaggatgatgagacccttcaggctaagaagtctcgagtgtcggatcctgttagcagctcagagagctcggatcaggagaaggaagaggaggcagcaaccgaaagggccaaagccaccccaagaccgacacctgtcaattctgcaaccgcagctttgccatcaaaagtaaaagaaaagggaaagaccaagacagccaacaagacggtgaactctgtgtcgcaccctgggtccggaaagacggtggtccacctgctctctgggaagtcacccaagaagtcagcagagcccttggcaaacactgtcttggcctcagaaactgaggaggagggcaatgcccaagccctcggacccactgccaagtctggaacggtgtcagcgggccaaggcagcagttccagtgaagattcctccatctcaagcgatgagacagatgtcgaggtgaaatctccagcaaaaccagcccaggccaaagcttcagcagcccctgccaaggatcctccagcaagaacagccccaggccctaccaagttagggaatgtggcgcccacacctgctaaaccagccagggcggcagcggcagctgctgctgctgctgtggctgctgctgctgctgcagcagcagaagagtctgagagcagtgaggaggactcagacagtgaggacgaggcccctgctggtctgcccagccaggtaaaagcctctggaaaaggtccccatgtcagagccgactcggtgtctgccaaggggatctctgggaaagggcccatcttagcaaccccagggaagactgggcctgcagccacccaggccaaggcagaaaggccagagaaggactcggaaaccagcagtgaggacgattctgatagtgaggatgaaatgccagtcactgtgaatactcctcaggcaaggacttctgggaagagccctcgggccagaggtacctcagcccccgccaaggagtcatcccagaaaggggctcctgcagtcacccctggaaaggcaaggcctgtggcagcccaggcagggaaaccagaagccaagagcagtgaggagtcagagagtgacagtggggagacaccagctgctgcgactctgaccacgagtcctgccaaggtgaaacctttggggaagagctcccaggtcagacctgtttccaccgtcaccccggggtcatcgggaaaaggtgccaacctgccctgccctgggaaggtggggtcagcagctctcagggtccaaatggtaaagaaagaagatgtctcggagagcagcagtgcagagctggacagtgacgggcctgggagcccagccaaggcaaaggcctcccttgcgctccctcagaaggtgaggcctgtggccacccaggtcaagactgacaggggcaaaggccactcagggagcagtgaggagtcatctgacagcgaagaggaggcagcaccagcagcctctgctgctcaggctaagccagctctggaaaagcagatgaaagcttcctctaggaaaggcacgcctgcatccgcaacaggagcgagcacctcgtcccattgtaaggcaggagcggtgacctcttcagccagcctgtcatccccagctctggccaagggcacccagaggtcagatgtggactcttccagtgagtctgagtcagaaggagctgctcccagcacccccagggtacaggggaagtctgggggcaagggcctccaagggaaagctgccttggggcaaggggtggccccagtgcacactcagaagacagggccttcggtcaaagctatggctcaggaagactcagagagcctcgaggaggactccagcagtgaggaagaggatgagaccccagcacaggccacgcccttggggagacttcctcaggccaaagccaacccacctcccactaagacacctccagcgtctgcatctggaaaagctgtggctgctccaaccaagggaaaaccacctgttccgaacagcaccgtctctgcaaggggccagcggtctgtgccagccgcgggaaaagcaggggccccagcaacccaagcccagaagggtcccgtggctggcacaggggaggactcagagagcagcagtaaagaggagtctgacagtgaagaagagacgccagcccagataaaacctgtggggaagacctctcaggtcagagctgcctcagcccctgccaaggagtctcctaaaaaaggagcccatccaggaacccccggcaagacgggatcttcagctacccaggcccagccagggaagacagaggactcagacagcagtagtgaagagtctgacagtgacacagagatgccatcagcccaggcgattaaatcccctccagtttctgtcaaccgtaacagtagtccagctgtcccagctcctaccccagaaggagtccaggctgtgaacaccacaaagaaggcctcaggcaccactgcccagagctcctcctctgagagtgaggacggggacgaggacttgattcctgccacacaaccctccacctatgctctcagaaccagtgtgacgacgcccgcagccctctcacgagcagcttcccaacccagcaagagtgagcagtctagccggatgccaaaaggcaagaaagcaaaggcggcggcgtccgctcagaccagcagtgccgtggaaacactccccatgatgcctccccagagcgcacccatccagcccaaagccaccaacaagctcgggaaatccaagctccctgagaagcagcagcttgccccaggctaccccaaggcccccaggagctcggaggacagcagtgacacttcttccgaggacgaggaggatgccaagagaccccagatgcccaagtcggcccacaggctggatccagacccttcccagaaggaaactgtggtagaggagacccctacagaatccagcgaagatgagatggtggccccctcacagtctctcctctcaggttacatgactcccggcttgactgtggctaattcccaggcttcaaaagctactcctaggccagactccaactccttagcttcttctgccccggccaccaaagacaacccggatggcaagcagaagtcaaaatcccaacacgcagcagacaccgcactccctaaaaccggtaggaaagaggcctcctcgggctccacgcctcagaagcccaagaagctcaagaagagcacctcaagctcgccggcccccacacagacactgccgaacagcatcacccagcgcctcctggagcaggcctggcccctgagcgaggcgcaggtgcaggcctctgtggtgaaggtcctgacagagcttctggagcaggaacggctgaaggccacagaggccatcaaggagagtgggaagaagagccagaagcggaagttatcaggggacctagaagctggggccccaaagaacaagaagaagaaggagcagccagtgcccagggcaagcgctgtttccccagaaaaggctcccatgacttccaaggcaaaatcaaagcttgacaaagggagtgctggtggcaaggggaaggggtctcctggcccccaaggagccaaggagaagcccgacggcgagttgctggggataaagcttgagagtggcgagcagagcgacccgaagagcaagtcgaaaaagaagaaatccctcaagaaaaaaaaagacaaggagaaaaaggaaaagaagaaaggaaaaaagtccctggccaaagactctgcctcgccgatccagaagaagaaaaagaagaagaagaagtcagccgagcctgccgtgtga

SEQ ID NO: 1058 - DNA, 58822 bp, Homo sapiens
  misc_feature (4679)..(5145): "n" at positions 4679 thru 5145 can be any base
cagggaaaggtagacaggtagttccctctgcctctaacctgctggggtccttgtcgagtcacttcctgtcactgggcctgtttccttatcagcaagaggagtgagctgggctagatgctctccaaggacccttctagctctgagaaataaaaccacaaaaataagaaattatgctgatgaggctatgaattgctacaacccttttggcagttaattgggctttagctattaaaataaaactcatgcatcccctctggtccacttgcaattacatcatacagaattaaagctccagtctgcaaggatgtatttactaggatgtttagagcaacactactctattagccaaaaaactagaggcgaataacctgtatcatatcatctcccatctctgtctgttgatggccctactgagggactggttatgagccctctggcagctggagcctgtcttgagcctcagtttcctcatctacaaccatttgacatgctttataggatgttgtgaggttttgattggttagtgttagagcctggaagcacagctccagctcactgcacacactcaacaaatgatagctgttactattactcaaaagagtgtggcagatcccagcatctagagaaatagctctgctgtattgttattaggtgaaaaaagagagttgcagagttgagtgtttagtatgattcccttttgtaagaaaagaagcaaagaagccaggtgcagtggctcatgcctgtaatcccagcactttgaggggctgaggtgggtggatcatctgaggccaggagttcaagaccagcctggccaacatggtgaaacccatctctactaaaaatacaaaaattagctgggcatggtggcacatgcctgtagtcccagctactcgggaggctgaggcaggagaatcatttgaacccagaaggcagaggttgcagtgaacagagatcatgccactgcactccagcctgggcaacagagcgagactccgtttcaaaaaaaagaaaagaaaagaaaaagaaaaaagaaaagaagtaaagagaagtgaaaaaggaaaaggagaaggaggactaaaccttatgaaggatgtctgtgtttgtctgggcagagaaaggatgtgaagggattgaataccaggcttctttctgattgggaaatgaagaggctctagtgtggagaagtgggcagggaatggctaagagggagggaaaaatgatggactttgtcttaatatatctctgaattgtttaacttgttacttcagtaacaacttgtaaacctttaaaagctcctgtgagattaaagatttcgtgtcatttcacgaaagggaaggaagtcttgggaaatctactggccaaaatgacttggcccagggaaaacctgttgttacaatggatgaagggagctactgggaagggcacccttcccagatgggcccttctcttaagagttccactactggaagggtctttgttcaacagcttcatttaacagaaggtaatgctgaggaccagagagggcaagagactggcccaaggtcacacagctgagccaggtgaaaagggcctgactcctgacagtaacacaggggagaggcccagtaacctttcccctgtatcgctgctacctcccacctctgtgtcagagccattcctgctgggagagacaggtagagtgccccatctgttgagcttccttctcttctgttgttcattcttccttcattcatttcctaagtgacctcgccgtgccctgcatgggaatccaaggtgactaaagcatgctgcttccccaagaggcactcgcagttcagtggtctgggagcatctggcttctaccactaacaaaggcattttctcttactggtagagaaatgctctgaggctaattttttttttaatgcactgttttgtttgttgctgtcttaatagttgccatgttatattttatcagtttaatgttctaattttgtgcttgggccctgaggcaattcagtgaagggtatgatttggaaaatgagggaaataaagaaattgtccacagaagagacagcctcccaggagccgaggacaaagcataagtgccgacaatgaattttattaggagcaaaacaaaaacaacctgttgccagacagaaggtattagacaatcctggtgtggttttgttttcgttctttaatttaattccagttctgcatttcttccagggtcagccaaggatgcacaatccagttccttccccactgccttccaaagccttccacattcctgcctccaggcctaaactcagtgagcaccttgcctgccctgccctcccttcttcttcaggagaggtctgtaaccattcctgcacttgccaatacttattaagtgcctgctgtatgcaggcactgtgcaaaatgttggaaataatgcaaccaacaaggcaaaggtaagtctgccttcagggagtttacattctactaaggcatgcattctcaaatggggccttgatgccctcgaggaaatgaaaactggttcctggaggtgttggtggaaaaaaatcttagatcttacaatggtttgtatgctcatcatgtacattcatcacccatccagccacccaagcagaaacctgggtgtcaccaccagttccagctcccagccctctctgatctcaggggtccctcataaggcctggcccgtgaaggattccactctctccctgcaaacatccatctgccttgcttccctcgctacccagtgtagatcccaggacccagaattttagcatctctttgccaatactttagactcctgtgcccttttttccccacccatctggcaaagccctaggcctggataaatcccactatgtacatacatctccccagcctgcagctgggtaggtgagccctgatggaggaattcactcagcaggacaggacgagacacacatacactaaggaccaccaacctcaactggggagccaaggctgtcaggcaattggggattttgtgggcaagttgcttctcaacactctgaatgatcattctttcaaactcctcaccacctcttcttcactctcagcagaagaccttgcctcccactttgcagaaaaaatagaagctcaaaatgaaatctcccttaacatcccactataaacctacatctacatctgcacccatcctctctttgttcctgcttttgggttctagagaactcatccctcctcctccccaagacgaacccccccaacccacatgcctgatcccagcccctcgcacatgcttgagagaactttactcgctgattatctcccctatttcttacactcttggttaacctctctctcctggatctgccattcacttttaaacaaatctcaggtttcttctaccttgaaacacacctcccctaacatacatattggccctagcactttatctttctcgtcctttttatacaaaaacttctcgaaagacccactgcctccctcatccctcctgcactcatcagaccactgccatctgaccccctccatcatgccacacataaatagccctccctaagtccccaacaatctccacgcctgtccataaaccaaagcccagggctgcaccctcctcctatctgacctctcagagcattccctccatcaagtcttcccagctttctaaaatgtctcccttggcctccttccataagcccactctcctgggctttctccaagctgtccagccactcctgatcagcctttgcaggcagatccttttgtacacagccctaatctgtagatgtacctcaaaacttcatcctgggccatctctcttctctctccacattcttctccctgggtaagcttctcctcatccacagccgcaattatcatctgtctatcgacaacttctcatcttcatctctagcccagacctccacgccacgtccaaacccaggtttccaagaaccttctcaacatctgcatgtggtgactgtaaggcatttcaagctcaagatgtctaacatagaatatatactttcacctctctgtccacatcctcctctcctcaatcaaaccacccccctgtctcagtcctcttctagttttttctatctcagtgaaaaatactgcctacttgtttgcacagaaacctcaaggtccattctgacattgccttttccttcccctcccattccaacacacctctgtgaaaactttagttcctgattaactctgggaaccttccactctcttcaactccactgccaccagcaccctccccgctgcccccgccacctaccacccgccccccccccccccacatacactgtcttctccctggatgcctgcctgcactcctaaccctgacttgtcttcccacatctactcatacccaccagacacactccactctccactgggcaggcacacaggtcacagtaaaattcagatttcatcctgtacctcttgggcttacaccgtcagtggcttccaatggctcttaggatggaggaaaaaaaaccctgatgtggccaatccttcacatggagtctgccctctgcccaccttctacactccccagtccccctgctctccctccggactatgctacaaaggcctttttgtgtctattctctcagctgtaccttctgccctaggccctttgcacaggttcttccctctgctcaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtatgtgtctcctccgttagactgtaagctctattggagtagagacaattccatcactagactgtaagctctataggagtagagactattccatccccaatggtaggtactcaataaatatttgctcaagaaaatgggaaatgttgaatgtgtacagacacataacattttccattcaagttcaagacaaagataaccacatacctggacctcctagggttagggactcctgcgcccgtaagaaacatgctgccctcagattctcaatgggtcggtgaagttaagaacagctcactctaacattctccagcctacctcaccttttccctgccatccttccctcaacaactacaacagcctcacatttagtattaatggtatgtgctttggttttagcaatcttttaaaaacacaaaacagggtcaacctcctcggaaaagccagtcagagactatctaatgccctcagagcaaagtccaaactctgttgggggtgggggagttgtaggccttgtctacttcttcatcctcatgtgccctcatttgttccctcttccccacctcaccccaccccacctggacagcccagcagcgcagactaggggttctgggtttagggttcccaggcaatagcagggtgttttctcatgcctagactcatgcagtgccctctgccagtcctctcctttgcacccagcaatttcgggtgtctttatgcctcagcttagatatctctctggggttcggtgctcctccttggggcgcccataggctgcatctgtccctgacaaggcacacaagatattgaactatagttgcttggttacggacagtcgtctctgtgagctttgagggcaactgccatgtattatgcatcttttgaatccccctagcctagccgggtgctagcccaagttaggtgcttattacagatttgttcagttagcgaatgaatcaatgaataaactggcaattcgtgtctggttcatgggcaccaaaaaccgtgcgaaatggataaatgagcaggtaatggcagtacaaagttcggatctagagaaagatccagattagggagttcagagatgagtaaaacgcagacccagccatcagagaattaacaaggaagataaatctcttcaagaagccagccggaaggattaaaagagagtcgtccaagtcccggccggccccgggggcgggtccctgtctagccccgcatgctccgcgccaatgggcggtattgttgatcacgagtctccgcccccttcgccttgaggggcggggccggccactcccggagaggggactacgtttcccggcgcgccgcgcggccggagcgaaagaggagccggaagtggggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccaggtaagcgttcgtgggccgtgtgcgagggccgcgtgcaagatgtggagatcagcggcccgcggcccgcgccccgtccccaggcgacccggcaggcgcccggagccgggtcccgcagtgctcgacggcgcggccaggggtaccggaggagccgcaatctctgccttcccactgcgacttcagttcccctgggcctcactttcctcatccgggcagtgggttgggccagaaagtgtgctcgcaggggccgaactttgtaattcccgcttcccttacctccacgcccttcctggtagcgggtattttaagtttcctaagtctcccgccacgtggctaggctctgcgcggccccccctggggcaaggaggttgctgcgagtctcgggggtggattgcgaccagcccctcgggggagcgcctggaaaagggaccctacagcctcttagttgagctggaactcaggcctttagcgattgtctgtactgagacggtcagctttggtactcgaactcgtggtacagtcatttcttacttgattaattcaactgttaatccggtactcagggtgcttcctggtgttcgaatggtgagcaccatctctcagccctcctggagcttacactctagtaaggtagacaaatcaaagaatcacaaaagtgactatatgcttagcaccgcaataagtgttaagaatgagagggatgggccgggcacggtagctcacgcctgtaatcccagcacttagggaggccgagactagcggatcacctgaggtcagaagttcgagaccagcctggccaacatggtgaaacaccgtttctactaaaaatacaaaaattagctgggcatgttggcgcacgcctgtaatcctggctactcatgtggctgaggcacaagaattgcttgaacccgggaggcagaggttgcaatgagtcaagatcgtgccactgcactccagcctgggcgataaagcgagactctgcctcaaaaaaaaaagagagatggatggcagattgccctggtcaggaatagctgaggtgtaaatgccttgtggtgggagggaacttgtgtacacactggcctggagaaagtccactctcttgagcccaggaatttgaggatacagtatgagccatgatcatgccactgcactccagcctgggcaacagagcaagacactgtctcaaaaaaaaattttttttaagtccatagcaggccaggtacggtagctcacgcctgtaatcccagcactttgggaggccgaggcaggcggatcacttgaggccaggagttcaaaaccagcctgaccgacatggtgaaaccctgtctctactaaaaatgcaaaaattagccatgcatggtggcatgcacctgtagtcccagttactcgggaggctgagtcaggagaatcacttgaacccaggaggcagaggttgcactgagctgagactgagccactgcactccatcctgggtgacaaggcgagactccatctcaaaaaaaaaaaaaacgtccatagtggctgaagtgtgaagtacaagggccagatgcccctggggagatggaggcaggggctggctggagtggtctggtgggcagtttgatcttccttggaagagcagtggtaaaccaatggagagttttgaactggtgagacagtatcctaagtagtcagatccctttgccctgtggtgtaggctctgctcctaatgcttgctctcagaacctcctggagggactaaagggtgatgggccctaagacgttatgtatgcttttcccagtttctctgaacctcacttgctcttcctaccgcagctatggtacttcacagataaggggagcaagagatagtacccatcttcattggagcaaaatatcctgccgtcatggagcacacattctagtaggagcagacaggtgacaaatagaaaaagtttaataagttaatgatatagtatatccaatgatagttggtgcttgctataaaaggcaggcaagggggataagggatgtcagacttcgattataagtagggtagtcaaggaagtctcattgagaaggtgtcatttgggcagagacctgaaggaaatgagggagtgagctgtgtagttaacaggggagagaacattccagacaagaagaatagcaaggccgcgttagaggcagggtggcctgacacatttgaggacagcaaggaggacactttgcctgaggtggagcagagggaaactgactcttgaaatcttagtgttaccggctcactgctgggcactgacagatggtcttgttcaaaccagatagcagcctgcaaggtaggtatcgctgttgtccccatgttaagaagaaatctgaagttcgaagacgtgacgagattagttcagtccacccgtgccccacattgcttagcctcattagagtacttgatatcctggcttattgacatttacagagacattgggccctctggcctctgctccaaaggcctggattccacctggttccctctgcttccaccaagggactggtaccatttgggcccagtcttctcccagcagactagtagactgtggtcatgccacctggatgcctcaggtgtctgggctgtgattcgtgctttgggaagattggctggccacgtctttgaaagcttttttaaaggtcaaaggtggggaaaaccctgtctcatggcctctaggcatggatagtgccagagaggctgggagctggatgaatgctagcttggaacattccacctctggcctttcaaaggggttgtctaaaaaggttttagttgggattggttgttcttcttgtctctggaaggtttgggacagaactggcagggccaagcagacatacttcccagagcaaaaagaccctctttttttttttttttttttttaaagaaagggtcttgctctgttgcccaggctggagtgcggtggcacaagcatggctcactgcagcctcgatatcctgggctcaagtgatcctcccacctcagcctcctgagtagccgggaccaccagtgcatgccaccattctcagctaatttttaaatttttttatagagacagtctcactatgttgcccagactggtcttgaactcctgggctcaagtgatcttcctgcctcagcctcccaaagtgctgagattacaggtatgagccaccatgcccagccaaaaagaccctcttctgaaccacctgtctatacaagtcatgagtttggggagatctgggcccaagaaggatccttactgtgctggggattaattgtggctttctctttacctctctgcagaagtgtttcctggctcagcccgtaacccttctggacatctatacacactggcaacagtaagtggtggggcctatagggtggagtagggacggacaccccaagcaactcagcttggaataagctgggatacctatctggtctaagatctgtccccatagcccactgtggacaccattgttgcctccagaaagccagctcacatcacatggatgggtatttctgtgtggatatctggtagtgggaggggacattgagagctgtgatctcttaagaacaagagcttctcaccagcttgtcagttgctcagcaaacgtatattgagcacctcctgaaagccaagtcctgttcttacttagtatgcaaatattgtcacaagtgagacagacatggttccttctttcctgcagctgacattgtagccaaggaggtaggcataagtcaaagaatgaaacaaatgaatgttaaattacagtggtagtaaggattacaaaagagaggaatctgttgccacagccacataaatgggtaagtctggcttcatctgggggtccaggggaagcttccctgaggtgatctttgacttgagagctataggaattggaggagtgaactatgcagtgggtagagagtggcaggtggagtgtacctgccagtggaaattgctaatgctaagtcctgtggctggtggacagtacagatggggctaggtcatcgcatggatagccatgcatgggctggttatccatggtgaggaattttgtctttatccaagagcagtggggccatggtagggtgaaaaagtgaggagattgctctgcaccatggtgagactggtggggccatggtcaccatcgtccaggcaagagctgatggggcttgacacagggagaacagggtagaaagtggattcccaagaatcatagggatgaaaccagggcctgtggatgggtgggagaggaagtatcttattgactccacatctaacttgtgtacccatgcatagagcttgaagggaactcagtttggaggggaaagatttcaatgacatgttgagtgtgagatgccttttaaacatgtaaaatttatgtactcttcaaggaagggggaatcatccaaggatatatcaacagaggaatggttggaaaatggagagagtaattgtgttctcttcatgcactggcctgaccacagctgactaagggagtgaaggacatgcagacatatcccatgaggaatggtagagagtactgaattgccttggatggaaaggaggcaggagaggggtgtgagggaccactgcacatctttgaggaccaagaatagtgcgttctctgaggccccggagacagaagtgggccccaaatgtacctgcttcaggaagacaggtttcagcttctgaatataatgacatcagagctatctaaaaatgaggtgggctaggtggaagtggtgggctccctgtcattagaggtgtgtaaacaaaggcaaaaatggtgtggaagggattacagcctctggtggagagctaaggtcattgaaaaccctgccaaccctcagtcctctgctgctaaggagagcttagagcacagggcacagcccacacttcctcaccctgacttgcccaggtgagtgggtgttattcgtagtacttccttcccccaaaaaactgcttcagtgagctactctgcacactcttccctgccactggccccttctatgggtgagggggacaaggacctcaaacccacgaaaggcagcctagcctagcaattccctgcagagttcaaacccagcaactagctgtatgtatgaccttgagtggatttcttggcctccctgagtctgtcttcacctataaaatgaaaataatgatggcaattatctcattgcattgtgagggttagacacagtgctccatataaagtgctaaaactaccggttggaggctccccgacttcctgcacccgcctcagtatttattaagcatctactacaacccagcaatattcttgatatagctgggaacaaaccagagaaaaatccctgctcaacatttttgttgggggaaaagaggcagaataaattgatacatgtaaaaatgaaacctgtttttaacaggagaatcctgacaagtggctttcctgggaacaagggaccctactatcacatcccaaaccatgacagagcagagtccatcgcagctgggaaacctggggcctagacagtgactccctgggatgggggtcaatgggcgtgagacttcaaagtccagggcctcagccatctgggtgcttatcctacccatgccctagactcactttgccatgagcaagtcacttagttgttcagtttttgagacatgtgtgaggcactgaggatactgtagtgagctgccagctgccttcctccctgggcctttctgtgtaggggaggagtctaggaagtaagtaaaataacaggagatagagaaaagctatgaagaaaatgaaacaggatcacagggcagagcatgccttggaagaggggcaatcttcgagggcctctcttggggggctacattaaagttgagacgggaaggacgaggacctgggcagagtcttccaagaaggcacagtacacacagcatgttctgcagggggaagagcctgggcggttctgtgaggtgcctgcatgggtcagctcctatcacttaaagactggtagctgctgcagctgttatataacattatccagcattcctgattattttaaagactaatcaagaattgtaaaagcactttatgaagtgagtgaaaatgcagaatacaaaattgtgcctatactgtgttttcaccactgtttagattctatgcacattgcctttaagagctggaaggatgcgggaaggtctgtctagtcaattcttgtggagttgttctgtcacccagttggtatagacagtcacccttgtcctgcagaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccagtaagagccttgcagctttgggaacaggctatggaatattgattgttctagggtagagtctacctccagcttcttctcttatcactagaagacctaaaagaccctggggaggagattgggagggcaccacatatctttggcagtatttgagcccttcctccgtgccaggcattatatctccatgctctgggggtgcaaggccgaaccaaaacaaccagatgggcccttccagtctcatttggtgtatggggcccaggagctgccctattacaggctcccaggtgattcttattagctggaaagaagacacacgttcagaagtactgctggagggatttcagaaagcagctagcggacacattttctgtgtgacctgtgggatgctttaggaattgctgatcttcatgttcgtttagaattgtacccattagcactggaacgctgtactgggcactggttttacaccgtttgcaggagtaactcagtcaaagcttttatagccccttcttctcctaaggtcccagggctccttgtactttccccaacagcagccataactctacagaggaattgctgtgtctcctttgcatcgtattatcttcttttgcttacatagaagacacatttcttaatacttattttttatttttcaagacaaagtcttgccatgttgtccaggctggtcttgaactcctgagctcaagtgatcctcctgccttagcctcttgagtaggtggaattccatgcacataccaccatgcccagcttcctgagtctgcttttaaagtgtttgagatcatactaggtatatattttattatttttttgagacggggtttcactcttgtcacccaggctggagcacaatggcgtgatgtcagctcagggcaacccccgcctcctgggttcaagtgattctcctgcctcagcctcccgagtagctgggactacaggcatgcaccactactgtcagctaattttgtgggttttctttttctttcttttttttttttttttttttaatagagacggggtttcacaatgttagccagactagtctcaggtgatccgcccaccttggcctccaaaagggctgggattacaggcatgagccactgcgccctggatatatattatatatcgcttaattttacattataaatgcaaaacgagttcactttgaactgtagaagagcatatagaagaaaacttaaaggttttttgttgtcctaccctgttccctatcattcctaagtgcatctcctcataggtaacctttaaaacttcctcctttgcctctatattcattcaaacatgtattcttacatgcatatatacagacctgcatgctatttgaaacacaaatggtaaaatttcttactgattggctatttggtattaatcaattttataagctgtgataatggaggtgtaattacatttttttgtttgtttgtttggggctttttttgatatgaggtcttgccatgttgcctagactggccttgaactcctggcctcaagtgatcctcctgcctcagcctccgggtatgtaattttatttttttaaaagtcttcactgggttgggcatggtggctcacacccaccggtaatcccagcactttgggaggtcaaggtagaaggatcacttgagcccaggagttggagacccgcctgggcaacatggcaaaaccctgtatctacaaaaaatttaaaatttagccaggcatggtggcgtgtgcttgtagtttcagctgcctaggaggcctgaggtgggaggattacttgagcccaggaggtcaaggctacagtgagccatgactgtgcctgcactccagcctgggcaacagagcaagactgtctcaaaaaaaaaaaaaaaaggaagaagagtcctcgttggcatcctgggcaacatagtgagactccgtctctgcaaaaaataagaaaattagctgggcatggtggcatgcactggtggtcccagctactcaggaggctgagataggagaatcatgtgagtccaggcattggaggttgcagtgagctatgaatgtgccactgtactccagcctgggcagcagagcaagaccctgtctcaaaaaaaatttaaaaacgcatcctcattgagagagaaacatgctgaagtatttgtgggcaacgtggtaggatctatggcattttcttcaaagtaatgcttgatggggaagggtgagtgagataatacatgagatgaaaagattggtcacaagttgttaatggttggagctgcctggttcttcctttctatttactacttaaaaattttccataattacagaaagagagagatggagtgaagtgccaggaaaagaattagatcatgccattcatctcagcaacattcttcttaacaaaaagaaatctgagatttaaggagacaataccctggtataaaagcactgagaagctgggtgcggtggctcatgcctgtaatcccagcactttgggaggccgaggtgggcagatcacgaggtcaggagatcaagaccatcctagctaacacggtgaaaccccgtctctattaaaaatacaaaaaattagccaggcatggtggtggacgtctgtagtcccagctactcaggaggctgaggcaggagaatagtgtgaacccaggaggcggagcttgcagtgagccgagattgtgccactgcactccagcctgggcgacagagcaggactctgtcccagtaaataaataagcactgagaatcagtgaatatcgatatctaacggggcccaggtggcatggttcagccacctctccactaagaagccatttgaattccaggcaactttctctgtggacctgaggctggctgcctgcctgaccactgccccttcttgccgaacagctttcagggctacagtgtggtggcctgtgtgaatggtgcccattgcagtgtgcagtgcccagtaggcagcaagaatgtgggccagtccttttccctccaggggcctccacgtctcatgctgcgggggagttgggaatccatcaaggatgcagacacatagcttcatgttaccatcctcttctctcttgctcctggtggacctggctgatgcatcacagagctcattcctgcaagtctgggctcagcctcagatcctcatgccagcaccaggcagccaataccaatagaattgttaggtgagatgaaacctgtttgccattcatagatgagaaaagctcatctggctcctttagcagatgtttgtttcttgcagccccaagactagcatctaccaactcctcagtcctgggggcggacttgccatcaagcatgaaagaaaaagccaaggtgagtgggactgccttccaagctattgcctatgggatttaaggtgcctggtaggggacagtcttacatgtcagagaaggatagggttgtgagtaattgccccacctggattcagagctcaacctgtgtcaccagttgtgggatcttagtcccttcacctctctgggcctcagtttacttttctataaagataaggatgatgcctgctgcagtgggccactgggcacattctacacctggggtaggcgatttctttcctctttcatgcctgcgttcacccgttcactcaacagatcttgactaatacctgttatgttccaggcactgtgctaggtgtggaggcaccgtagtgatcaagacatctgtggttctgaaactctaaaagcattttccaaactggaaactgctcaaaaaacaaggtgtcattttctaataatccagaaagcagagttagatacatacatgtataaagaattgtgcctctgcgattgcctggagcattagcaacaatgtctcaaagtaattatgaagtaatgataagatcaacaacaaactgctacttaccacttagtaaataactaccatgtcccaagaactgggattctgttttctcaacacctctggtgagaggaggtgctgtttttaacctcactttaaagattgggaaacagattgaaggggtagtttacccaaactcacacagctaagaagtggtaagattgggttcagatgcaagtggcctgtgctcttagttcaccatgccataccagatgtgtctgtcactcttgttctctgtaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctggtaagaagtccccacctctaggaacctagtccccagaacttgggctggtgaggcaggcctaggcattgctttaagttctgggacatttctggaatcaaaagtttgtctccaggacagccaggttcctgcatcttaggacttttctcatcacctagacgagggagggtcagcttacagggacctggcctcaggctgaacagcccacctggtggttggagcattttctgctttatgactccctggtgagttacagggacaactggcagctcagagactaaactgaaaggcctgatttgcctctgtttcctatgtagagtagacatctgtctggcctgcatcagtggatatgatggtggatggaggttctgtagactgtcaggtgctggtgcatatttgttgggtcccctcacagcccttcccagggcctcagagatgtgtgggaacatagggatggtgatggtacccacctcagaagggggcttcacagctcagtgcatgtgaggcacacgaggggtgagcgctcagcacctggctttgatgagcagctggtttgtggggaggtgctggggaggggcaggtgaggctggaaagggagtccctcagtcccctccgtgtccgatcctcagggatggtgtcagcgggccaggccgacagctccagcgaggacacctccagctccagtgatgagacagacgtggaggtaattgccacccatccctaggagttgccctctcccagcctctaacccttccaggaacctgtctggggcttcagacaccagtgggcccagatgagttcagcaactgtggtagggtgaccaggagctggaaaggctgcagccggagaggggcagggagaggagtctggtgctgcttgctgcactctgagtgtgagatcagccctgggggcaggagagggacaccctcctgcctgtgagactagacaagccttcctgggagaggtgccctggagtagggcctcaaagcacagtgggcttcactgggaagggatgtggaggaggcagggcattccagacaggaaatggggcaagaacagggcccagaggcaacagtgtggctgtcgtggtctggctagggctgcggctgctgagagggttctgggccaactggtgaatgccaggcctagacacttggctagagttgggcaggactcttgggtttgtgaactttgacctggaaaaggtctccacaggttactttttattgtgtacctactaagtggcagacctggggaatatagtgatgagcaggacaggcagagttcctgctgccatggggcaagggagcgtccctcagatatttaattggtgatggctgctatgaagtggaaatgtagagggccacgcagggcaggaacctgacgttgatgagtaggcgtaagcagaaggaatggcatgtgcagagaaggcggcaaagagagtttggtgcttttaaagaacattgatctttttttaagacagtctcactgtgtcacccaagctggagtgcagtagcgcgatcttggctagctgcaacttccacctcccgggttcaagcgattgtcgtgcctcagcctcccaagtagctgggattacaggtgcacgccaccacgcctggctaatttttgtattttttgtggagacagggtttcaccatgttggccaggctagtctcgaactcctgacctcaagtggtccatgtgccttggcctcccaaagtgctgggattacaggcatgagccgccacgcctggccaaaaccttgatctttaaatgagagggagaaaccaggcacggtggctcgcacctgtaagtgcagcactctgggaggccaaggcaggaggatcatttgaggccagaagtttgaacccagcctgagcaacatagtgaaaccctgtctctacaagatgttattttttaaaaaaacaaataaattatggggaaagtgacacaagatgaagtcctaggtagacaggggccagatcttctgtctgaccttgaggaccaccataaggaatttgggttttattctaggggctgtgagaagccatgccagcaaggagagatggcctgatttgcatttaataagattgctggctgcagcctgggttggagggcagtgcagaataaaagcagtaagaccatgtaggagactattggagtaatactgatactggcataagaggctgggggctgggagaccaaggtgtccacagttggaaagatgttttcaagggaaaaccagcacaagtcagggatgaactgatctggtgcccagggaacttctcactttactgtgctgcctggcccagtaaccctgtgaaggttgaaagctcacccccatctaccccaggccttaccaagggctgccctccaccttccgtcctcacccttgcgccctagataccaccagctgtaaggacatccctggcttctgtcaccccaggccttgccaaagggaagaagaccactcccagccctccataaacacacaacctcaatgggctgaggctgtgcagagctccagtagcagacgccccagaaacccagggccgcaaggggtctgatggatctcagaggtagaagtagggcactgactgcctgggaaatgtctgaattgtggaagtgtaggaaagagctcacagagggaaggaatttgcccaaggtgtggcaagccagtggcagaggtggtgttcacatcctgaactcctggccctcaggagggctgctgtgatcagatacttgagtttaaggggcagacaggatgcgctctcctgattgagatgcaagcccttctctcaggccaagcccggtgtgtgccaggtgggagatgaacgtaatggttttgagatctgttccaaagtcagacagtccagggttccaatggggctctgtcccttcatattgatcatgagtgattttacctctttaagccttgtgtacttttctggaaaatggatctaaagctaatagccgtctcagggagttgcttaaaaatccagtgacattaggaaagagctttatcaactgctgaagcccctaatacagaaccttagggggaaacagtaattattattcattttctaattccatcctcttgttccaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtgaggcctggaggagggctgccccttggaggacctgcgggtcccccagcagcctgagcactctgccatgagcacctctgccactggagttggggagagggaggactatggtgtgaagttgaagagcaagaacagcctgcttcccacaggggagtcttgcactccactttgtctgtgaccaactttacctcagtttctctgcctagtaaatgggccgctgtcctcgtcccagccagtcctgctgtgagggacttgagaagttttgattgcctaatcctctgacttctcaggacaaaccagaccctgagcaggcaaacactacgttagctaaagggaatccagttcccttccccatctgctgggagtgggcagggctgcagccccaaggccctgggtgtatcccaagggcaagacaggggggctggaaagcaatggaagtcagagcaggaaggaggaagagtgagggtcacccacccagccccaggcctgggcaggacaaggcgggggcatgcagtagataagcagatcccctgcgttagctgctggtaaatggtaaagaggaagtgggggacataggaatggcaacttgaagcagagtgctctgggctggccttgggagaaggcgtctcagtaaagaccagaaggaggaagcactcttaggaaggtcattccaggcaggggctcagcaagtgtcaaggccctgaggtagaagtaggactacgaattgtgacaaattgttgttcccaccccatctacagggaacttctacgcctcggctgtctattttgcagtgtctgggggctacacagtgttggatgggcatccactttgagaaggaacacaaatgtgaattttttttttgagacagagtcttgctctgttgcccaagctggagtgcagtagcggcaatcatagctcactgcagcctcactcctgagtagctaggaatacaggcacacaccaccacacccagcttgtgtgtgtgtgtgtgtgtgtgtatagacagggtttcactgtgtttcacaagctgtggactcaagcagtcctcccaccttggcctcccaaagtgccgtgattacagatatgagccaccgcacctggccataaatgtgaacttttatgtaaaatctgctttctccatgttggctcaaaaatttaaaaaggagctagccaagcaagacctgtgtggagcagcctgcactttctgcatgagaagcttcttagaagatcagagctgctgttttctagggttgttggcccagggctgaacacccagggccttccagggaagacagggcctgcagccaccctgccaaagccccaagacagtgcagagccccaccgaggagttagtgaagagggggccaggtgtgcaaaccttgccccatgaggctgagggtgggcttccaggggtcctgctgctgtccatgtgcagaaagtccagtgagggcctccctcagtcccttccccactttcagactgcctcttcattccttcccttccctgggcctttgcacaccccctccccacagcccagtctgatgatgctcccgataagccagtgcctgtgcctccagagctctctggccagtgggagcccagcagaggacaggctctaactacccagtgtgctggggcaccagggggaaccatgttaaggaagtggtgtctcttagggagccagagacagaggaggcagtggctaagtgaaatggaacagggggcatggaggctccaggagtgagagtgtgtgaagctgatcgatttttgagaaaccaggaggccagtgtggccaaagtatcagtcaaggtggggagtggggagggaagcaggggaggtcttaggagcctcattaaggcctctggactttatcctaaaggcatcaccagagagttttcacaagcaggagagcaagctgccctttctttttcaccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggtgaggcctgaggagggagactccatgcagccaggcccgtccccagaaggccttctcaggacttgttctcccactctgggccagagccccgggcgtgcctcagaccccagccccttactcccctctcactgtgtggcatcatttgccctatctggtcttctgtacgtggtgtcctgtgtctcctcacacgtccatcctctgggctgtctccccttgtcttgtttctccaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggtgaggcagaggggaggggtggagagtagccccatgcctaaaccccagcacctgcatgggtgtggccacctttgccacatccagctcctgtctccacacgtccaccctctgggctctcccctcatcctgtttctcactccaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaggctggaagccgccctgcatggcctgtgccctgcctcaaaagacctcctgtggttttgacttttcctctctgaacctagagccctgtgcggctggcttcgtttgctctcctcccctcactcacattctccttctggactccctccctaatcttgtcctttgtgtctcccaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggtgaggccccttcctgtaaggctctttctttttcccccccactcagagtggagctgcctgtggcctcccaacctcacactgggactctgtctacaatcttagtttcttaatgtctgcacacacctaccctgggctccctctcccgatcctgtgtatctcactccaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggtgaggcctggggaaggaggctgctacatggcctgatctgccacaccacagtcagcacccccggggagctgtgctccctcaggcagagcatgggttttggctggtggggcagaacagatgggggactctgagttcaggaaccttctccagcctttctttggtgtcccctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggtgaggcctgtgttttctgggcgggcctcagggccgcccctacgtggtcctttggactcctggagacacctctcttccccttgtcatcccaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaggcctagaaggagcaggcccatcccacccacacctgttcctgagccagggctgaggatgggcttgactgggggctagtgttgcctgcaggtgtgcagaagcctcagaggtagcctcaacacagcttccttccctatctttcactccatgtctcctctgcccatcagagctccagggtctctgtcttgtttgccttttgaggtcctcctgctgattgattccctgtggttttcacaagctctggagttcccaccctgccaggtgctgcccttgtctggggttgctgaggccctgttcctcagggaagtcctgtctctgtggagcatggacatgctcctgcagtgtggagcgatggggttgagatagagggtgtgagcctgggctgcgcagcatgacaggtgagagcatctaggccttttacaggaggtggcagcatctgagccatgggctgaaagagttggccaggtgaaatgggcagggagagtgttccaggcagaggaagcagtctgtgcgaggccagggaatgagagagtgcctggcttgggtgccttgccacaggcggcacattgtggtgggatggctggcagttgtttagagccagaccgcctgggttcaagtttcagctccacagcctggcaagtgctgtaagccctcagagcccttactctcctataaacaggaaatcagccctcacaggtttgggtgagaatttaggtgagatctcacctgctacacccagcaagggagctgcacacagcaagttgtctctgtcaccctgacgatgggccaggctaatgtggaacagatcaggagtgaggtctccaagcctggaagagctgagagaagatggctcactccctgcactcacccacccactgtttattatttttaattgtcgctctgtttttttctgtaaccactcagaaattagtcatttcttttttctctgtaccagagcacacatttctactgatttttttttgtcctcctctcgttgacttgtgggacctcagggctctagaattcctccattgaggtttttaagctctgcaggggccccttccagagccgcctctactctttcccaagctgcaggcacattccagacccaatgccttacagagtttcattatgcagctcacttaaatatttgtcttcccttctgagcctcccacctgtaccatgaggtgggtgttttatttttattttttgaaccatgggctattttgaagtaagccgtttaatttccaaatatctgggattacccaggtttctttttgttgatttctaatttagtcacattgtggttggagaacatattttgtatgatttaaatccttttttgtgtattgagacttgttaggtcaagtcagtcttgtgtcttgtttcttgtggaaaacatggctcccctctggaggatttacgtgctctactgatgagcacctcggcctgagtcatacttggtccacactgtagggaatcttcttgaagtcctgattcttcacctcatttgacctcatgtgtttgaggaatgctgggggatggggttgttttctgacactgaccagatgccatccctgagtgaggcaggggccttgagatgctgccagagtcctcattctgtttcacattaggcttgctgtcactcctgttaaggatctcactctgggaatttccctttttttttgttctccttctatttgttggaatccctgacaggccttttgggggttctctggatatcggttaaggctagattaagctgaagaaaaccttaaacaacaagtatcttgttctgccgtggctgcttgagctccagctctgacctcagcattccatctagcctggaggaggaagagacatgtttctgaccttttatggcactcaacttacatcctatgagccagaatttaatgacattgccacctagctgaaagggagcctggaaaacatctgttttaggtagtcttgtgcttagctaatgctaaggaaggcacgcacaatgagtttgagtgtttattatgttccagacatcatgttaaactctgaatctcctatttagtcttcatcataacccgtaggtgggccttattattatctccatttgatagaggactgaactgaggcccagtgagatcaagtgatgagctcaggttcacacgcctattgcatggaggagccagaatccagactcgggctccagctccagagtctgtattcttggctagctgctttactcaatctcaccttctccctccttaattcccttttctccactcaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggcaagtggggccagaagccacaggaggtgtggagggttggggtagagaggaggaccagtcactgagcccagccaggagaaggtgcgtgcatgggcaggccacccacccagagttgtgccatagtggggagtgggacctgaaaggaatcacttttgcctccaatactattatccccctgcaattcaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgagggggagggaatggagatcatcccctacatgggatgtaacacctttgccacatccagctcctgtcttctcacacgtccaccctccaggctctctcctctcatcctgtttctccctccaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtaagacttgccaggcctctgagccaccaacactcactcctcagaacgggggtatagggctgggcgtggtggctcacacctgtaatcctagcactttgggaggccgaggcagatgtatcacttgaggtcaggggttcaagaccagcctggccaacatggtgaaaccccgtctctactaaaaatataaaaattagctgggcatggtggcgggtgcctgtaatcccagctactcgggaggctgaggcaggagaatccctagaacctgggaggcggaggctgcagcaagccaagatcatgccactgcactccagcctgggtgatgagagtgagactgtctcaaaaaaaaaaaaaaagaaaaaaaagaaaagtgaaaaaccagggtttagggccaggtaaggaaaagaaaggaaggccaggttaaggcttaaggctccagctccaccatgccctcctccgtctgctgtcatccacatctccttaggtaaaacctgctactaaaaccccccaaacgaagacttccgtagctaaaagtgtcctgggtctatatctaggtcgaggtctccaccagctctataagctaggccagtatttcccaccaaggcatatgagaccaagaatctacatgttagttattgtgcatacgttaacgttatacaaaatgactctccctgtcagagtcccagggaagcttggagtgtggcacaggtccccctgaggtcctggagagatggaggaagtctcatcctgcaccttggcccggagcctcacataggcaggcgcatcttctcaggcagggcttgtctagcttagtgcaaagcctggaccctggagagtggggagaaagaaaatctgaacaattccctctgtctgcttgcagaagatagcagggcttgctacatcctacagaagtgtaggatgacaaactccagcactgccaaggcacaggtgtgtgatggaaatgactgatgcaggcctggcaggaatgatagatgtcggccgggtgcggtggctcaagcctgtaatcccagcactttgggaggccaaggcgggcggatcatgaggtcaggagttcgagaccagcctggccaacatggtgaaaccctgtctctactaaaaaaatacaaaaattagccaggcgtgatggcaggcgtctgtagtcccagctactcgggaggctgaggcaggagaatcgcttgaacccgggaagcagaggttgcagtgagccaagatcatgccattgctttgcactccagtctgggcaacagagtgagactctgtcacaaaaataaaaaaaagagatgataaatgtcaggagagatggtagatagtggtagcaagtagggcagaccggagagcccttgccccatccagaggggcagttcttatcagcttcagccagtcatgactgtggagatggaccttctgtgtggccaggtcttccatttcttaagggaagctggaagtccctgtgccaggccaagctccataacctcttagatttgttttcttcatgagtaaaacaagcactgagatgaatgctccctagccctaacctctgcctttgatacaccaaaccaacaattactgggggtgaaagacattggccccaccctcaaggagctcacagtctgtggggcaagacaggtgaccggattatcgcagactatgctagtggtgctgacagctgaaagagcaggtctctgagaggccagaaaaggaggagatgattgagctgaacctgaaggatgaccaggcacaaaagtggagaaggcccctcagtgtgtgcagaggggctgggcatgaaggcacatggtcactgaaggcagctgtcctgcaggccgtaggccctcccaggtgcttgttactggtagatttatggaggacctaaatgccagactaagacataggccccggccatattttgggctgtgtagtttttttgtttttaagttttcaatgagttcttagtcagaatggcctaatctgtaggagaaagccccattcaaaagagcttaaataaggggattgactgtcttaaagtgcacaaagtcccaggttccagctgctgaaaagctggttcctttagctgagcgtcagtggtaaccagatttcttcatctctgcactccactagctttatggtcatagcagggctgcagcatctcctaaagtgctgggggcaggccaggcacggtggctcacacctgtaatcccagcactttgggaggctgagacaggcggatcacttgaggtcaggagttcaagaccagcctggccaacatggcgaaaccccatctctactaaaaatacaaaaactagctgggcctggtggcaccagcctataatcccagttgaggcaagagaatcacttgaacctgtggaggaggaggttgcagcctgggcaacagagtgagcagagcaagactccatctcaaaaaaaaaagagattagggggtagacttaaggctactcagacctcaggctggacgttctaccgccttagccatagacaagaggccggtagttcccatgactggctgggaggagggcccaccctccctgaagcatgtggtaggggccactgaacagagtgagggttctattagcaaggaacagatgggggcatggctgttaggaggcagcctgcagtgtgcattgtagttgccccatttaaaaattggaaatgacatgtacaaatcttccagcttctcttgataaattggaagctcaggcagcctgggtcctacttttttggctaggctgagtagggaaaaggggggcccccattccaatagggaccactgagctgccatcaccaccagcatttccacccagatctctgagtcctcctctgactgcagtgcttgctcatccttccagcccccatcatcacacctgccccaacaggaggggatggtagccagtggaacacttctaggtggctcctgcttttggctgggggtgttacaaccggaggtgagctgtgctgggaccactggcttgtgcctgcaaccttgtcccaggctgctgtcacctcttgtcgagacattgggccaacagccctgcagccctcaggttttagctgcatcggagtcataaatccctttcatgttcggagtcagctctggaaggagctagcagggtggaagcatgtttccagtggctgtggggcaggtcaggccagcaggtatccctgtgcatgtgcaggaaggggccacgctgcctcccctggaaaccagagtgcctgagggtcattgcctactggctgtttccccctcagcaaatgccccactccccgaccacgtgcttatccaggtcttgtcccctcagaaggacagtaactccaaacctgccagaagcaagaccctggccccagcacccccagagaggaacacggaggggtcctcggagagcagtgaggaagagctgccactgacccaggtgcgccatgccttctctctgcagatgctgcaggatcagagctgggctggcaggccttgcaggagagggcagatcttgcccatagggaaaatctcgccatatttaaacagcacctcacagcttccagagctctttcctctattgtgacattcatctgagccctgtgaggcaggcagcagtacacagttaaacatacaggcttcagagccaggtggtgttggggcgaagcccagctcttccacccaacagccccatggtcctgggcagatgccttttcccctgtgtgaggctcaatgtttcagccataaaatggggacagtactggcacctctctcctgcctctgtgcactggtgccagcacacaaggtacttgccacagtcccctgcctaagaaagggtgcctgttaactgtgagaagggcagggagtgttgccccatttgacagattgggaatcaagccttagagttgaagcagtttccccaaattctcatgattcataagaggctgaggaaaggtccaaacgctggtcccctggctccctgtatctctctgttttctgtttaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccaccaccaacatcggtaactccctgtattctcatttttctgtttaatctccacaacagccctatgagggtggctccctttgttgtttgcattttaaggaactgggagtgaggctcagagaagttgagggacctgtcccagcatcacatggctgatgacaagtggacagacctggtgtttgagcacaggccattcacattctgacccgttgcctggtgctgccccgacactctcctctcctgggcttgggcattgccctctggctctgtgtggagcctttacgaggccacctgcctctctgagggatctaaacaactgggagggaggggaccgctccccctttctctgtgggggtggactaacacaattaaaatgaacatcctgcttaaactgaaccatttaattggtatgttagtcctgaagattctggagtctctatttaaaaagcagaaaagaagtcagcggtttgtacattcccccaggaggatgcggggaagacgggcatagcccggggaagctgcagcctcttcctgattgagagatttttagttcctaatccccagctcactaattatgattattttcattattgtacatttattgagcacctctctattgacaagtttcagtctgattttattagcccatcagtggggaaagggattgaggccagggtggtgggcagagtcccaggctgggaggcagggatagataccttggctccattcctagacccctcactgtgcctccgccctgttgtgcagagtagacctcaggccagagtctgtgctggggtcaggacagcttccagatttaaaaacaagtaggtgatacatatgttaaataacttaatttagctattccacaatgtatatgtgtatcaaaacatcatgttatataccacaaatatatgcagtttcacttgtcggtaatattttttaaggccaacttcttctattagtttgtcaaagacgtaggccctgctctcaaagttttaggttgaatcaaagaaaaaggaaacctgtaagaaactaaattctggtgttacattgaggcctagcataattggttctagaaggagctccagtctggtgcctggagaactaacttctaatcctggctctggcaccagtttgctggttgccctgggtgaggccacttgccttctctgagcctcattcatctcaatctctgggatgagacttcctgggttggtggggtggaccttgaggctccaggccacatccccagagagtagaatttctcagtcccctggagtggggctggcctagatctgttaagcagcctcaggcaattctgagagaggttcttggagtgtttgttgcctttgtggtcatgtcccttgccagggtccgcagcctaggccatcagccccctctccccactctgtgacttgctggaatgaaggcacagttagaatgagctcagctttgacaggatggggtgagcactgtccagaaagcccctaggtttggttctgcaggcatcagacctacaggtaggaggggtatcccggggttccctctgggtccttactgcccagcacctatagggaggtacaaccaaatgttcaggccagtgctggttttgctgcttcactcccatcagttttttttctaactgaccccagaactacattcctgtgtatactgtgctttccagtttccacagtgcattggaacccctccagtgaatgagcccaggctgggataactactagccgtttcattaaacgggaaactgaggatcagaaagttgaggggcttgaccacacagtgaagtcatgagagaggcgtaatgagaagcaggtcttctcctataccctgggcaagcttcactgcccacctttatgaactctacaggctaatgccccgccccaaccccccacagccaagccccctgcaccacctccctcctatggcccagaggcccagtggggtggcgtgggcaggtggaactaacaggaggcttttgctgctgagctgcttttaacatcccaagacgctattgtttgcctcagtgggttcgttgcttctcttcgtccccgacaatctgttcctgtcttcacatatatatagatcccccctccctcaactgtaagccttctcccactttccatccttctcttttttatatcgtgggaaggaaggctctggaagtggcagatcggagcagccgcgggggaggctatttggcaggggtaggaaaggcctaagcccagagaagcttccaccctcaggcaggcacctttctgttttactttttactttatgcctctccacagcaccttagcaccctgaggagccaggtgtgctaagtcaggctcagggggtaaacaggatggtgaaacagagaccagtctggacctgattccactcctctcttagcctcaggcagctccctcttcctgccctccagctcttcactggccagagagggagcagagctcaaaccagatctgacatttggggaatggaaagtagacctgaccagctccctggctcacaaccatgtgtgttctcgttagctggaggttcaggaaggaaatgggcctggagatgccctcgtgtgcggtgaacatgttcagggatggtgcagttcaaaaccagactggcctgcagaataccagggagctgctgttgcttgtttgctttttcttttattgtttccttggaaaatttaaagcatacccaaagatagataatgtaaagaacccccacgtaccatccccagcctcaacagttaggaactcctgagcaggctcgtttcacgcaaaccctccactcagttccccaacgcccctggattactttgcagccagtctcagacatgtcagctcatccaccaggatttcagtatgcagctctcagttataaggacctttttaagcacaactacgatacagtgtcacacctaataagttgatctacccagtcagtgtccctatttccctgattgtctcatagagttcagttaaaggccacgtacggcattgagttattaatcctctaagtcttaatctgttggttctcacccactcacccaacccttgtttctcttgtgcatttttttgttgaagaaactgaattggtatagctggggagtttcatcctgggccatgtatcaggagggctgcatcagaacctctggggttggggcaactagactgtaaatacctccccaggtgaattgcatattccaaccaggcagccttggaaaactgcttagaccactccctgcattcagcaagtaactgtctctgaagccagccggggaaagaaggcagaattggacattctggccgtggctttgcttccagtagggacagcagccttgggtcgctccctttccctctgggcttgtggttttcccactttgtataagggagctgatcctgctgaatgtagggcttcactgtgagggtcaggtgggctctgggagttgtgaagtgctgtgctgggtcttagcagatgtgtggggtgggagggggcaccctgggcagctggaatggcttctgtgcccagctgcccctgagctcagtggaccctttgccttgtaaaacactccctaaccccatcacctcctttccctggccaagcctttaatcactgggggggtgttttgtttttgtttttcaaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggtgagcgcagcccttatgcagtggtgggaggggctgccagcactgccccacattgaggcccagaagggacaggacactggctgagtcacatagcaaggtgttggtcgggaggggcttggggtcaggtctctgggccctgcattagccattctgattagggcctggctcagacctgcagttctgggggaatagttgccagagcttttttgtggcagccccagtcatggagcccagaccagtggctagaagctgcagggaccaggttcctacatagtctaagaaagaattctgtatcagttgactgcctgtggaacaagtggtcagggtggtagtgagcttcccgtccttggtggcatgtaaagtaggttaggcaatccctaagccagagacatcacagggatagatttcatctatcagagagacaggaccaatctgaggtttctttgacttctgagaatctgtgattctaccaatgacaacaggaaaagggttaatgttactattacagttattgtaacagttttacaagcaataatacctgatcctgataggacaatttaaaaatgcagacgggtgcagtggctcacgcctataatcctagctctttgggaggctgaggcaggcagatcacctgagatcaggagttcaagaccagcctgggtaacatggcgaaaccccgtctctactaaaaatacaaaaaattagcctggcgggcgcctgtaatcccaggtacttgagagggtaagccacgagaatcgcttgaacccaggaggcagaagttgcagtgatctgagatgtgccacagcactccagcctgggcgacagtgagactgtctcaaaaaaacagaaagcaggcaaaatagagattactgctgggcatggtggttcgcacctgtaatcccagcactttagaaggccaaggtaggaagatcgcttgagcccaggagttcaagaccagcctgggcaacatagtgagagccctatctctacctatctacctacctacatacatatgtacatatacatatacttatacatatatgtgtgtatgtgtgtgtatatttttttaataaaaatacagattagcacataagaaactatatcacctgtaattctgccccaaataattactgttaacatttgacaaatgctaactttataaaaacctaaaatatacgtgtgtttttaaagcaagaccatactgtatctaatgttcagtaaccttcactggatattttatgacatcgggtttttttcatctttacatatttgcagcacaattcctaatggctacagagaaatcccttgggtggacatgctacagtgtgtgtagccagcaccatgttggaggaagcagagggttttgtttcagggtggaggggtgagggagttggctgttataaacagtgctttgaagaacatgcatgtaaccaggcctctgcagataaccacggggactcttaggagagacgattttaactgcaaggagagtcgtttggtgccggtgctctggcccattgctcaggagtggcagcccgaccagttgggaggggaggggatgaggaagcctggggtcacccccagagcagccatttgagctccctgagccttgtcaaatgacataatgacatctcctgcctgggaggcttggagagggaagtaaacaagcttctacctctgtaagccctgagcacagctctagatcaccagcacaggccggtaaattgggttattgccgctgctgaggaggcgatggggcttttgtgccctgatgtgcccccatctcgctccatttcaggcatcagaaccaatgtggtgaccatgcccactgcccacccaagaatagcccccaaagccagcatggctggggccagcagcagcaaggagtccagtcggatatcagatggcaagaaacaggagggaccagccactcaggtacctggtgggcaagggagggtaatgcaggccagtggggtggggccctacttccatacttacccacatgtgctgatgggatggcctgcaattgctgtcacgcccacactccagaggtcgtggcctcacagccagaggctttctggcctcctagctacaaccccccaaatcacctttgagttatgaggaagagtaatctggggacacagcctcctggccaagcaagccctgcagcactcgagtccctcatgagattttccagcgtagtggggcttttgattttttttcttccagttttgaaatgccatgaacaaaagttgcccttttttggtgtttgtaatagtgacttcagcattcttccaagcctttaccatcttcagtgcatttttatttggtccttgcctgaatctaaaagctgggcattttagggttaatggctggtgcattgtttagatcataaaacttagcacacatccccaccccaagggctgcgatgtgaccagcattcagcaaggccggaacccgggtcttctgagacccagttcattgctctttgggccatatcagtctggtttcccatcccactgagaggatgaagtccatgacacactctgacctctcttcctgaggggtgggctaagggggtgttggggggcggtggggctggtgtgccacccactccctgggctcatcacaagctccaggtcaaaaacttctgggaacatgggtgtcggatgggaagtcaggctgtggtcactgcatccatgagcatcggttcctgccaggccctagggatactgcaggaaccaagacagggacaaggaattcccaggccagtcagggagtggtgaggggcagcgattaaacaaggaaacccacatataaataaaaagtattcaccagctggtaggagaggaaacaataaaaactagagaatagtggggtgacctgctatatgaaggcctcctgagacagcgatgcttaagcagaaaaagcagccagtcacaggatgagctgggccaccctccaggcagggaaactgcaggtaccaggtcttcgggggaagcgcttgggaatgagggaaactgagaggtggggacagctggatgaggagctgggggagaggagatgagccaggccgtggcaagagccacgccacatttgaaggctctcagcaaggggtcatgcccaatttccatgcccaccactctccctgactgctagtggttataagaagtagagatgggggtccaccaggttggagattatccccagtgaaggtgcagattgagtagtggggcctaagctgcttccctgccctgggctgggaactgtcccttgctccttgagaacaatgtgattcgctcataacctgaagcctgccaccagttttgcccctttgactgcccctcagtccctgctccagccctcaccccagccagacagcatctgaccagggtgtggcacagctggcatcccaaggacttgtgagtctgagggctacctcttgccacccacaggtgtcaaagaagaacccagcttccctcccactgacccaggctgccctgaaggtcctcgcccagaaagccagtgaggctcagcctcctgttgccaggacccagccttcaagtggggtgagcttggggagccaggggaagcaagcccacggagcgtagaaggtgcaggcgtggccctgcattgcggcaccagcactcatctgccccatgacctctgcacttggtttgcctccctcggcctcagtggcctaatctgtaagaaggaattacagtacctttcgtagttggaaggatcaaatgaggctgcatgtgtgccccatctaacacagttcctggccctactgaagtgttcaggaaggaccaggtcttacttgccctaatttttccttccattccttctcctttcaccgaattaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtgagggtgccaggggaaaggcaagggtgggccaggaagagggtgttgtgtggcctggtggagccatagctctggcctcagctccatatctcagactcattctgcacctgtggctgagcctgggcctcagtttccccacctgtacaacttcatgaggaagtcaatccaaatgatttcagagacctgactttgctgtttgaccactctcagctttttggtatcagactcccttcactggctcccaaaaactccagggccatgtttctggaacagtggaaagcagggaaatagaaatggggcctcaggaattagaaataaggctttggcattcaaatgtcgcacctagcatgctgtgactagcgataagtgtgcaaggagtgttgaagcagtaggaagacttgtggtgaggcggggcaggggatgggggtgagggacctgcagagagaccagggccttcctgaagggctctgcccttcccggctggcaggggccacctggggctaccaacaggatactgtgcttctccagtaggtcccaccccctccaggacagagaccctggtggaggagaccgcagcagagtccagcgaggatgatgtggtggcgccatcccaggtaactgcaagggagaggactggcagcccataggccttagggtggagccccaggccaggctcctgtctacccgatccctcaggtcaggggtctgggtcccctctcttcacagaggccttgggcaaggtcctgtctgcaaggcaccacgtgtggcccagccagcagaccacagccaggctgcctccgtcccctcatagagccctgagtagctgacccttggggtctgtagaagggattgaccttgattctgggtgatgtccggacaaaaacattctttagcagatttattttaaggttactatctgtatgtggcaaaagctagtaattttccatttgtattaataagaaatttcctttttaaatgtgcctgtctagaaagtgtattaattaaaatagttcaggaggcacacgccaagggctgaagtgctgctctgtgccttgttgtccacccactctgcactgatagggcagggtgatcctagaggccccaggctgctttcctcacagcaggccatgactcgggctgggttatggcagtggggtggggtggtggcagcctctttcacaatgggcttcttcagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtaagttaaggtctgcaggagggacatagcaggacacagagggacagggcagtgggccccttcttgccctcctgtagcaacagtcctcccaacatggtcctgtctgcccccagagcctctccaagtgagaccttgtggccttgcattggacctgaagatgctcatcaaagtgcaggtggggccaggtgcagtggctcatgcccataatcccagcactttgggaggccgaggtgggcagattgctcaagcccaggagttcaaggccagcctgggcaacacagagagaccccatctctaaaatttattttaattagccggtgtgatggtgcacgcttgtagtcccaattacttgagaggccaaggcagaagaatgacttgaagccaggaggttgaggctatagtgagccatgatcatgccactacactccagccagggtggtacagtgagaccctgtctcaaaaaaaaagtacaggtgggccccacgcccaggtgtctggctcccatggccctggacagcctggaagtgggggtgtatccagccctgggtggtgctgatgcacctggtaggatagcccttgcctcagaggaagctgcgtcttttggcttgtggagcaagtgttggctctctccaaccatcaccatcaacttttcttccctgtaaataggctcacggtgtgggccttgggcctcagaggatagcttagacaataggctgacagtcacgtttggaggacactcagcacatgcaggagaccccaggcagtagactggccccaggctgttctgactcattgtaaagccttggaaatcccctggccactctggacctctgtgtcttaaccatacaaaacagcagttgatgtatccagtctgtgtcaaggcatggcacatgtagaaaatagtcacattgtatttggagggcagactggattattcaattcacctaacctggggcatccacactccctgaccctactggagctaagggtcaaatatgtaccagctgggcacacttgggacagctccagggcttccccagccttggtgttctgggtgtttgcagataagcagcagaaaagtgggcctggcgcagtggctcgtgcctataatcccagcactttgggaggccagggcgagtggctcacttgaggtcaggagttcaagaccagcctggccaacatggtgaaaccttgtctctactaaaaatacaaaaaactagccagcatgatggcaggcgcctgtactcccagcaactcaggaggctgaggcaggagaatcgcttgaacctgggaggtagaggttgcagtgagccgagattgcaccaccgcactccagcctgggcaacagagcaaaactctgtctcaaaaaaaaaaaaaaaaaaaaaaaaggcagcagcagaaacgtaggctctggggagagaggtttccggggctaactgccctccccagcttccctctccattggctcctgccatcttgaagaatccccagaggatggaattgggcctccagccgtcccgggggcccctctgcctaacctggcctgccctgcccagtccacctcccccagcccaccgcagctctagagccaaaagtcgccagaaatcctggttggggctgaggggccaagctcactgcatgctgcagggggcagccctagcctcagtgtgacatgagtaccacatagagtgtgacatggagtatccacctgggccttcctccaggcaaacacctccaggaccaaaccaccaagccacctttcagagcccagcatgcaggagtgttgtgcccatgagacccagaatggggcagagacctccaagtcacttggaagttagagccggtgaggagacccagtcatggggctttcagctgcagcttgccccaggctgggtcggaagaggaattgctgctcactttcttccccaacattctctgtgagaggcggtgcgacaaggagacattttagagggggctgtggaaggtttttttttttttacacgtgtagtcagcacacaattatcaaaggcaagcagaggcgtggaaaattctaaacaaaggctgcaccagaagtctctctggcaggcagtaaacctgcttagtcagccaccacgtgtatatacactgcacccagagctccccaccttgcctggaccccctgaccaggaagggccgagtgtgggtaatcatcagttgaatgtctgcatggcccccacttttattataaatctacaatgtatcataggaagccttactgttcatccacccctcacgttatagacagggaaaccaaggccctgggaggagatgggtcctggccagaatcacactgaaagtgggtgggaaagtcagacctagaacccaggtctccttcctcccagctccagactccatctccctcctttctgaattttcattccattgatagatttcaggccctttcattaacattctggagtcattttctgtcccccaccctaactggagtttttagtataaagagacagggaaaagctgtaagttagaaatgaagtcagggtgtgaaattggtggaaaggtgtgagcttaggagaccagctggggcagagtgaccgccaagccttgctctccccatctgtgccattgtaagaaaagatggagtcactccctgcaccctcttcgctcttaggtaccataagatctgtcccccaactctcccagatctgtgaccccacattctctctccataggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagtgagtgaccgcttctcccagcccaccccaagggctgctgggcaccccacgggggcgggagggaccctcagccagcacctggtctcattcctcccatgtagaaaagagaggctgagaccagcctggccaacatggcaaaaccccgtctctactaaaaatacaaaaaattagctggatgtggtggcgggcacctgtaatctcagctacatgggaggctgaggcaggagaattgtttgaacccgggaggcagagcttgcagtgagccgagatcacgcattgcactccagcctgggtgacagagcaagactgtcaaaaaaaaaaaaaaaaaaaaaaaaggctgagaagtggtttgtccagagtcacaggggcagcttgtggcaaagcccgaactcgattccagagcacttgagtcagcactgccaggaatgctccagaaggacgaggagtcatgtcctctttccccaagcccagtgcagcagatcttggaggaacctgcttctccagccagctcctgggtgcagaatggaccaggaaccagactgtcagaatcctcatcccaaaccccatcttgtctctagacctcagttttccctccatagtaacactggccctttactgagtgctgttctagactccgcatgcagcaggacctcatttaggtagaaatgagactcagcaggtagaaaactgcggctcgggctcggagaagtagagatgctgttcagggccacagagttttgctaggtggagccagagtcaaacctaggcagcactctcgagcatcgccctggacggtgggttgccagtgacgcccgaagagccagctcgttctggaacaaaagtcgggcaccctcagagcaggacttgcagccccttggtgctcagaactgtgctagatttccatttacagtagggatagatagtgtccatttaaaataaatttgcgggagttttaaaaagtgagttgagctaaagaaaaatggtagtcatccaggtggtccatggatgggacagaaatcatgagctggcctccagggggcaggtgaactggccctgctgggtgatcaccacagctgccagcctgttttatttttattttttgagacagggtcttgctctgtcacccaggctggagttcagtgtcaggaacgcagctcactgcaggctcagcctcccaagctcaagcgatcctcttgcttcagccccccaaatagctgggaccacaggcgtgcaccaccatccccagctaatttttgtattttttgtagagacaggtctcactatgttgcccaagctggtcttgaactcctgggcttaagcaatccacccgcctcagcctcccaaagtgctgggattgcaggaatgaacctccacgccccgccctgctggcctgttgtgatggcttctggtggtgtggggaaagctgggagccctgccctgtgcacctcccaacattgaccccagcacttaggattaccatctgttgttcaggaactttactttacttcccttaggaaaaaaagacaaagaaaaaaaagaaaagaagaagaaagcaaaaaaggcctcaaccaaagattctgagtcaccgtcccagaagaaaaagaagaaaaaggtagagagttcctggggtgtctcaggccagaaaacagacccaaacccaagccccctcctacacacccagacctggttcctgcccccttcccattttcggggcccagtcgggggcgtcaggggttgtgacacaccagggaagaggctggcagggcatgttccctgagcacatggaagccgtagaagtggcctgccggaggtagaagggtgttggggaaggaaggagagactccccccagcacagggaaaccaggtagactgtggcaggtttccaggtgaaaggaaacgttgcctgggctgcgtgtgccccagctggcaggctagccctgaacaacagctgtcctcacggcccggggccttagcacctcagacacagatgaagttctcaccttggccagcagggcctcagctgtatttaggagagctgaacatctgtttgcctctgcccttggaggtcgctgcagacccagtatctattctaggggaattcactagtcctcaggaggtgggggcagcagtgggtggggaaaagctgcaggtctgagagcctctcgtacttccctcctcacagaagaagacagcagagcagactgtatgacgagcaccagcaccaggcacaggtacgcttcccaatcattcctgagcattcagggtgggaggacagctctggtgtcccctgtggtcccagagagccaggcagacctgataggtgggctctaaggggaaaggaggctggggaaagaggttctgttgccaagggtccatggggccactggggtgacatcaggagctggcactgcagcatcagaaggatccagaacagtaatggcagtggtgacaccgagtgcacctgggtgcaggggttgtgcatgctttagggggtgtgccctgggatggagcctgtttgtaggtgaggtcggatacagcttggttcctccttcacttgtgagcggttcattttcctcatgatcctgtaacttgggggcatttccttttgggaaggaagatggtttactcaagatgagctatcaccatggatctatgcttccctatggaggacaggccctgccaagtggtggtgacagttagctgctccacctggctctgctggccctgtggtcacccagcctcctgtaaatgggggtgatgcagagcccgcctcctgggccagtggtgaggcttatgtgaagctaaactaaacactaaaggactcagcccagttctcagaacattccaagtgctaaaaaatgtccactgtggttaatgcctcccccctgcattggagatgccagatttcattttccttgcaggggaaaagggtcaggaaatttgacatctgcatgtgtttccttcccctagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccctcaaatcgagctcaccatggttctgtggtggtgagggcaagaagtggatgaacatgaaagacaggatgatgtcttgggtgtggactgagggaggggagggatagcaaaggaggtggtctgctgctccagcctggaaatgcagaagcccacttccctgggcccagagccatgtggaacaccaggggtcctggagatggtctccagagcttttagcctcatgctggaaacagccagaggcagtgcagaaaaggaatgcatggctggaggtgtcggagacccaggttggcatccagctgcacccttgactcggggcccggggccagaccctccaccatctggcctctctcctctcaagcatgttgctctagaacagaactacagagtagtgtcctcattgggccttgttgacccacagcaagactttaaacttaaaaatggggtgatttcactgcagttcttgatttctggctcctcttaaaaagataacatctggcaacgggggctgtgcttcctcctggcagcaaccagatagagctgagtagcagtcagccccttaggtaaggcatgggcacccagttctccacagtcccctacttcctgtccatcctgacacggaggccctatgtcggttgccatctgtcatcacattcacactgttcttagtatagaaatgaaattggggacataggaaaatgaaagctgtaccaagaagagcttgtgcttaaactaggcaagagcctatttctttttggaagtagagtgttcgtgtgtgttaaacatgtaatcaagtatgtctgtgtccaaagactacaagcccccccccaggcctgcctggccccgcaggcatctctgtgggttacttgggctgcgttctcccacctcagtgactggatttagcgtctttagttacctctttaggataaatgaactggatctcaacagaagagccaggagccagagtgttctaattactaccttttattctaatgtgaaccatggccctgaaagctgataacaagcttggctgagcagagggaactaggggtcggcagaaaggattatgggtggaaaacattggctcttccttggggagtgatgctggggaaagggaagagagtggctcagcctgcaggtaaataggctagaaaagccaaggccaaaggctggaggggagaggacagtcagcatgtccagcctggggtctgggtgtagggttatcccttctccctgtgccttcccatctcgtccatgagcctaggtcttggagccttgtgttggaggctgctgtgatgtcaggaacggggatctgtctagcttttggccacttcctgggacctcacgcccctgttgacagatggagattgggcagcagggccttgctgcattgttatctgctgttccgacttggtttgtcttgtccaagggtgacgaaagagccaggcaccagggtctcatgggatgaggtacagggtgggagatgggggaggggctgggggctgaagggagcaagaaagctgtagctgtgtggggctggcaggatgttgaagaccgcctctgctgctctcacatggggactggagagagaagcagcaggttgaggttggggtcacccatttgttgtccctgcccctttctaacatcctggacctgcagagcagttaaggactgtccaccctcccctgccccctgctcaggtccaataatgaccatcatggatttgtgtaactccccacagccccccaaccctgttccttcgtctgtgaaatggacatcccaggaatgttggagagtggcccagcgtcacactccttcacctgcccacaaaggagctggccctgctggggatgagctgctggtgaccagatgcccctctgcaaggcccttacctgggcccagatcctgcttggtcacacccagcccagaagacgggtcctccagttccagtgactctgcaaaggagcagcaagtccgtttgtcacttgaagtgcagcctacctgacccaagatgcctgagggcagtgcttcccacctagccacaggcttagtgcctgggaaagcaggtacccagggaaggacagctgcaagcagcaacaaagaggtgtaatgggggctcgagtgagaagggggtgatgaaatgagatgggtgggtctgtaggactcctggatgctagaggatggcgcgtggatggatgaaattcacagatgaaaggactgacggataagtgaacaaatatgagtgcatgtaagaggagagatgataaatggacaaataggaatgcacaggtgggtggatggataaagggctggacgcatgactacgtcactgcccccaggagctgccatcctgggtgtcctggtcccatgtgcttcagaggggacctcttgcccctcaaccttcctagtccttcctggtcctctgacactggcacagtgccactgcttaccactgcagttatggtgcccgcggcttctggtgttggggacctccgtgccgttggggaagacacaccagcagtagccgatgctcccatagcactggagtggcagatagttgccgttctcgtcgcacttgggcctgaatgaacccgggtggacagcagggatgtggctgacctcttcctggcacttggtcagtactgaagcgacaggcatgatgaggacacagtgagtgagtgagctctgaaccagggtctgagcagagctaaagacccacacaccactgctgtgggcttaatgccttcttcccaagtggctttactcactccagccatcacacggatgggaaaactgaggcctagaccaacaaggtctgagatcaaaaaggaagtgaatggccatgtgtccaattcacctcagaagttgatggtttcttctgacactcaaagcccattacagttttgggccaggcacagtggctcatgcctgtaatcttagcactttgggaggccgaggtgggcggatcacttgaggtcaggagttcaagaccagcctggccaacatggtgaaaccctgtctctactaaaaatacaaaaattagctgggcgtggtggcacatgcctataatcccagctactcgggaggccgaggcaggagaattgcttgaacccgggaggctgaggttgcagtgagctgagatcgcaccactgcactccagcctgggcgacagagccagactctatctcaaaaacaaacaatcaaacaaaaaaacaccattacagtttggaattgcacttgcgattctgattctagagaaaagcaatgggcaccttggtaagtctaagcttcctgttactgggagttctcaagtagaaatggggtttaccgtttgttggagatgtcttagaggggtttaagcatcagctaggagttggagatagcatgtaaggtgccttctatgaatctgatgcagaaactgaggccccaggcagggtggccctttgaccttctacttcaggaccctgaatcctagagggaaggggacttgtccaaagttacatagcaaattagagacagcaccgggatagaaacagcactctgtctttgggtctaaaaacatcctagtctgcattgtccatgaggtgggaaacgcccaaggctctcttggcagcagctgtgaccttggcgccctcactggattgcgggcagcactggggcaaggtcattacaaggattcctttctgcagtgtttcgggcaggttctaccccaggcaccctgtgctgtaccatcctctatgagagaggtcacctgtaccctgtggtgacaggcctctgtgggcccttaggaacccttagacaagatgggggtgggtcaggggagggggacagccaaaccaagaaggaacagacaggagagagagagaagtgagaaagaagtgagagctgagaggatgggagattccgcggtgctgggaccagggagtgctggaggccccggcctcagcagcttcaggagagccccgagggtccagaagccctggcacgctaaagctcccactccctgtacctttcggtggagcgtcagtgggcttttgctccaaggagtgcctgctcatttcaaacaggagccaatggtgcatccagctctcaaagacctaatacggatagaggtggaggtcaggttcgatggccaccaccaagcccctacactgcctggctttgcccctggggacagaaacatgcagggccaaatagggccccaacacccgggtccagctgcagcctggttccctcttaaagacccctggggctgaaccccacatactctgcagcatccaggttttggaagtgctggtaaaccccttcagcttcctgagaatggcttccccagcccaccctcaccccacctctcctagccctgccctagacaccagaggaaagagagagttcccatgcagggaaacctgctgaccttccagtctatggtctccatggtgttcttaaggtgtctcaggttctccgggaagctccccttcagtggcgggtacaccttcagggggtcagcattctacagggtagcagggcaggaaggatggttcaagaagagctccctggcaggcagtgtgaaatgtgtagcccacgttcccttggtcttccattctgaggaatggaccagagctacaccaagcctaaaccctggacttcagccatgatgggaggggaggggagggtacgggtaagggtagtccagctgttcagctacgagactgcagcgttgcgagtcgagttccagattccaggccagctctaccaacaagccccagtgtcctccctgtggatggctgctcagctttcaggtcttacctgctccagcaggtgaggacccaaccttgactgcccccagctaggttgagtcctctgcctctttcttcacaaagccccctgcacttctgtcatcacctggtcacttgtctgtctcccacactagcctgggatccccatggcttcaggagctgggtccaattgctccccattgtgggcccagagccttgcacagtgctggcataggacagacacgcagtacaaatttggggagaaaaaaagggtgtcttgagcaagtcacttccaaactttgagcctcagtttctttttttatttttattttattttattttttgaaatggagtctcactctgtcacccaggctggagtgcagtggcgtgatgatctcggctcactgcaacctccacttcccgggttaaagcgattctcctgcctcaacctcatgagtagctgggattacaggtgactgccaccacatccggctaatttttgtatttttagtagagactttcactatgttggccaggctggtctcgaactcctggcctcaggtgatctgcctgcctaggcctcccaaagtgctgagattacaggcatgagccactgcacccagccgagcctgtttatctcaaaaatgcagaggccagactacatataacatttaagggtcacccttgtattcagtaatccagagagcacatgttgaaagtctgccatgagccaggtatacaggccttggagcttggcccggccagggtcctgggtgggcaggcaggaccacccagctagctccctgcactcacctggagcaggtgcatcacatggtcctctgtcatgttgccatacttggtggcattctgcatgggctgtgggaggaagtaacagaaggttaccagagctggtccctggagcagggggtatggagcaggagccggttgctgggatctaggtaagagactggaatcgcaggcacttggtcaatggttccatctctgccacctccaaacatgagagctcgagcaagtcactttagcttcctgcctcaatgtcctcattggtcaaactggcataagctttcctgcccagggttttgtccacagcacagtattgtgaatataaatattgtcaatgcatgatagcaaggtctttgagaatgggagaggacagtgagatgctataggaaatgagaagcactttgtaaactgtagagggctgagccttcctcccagggatggcaccaagagactcttcacctgtgccctccacacctggggagcccgattcttcctgaggcaggcactgtccctcccgcagcagtcaggacccctccccaggtgggctctcttccctgcccctccccttggcactgtcctccatccaggcgggataaccttgcccctcccaccaccctggggctgtccttaccccctggggcagggctcccatgggcagcgcctgcatcagcagcggggtggccatgcgcatcttgctcacaggcttgggagctgtggggacaggaacgagggtaagtgtggccccggtgcccagggaggagggtatcagacccagatgaggaagggctggaattccaaaccggagggagaggacagtgggcccagctgggtgcagggatgcgggtctctgagttgagggatggtgggaggtggggggtatcaggatgtaggggtgcacgcacgcttgggaagcttcatgcgcaggttctccagctgcaggttctgggaggtgactgtcagtttgtccagccggccctgctgctggtacaggaagtaggcggtggtggcctggccagcgaggagcagagtcaccaggatggaaaagcctgtgtacagggctccgcggctgcacttgctgtgggaggtggggaggataggtcagaggaggatccacagtggtggctgccccaagggctggctaggaatggggaaatgtatacccccatctccattagacccctaagccacccctaataaacaatgcatttgaagcacaaacagtaagctggctatggaaacacagcttgaagacctcaccccacccctccttccaaccatcgatgtgcctgaagtcttccctggcagagaccctgcagctgccacgggcctgagttgaacagagaagagcaaagaggcatgctctttgtcctctctggaccttagggtcctgcctgtgcgatgaggggttgaggtgggggggtcttcccaggctccctttgccgtgcggatctcctgatgatcagggctgccctcaaggggaacaggtttggtttttgttttgttttgttttgttttgttttttgagacggagtcttgctctgtcgcccaggctggagtgcagtggcgcgatctcggctcactgcaacctccacctcctgggtttatgccattctccttcctcagcctctccgagtagctgggactacaggcacccgccaccacgcctggctaattattttgtatttttgatagagacggggtttcaccgtggtctcgatctcctgatctcgtgatccacccacctcagcctcccaaagtgctgggattacaagcgtgagtcaccgcgcccagccttttgttttgttttttttttctgctggcaggatcaaccaggtatgttattttttttaattgacaaaaccaaaaaaaattgtatgtgcttaccaagtaaggggaagagggttttcacccctctgcccaacctcccaccctcacagtgaaatcagatttaaggagaaaaggtaaggaagtgggaccgggacagcagaaaatgtagcccacctgggaagaagtggggcctggccattttaggagtgggctgggggaggcttggacaatgtcaggctgaagcagggccaggcaccacccactctggggccatcctctgcccaggctctccatgtctttgagcatgtccctgccaatctctgtgcctctgttccctcatttgtcacataggtgcccccacctctgcgattctagaatttggtgggtttcttcttttaagcaagatctcactgcaagcgccaaagtatttcaaatggtaatatccatcctgcagggggtgggcaggagtataggtgcctgagcctgtgtggcctggatgaatttctcatgctccctggactcaccatccagaccctcggacctcagcaagcccttgtatctgtgggacttggatgcgactggggggtgcatgcatatgttacagtacaggggatgtaaggatcctgcccctacaccccaggagtttctgatctgttctttgacgaccccaggggtgggactactaagaccctagtccaggtgttgccaatgtgaaggtgttgggaggtgatcgggccacaaggccttctccctcacgaatgggattaggtgccctgtaagacggcttgatggaaggagttggttctctcttgcccttctgccttccaccatatgaggacacatcaaggaagcccctcaccaggctgggtgtggtgactcacgcctgtaatcccagcactttgggaggccaaggcaggtggatcacttgaggccaggagttcgagaccagtctggccaacatggcgaaaccccgtctctacaaaaaaatacaaaaaacttagccaggcatggtggcgtgcacctctagtcccagctacttgggaggctgaggtgggagaatcacttgaacccgggaggcggaggttgcagtgagccgagatcacgtcactgcactccagcctgggtgacagaaggagactgtctcagaaaaaaaaaagaaagcaagctaggccgggcgcggtggctcacacctgtaatcccagcactttaggaagccaagacaggtagatcacctgaggtcaggagttcgagaccagcctggccaacgtggtgaaaccctgtctctactaaaaatgcaaaaattagccggacgtggtggcgagcacctgtaatcccagctactcgggaggctgaggcaggagaatcccttgaacctggaaggtggaggttgcagtgagctgagatcatgccattgcactccagcctgggcaacagagtgaggctccatctcaaaaaaaaaagaaaaaattagccgggcgtagtggtgggcacctgtagtcccagctactcaggaggctgaggcaggagaatcacttgaacctgggaggcagaggttgctgtgagccaagatcacaccactgcattccatcctgggggatagagtgagactctgtctcaaaaaacataacaaaaaaaaaaaaaaaaaacaagaaagcccctccagaactgtgagaaataaatttctgggtgttttttgtttgtttgtttgtttgtttgtatattacgcagtctgtggtattctgttaaagcggcacaaaacggactaaaacagacccattgggaactgcaaggatgaggctgcaccctgcctactccagcaaccagcaaggatggtttaggacgctccaggagtcccttgtgcctggtaactcatgacatcacagactggctcattctcattggcttgctgcgtgccagtctgtgctttctgggataaggcccagcccaagggagagttattcgggaaggaaacagcaaaaacccgacggtgggcggggggcgggggggaagtggggagaccagacaggaagggaaaacaaattctacttcttggccttctcaaggaacacgggtggcctagcctgtgttcaggctctccagcctcatcctccacctgttcagtgcttctgcaaccccacacccaattctagccccagctctacctcccacacacgacatgggacagtaccttcccctctctgcaccacagttcctcaggag

SEQ ID NO: 1059 - DNA, 4840 bp, Homo sapiens
taagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaagcactggcagccatgaatgcagctcaggtgaagcccttggggaaaagcccccaggtgaaacctgcctctaccatgggcatggggcccttggggaaaggcgccggcccagtgccacctgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcgtcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaacccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggcgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccccctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacaatgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagattccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtaaaaaaaaaaaaaaaaaaaaaaaa

SEQ ID NO: 1060 - DNA, 4236 bp, Homo sapiens
atggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaagcactggcagccatgaatgcagctcaggtgaagcccttggggaaaagcccccaggtgaaacctgcctctaccatgggcatggggcccttggggaaaggcgccggcccagtgccacctgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcgtcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaacccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggcgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccccctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacaatgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagattccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatga

SEQ ID NO: 1061 - DNA, 23415 bp, Mus musculus
  misc_feature (3007)..(6208): "n" at positions 3007 thru 6208 can be any base
  misc_feature (9902)..(9921): "n" at positions 9902 thru 9921 can be any base
  misc_feature (14785)..(14804): "n" at positions 14785 thru 14804 can be any base
  misc_feature (18074)..(19126): "n" at positions 18074 thru 19126 can be any base
tagggaacaccaattgagaaaacacctccataagatgcagttataagacattttctttttcttttcttttctttctcctggaaatcactttgtagaccaagctggcctcaaactcagaaatctgcctgcctctgcctcctgagtgctagtattaaaggcgtgcaccaccacactgggcaagacattttcttaattagtgattggtaggggagggtccagcctagtgggtggggctattcctgggctggtggtcctgggttctgtaattaagcaaactgaacacaccatgaagagcaagccaggaatgagaactctccatggtctctgcatcagctccttcctccaggttcctgccctgcttgagttcctgtcctgactttttgataaacaggtatgtggaaatgtaagctgaataaaccctctcttccccaagttctggccatggtggttcatccgggcaattgtaatgctaactccgagtctttctctgggttaaatatagcccaggttggcctcaaacttgctatgtatctggagacaaccttgaacccctgatcctgcatgacagacatgtgcccataaccagcttatgtggtgctgggattggaatgaaggctttgatggttccacgcctgctaggcagtattctaccaactgatttacatccccagccccaaagaattccccaaagaattatcgggacaacttcaagtctttccttctcttatggctgcactggagacttcccaccttgttaaagagccagtgctgttcccctggaatgtgagtgtatgcccccgcgctactggactttcgctgtttctttttgagttttaaggtgcacatgagatacctccaatgccctttaaagtccctagtcttagctgggcgtggtggcgcacgcctttaatcccagcgcttgggaggcagaggcaggcagatttctggaaacgccctacatagaccagaatgctccacccctgccccgcaccctgtgtggacaagaatgttccaccacctgcacacacacacacacacacacacacacacccttttaaattttgacacaggatactatgtatccctgactgtctgggaactcactatgaagttatgatgggcctggacctctcagaggtccgctgcgcctcttccttgagccctgtgattaataaacatgtgcattaccacgcctgtgccaccaaagtccctaccatttttaacatttattttcaaaggtcactttgcagcaatttattgggattaaacaaacggttcctgattccaactgaacatcttatttttgtaattttagggagaggtgtctcctctaaacccctggcccacagggctctagagtggatgccttgaagtaacacatatggtgtaatctctgcttctgagccctgctgggggaaagggcagccctgcttcctgtgtcaccctagagtatagctaactgcatgcctgggaagttgccaggtcatgtgggatgggcagctgtctgcatggtgtcattggtgggtttgaggaaatccccctgcataaaaatatcttctcccgtccagggccttggcacttaccctaaatgtatctcttaccattggttgcaaggtgatgtgggaggccaattgtttaccaagtttggccagagagtcccactagctctcagcgatgcttcttgcatccaaattcaccagccaggatgaagtgtacaggagacagttccttttaattagggacttgattcttcaatgtgagaaatctggggtgatggccactcaggggaaggaccgtgacgaggactcttaagttaccttctgactgatcacaagaccagtccaggagatggaaagagacgactgcttatgttcccaagagaattccaggctgccatgatggcctgggagtctttaatcccagcactcaggagacagaggcaggtaggtctctgtctctataaggtcaaggctagcctatagtgagttccagggttgtagtgagactttatctcaaaacatacaaacaagccgggcagtggtggcgcatacctttaatcccagcatttgggaggcagagacaggcggatttctgagttcaaggccagcctggtctacagagtgagttccaggacagccagggctacacagagaaaccctgtctggaaaaaagaaaaacaaaacaaaaccgaaacaaacaaacaaaaaactatacaaacaaaaataaaacacacataaaaataagtaaaaaacaaaaacaaaaaacaaactcaccacagaaccctaggcgtgctgaacaggtgtaagagtgtcagccaaaaccttacttgaggtgccacagcgaacaggtcggttaattaccaggctaagtcaccatgtcccaggtacctgtgatgtccttggcaattacagaattgtgtctaggagggagggagctattattagcctcaaattacaggtaaggaaactgagtcttcagagaggttcagcttgctcaacctccaaatggctgagtcaggacagaggtaaaggcagcacacatgggaaacctggcacagcctcctgctccagggctggacagacaactatgacttaccccgagtcatctcaaaaggaaaggaccttgtcctgccatagccttgatggggcctggatcagagtcaggtttgggttttgttttgttatttttctctctaaggccttgcgtgtgcttgagcaagtgatcttcctttgaatatagaaccgtctctcatttaaaaaaaaaaaaaagtattttcaactgaacaggcaggggtgctgcacaccttcagtcccagcattcagaagcagaggcaggcagatctcccagttcaagactagcctggtcgacagagcgagttctagcctggtctacagagcgaattctagcctggtcgacagagcgagtttctagcctggtctacagagcgagttctaagacagccagggctaagcagaaaaaccatgtctcacaaagccaaataaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttcttagacaaaagggtctcactgtgtagacctgactgtcctggaactcctatgtagactaggatggccttgaactcacagagatctaagagtctatgcctctctctgctgggattaaaggcattccatcctatgcctagtccaggaccagtgtatcagcctgccctatgctctattagtgcttcatcatggaggcagatctcagccctggcttcctgtgatgctcaggtgccatttctcctgggcacaacagtctgcctgttatcccacgtcctggttctcttgaagatgggcctttactgtctgtgacctgagtgtgctttctaacagacagcaacaccccaggcatctcccaggaatgaatgatggcttgcatctaagtcacctgtggtccttgggcaagttatttcattttctaggtatgctagcaattaagagaattagagaaaaatatgcacatatgggccatatggatatacatgaatatgtatgtgccatatgtgccgtagaaaaggattaattaacacacagctaatattagatagcagttggacacagccatgtatacctgtaatccaatgacagtgacaggggaggctaaggaaggaggcctgcatgcagtagcttcaagctcagcctggtctacatagtgacccccaggccagctaggaatcaggtgaaaccctgtttcaactgctcaccctccgaaaagctagattttatgtgttttatttgtttgcaatggtaagacagggtctcatgttgttcaggctgtggttgaactccctttgtagccctagataatctttttttttaaattgtctttatttgtttgttttcgagacaaggtttctctgtgtagccctggctgtcctggaactcactttgtagaccaggctggcctggaactcagaaatctgcctgcctctgtcccccaagtgctgggcttaaaggcgtgcaccactgctgttcagctagccaaagataatcttaacccccacttctcctgcctccacctctgaggcctggggtgacactcaggttccaccctgcctggcatagatattattcttcattggatcacacctcacaccttcttcactgggcctctgctttaggaaactggttatctttttattcatttatttatagctatttatttctagtgttggggaaagaatccaggactttggaaatgttatggaagagctctctgccactgagatcggcccccaggctggaatctggaaatcaatgcaaatctctctctttctctgtctgtctctgtctctgtctctgtctctgtctctgtctgtctgtctgtctctctctctctctctcttgtttgtagaccaggctattgaactcagattcacctgcctctgcctccggagtgctgggatcgaacgtaagagccttcacatctggcgaagcaccttcttgaagaaggcaaaattttgcttcaaaaatttgtttttggtgccaagaagtgaactaggcaagatctctcaccaagctacacacccagccccggaatttgcttgttttattttacttttttgagatagaatatcaatatatagttcaatgtggcctccgatcagaggtcttcctgccttgtcctcacttccttcctttttcagtcatcggagtccatggggttagaatcgtcctggccacctctgcctcgacgtttgtctttttatgagactgatcaattacgtttgtaccagtgaggcacgtatgttgtggctgtgttgtggaaaagcaaacagccatctgtcttttcattataatttatcaagacggtgactgggacagagggagagccagggagcaaccacatcgtctcgtgtgtgtggcctcagatcacatttgattctttttttagagttggcaacacagttcagcgggtaaaagtcctaccgccatgcccaccagcctcagcttagaccccaggacctgtgtggtggaaggagagagctgaccttctgcaagctgccctttgacctttatgcatacattagagagagaggaaagcatctgagctgctcatgggctctacatacacaacaggcctgcctcagccttcctaacagctgctagtaggtgtgtgccacctctagtgatgcttgctggctttttcctatttactaattggttatttatatttacatacatgtgcctgtgtgtgcacctaccctacatgtggaggccacacacacacacacacacactcttggtgctggaattataagcaccaggcccgcacccagcttttatgtaatgttctcatggtacagaactcaggctctcattcttgcttcgacaccactttgccaactgcatcatctccctcgccacccccatttttatttttttgagaccagttttccagactggtctcgaaatcaagatcctctagggtcaatatcctgagtgctagaattacagatatcagcatcccatattgacttaaataatgtggcggtttaaatagtaaatatgggccgggtggttgggcacgcctttgaactgaacacttgggagtcagaggcaagtggaattctgcgagtgtgagaccagactggtctacagagtgagttccagaatagccagggctacacagagaaaccctgtctcgaaaaaaggaaaaacaaaacaacaacaacaacaacaacaacaacaaactagtggccaggaagaagagagaaagatcaggtggcctctccagtttggaaagagacaggatgaactcaggactagctgtttgccagctcggcttccattcataagaagggtttcaggtgcggctctgacctataaaaggatgaccttctgacctagttagtgtgtgagtgtctttttctggtctttactacttagctcaggctgccctagaacggccccatttctcccgcttcagcgtgtgccacggtgccccagccaagtggttccttagtaaagtggcactgttggacacctaggcaaagaaaggtgataccagtgctgtgtgtgggcagcacagctcgctaagttcccgggatcagccagttttctatgtagacacttggggactctcacttctgagcacctggcacatactgttgaggtctgtagtctcagggagctgaggcaggtggatgattccatgagaatgaagggtttgaatcccatctcaaaaatgtagcaaagctaagactccagtctaagtccatgtttaataacaaaaagaagattggggggctggagagacaactcagcagttaagagcactggcagctcttcggaggacccacgtttgattctcagcacccatgtgggggctcacaaccatatgtaactccagctccagtctcagaggacctggcgccctcctgtggccttcacaggcactacgtacacacgtgctatacatacatacatacatacatacatacatacatacatagcacgcagacacagaaattaaattaaatggagctgggcatagtgaagaaactaaagcagaaagatccctttaagatggaagtgtctatctccgagctagagtgagttttaagccatgctgggctacagttagattctgtggaaacaaataacatcaaccagagcaataacaataataacgagcatagagagaaaacaaagcaagccaggtagggtgtacttcagcggttaggcagaagannnnnnnnnnnnnnnnnnnncctgggcgcgcgggtcgttgggacgccgggagacccccgcgtgggtcgagcgcgctgagtgtcccgtgcctctttcctaggcaaagagaaggagccccctggagtcgcagtaccaggtgggcccgctgttgggcagcggtggcttcggctcggtctactctggcatccgcgtcgccgacaacttgccggtgagtgggcaacgccgcctcggggagggcgcgcggagggatgctttgagcaggagggtctgatggagactcgggggtcttcttccaggtggccattaagcacgtggagaaggaccggatttccgattggggagaactggtgagtgagccggagccagagaccctctcatgggtgggtgggtggcgacgggcgtgccggaaccggcgcgctaaccctcgccctcactctgcagcccaatggcacccgagtgcccatggaagtggtcctgttgaagaaggtgagctcggacttctcgggcgtcattagacttctggactggttcgagaggcccgatagtttcgtgctgatcctggagaggcccgaaccggtgcaagacctcttcgactttatcaccgaacgaggagccctacaggaggacctggcccgaggattcttctggcaggtgctggaggccgtgcggcattgccacaactgcggggttctccaccgcgacatcaaggacgagaacatcttaatcgacctgagccgcggcgaaatcaaactcatcgacttcgggtcgggggcgctgctcaaggacacagtctacacggactttgatggtgagccaggccccggggagggagctgcccaaggtgccggcctggaagcctctggcggcctcggctccggccctttgtaaaggtcattgggccgcctggctcagagctggcaggggtggggcagagtcgagcttcccggcatagtacagccggggatttcgagctggttgaacgaacctgcaacatttctggcgtgattggggttttgttgttgttgttgttgttgtttttgttgttgctgctggtgtttgcttgtttttcttttcagcaggaatttattaaattccatgctttcccggtgaataagaggtcgtgggtagccggctgtagcccagatttctaaagtatgacccacttttccctccagtaggaggtggagccgttggtggcgggagacattggtgctgatttttttctttttcttttttttttttcttttgtagttttgttttgtgggggagttttaaggtagttcttagaactgcagggttttgttttgttttgttttgcttttgagggtaaaggaataagagccgcggtttcaccccacttgggggtgttgtggggtgaggaggcctggaatgaatgttgtgaaataagatctgttgctggtttgaaaattagttgggagtctccgctgggaggatgaaaacctatctaccatagggaggggcttggatcgcgttctttcagcagtggagggcaggaatagtagatcaaagcgcgagggtgggtcacgatccgagtggctcacccggacaaactatggcctttcaaaacttgtgactctggcttgtggtttgaatttctttggaggatgccgggctgggctgcgttttttgtatttaacagttaatggctggctgagtcctcccctgtgttttccccccctgggcaagtctttgctgccccctgttgagcaccacgaggctagcaccttttttttttttttttttttttactccccaaagtttgtaaacaggaatcacgtggtctgaaaccagccctgcaactgtacctttccagtctagggagtgggagagtgcagtgtctatgccttgcttgcatagaacccggaggaaagcacaccctgagttagttgtgtataaaggcccttacctgggcccggtctagatgagactggtgtggcagggccctggggtccttgtagttaaaggctaacccactgagtggggcctctagacttgagcttttcggtggctttatttgtctttgggccgatgtgtaagggatttgggtttagggtttttgggctcccagagagctaccatatcatttcttcattttctgtctggaccagagaggcagagatggagagaaaaaaaaaatatggttgttttaaagtcaaatctgcctgtctgcctcctgagagctgggattaaaggcatgtgccaccaaacccgagccaggcagtgtctttattaaaaaatatttgaaaacctagtggaggtggtggttcttgcttttaatccagcccttgggaggtagaggtaggcagatctccgagttcaaggccagcctggcctacagagtcacttccagagctacacagagaaactttggaggagaaaaaaaaaattaaaagaagcggctcagactagctgctttgttacctttttttttgctaatgctggtttctttctattccctctgctggtagggacccgagtgtacagtcctccagagtggattcgctaccatcgctaccacggcaggtcggcagctgtctggtcccttgggatcctgctctatgacatggtctgcggagatattccgtttgagcacgatgaagagatcatcaagggccaagtgttcttcaggcaaactgtctcttcaggtaacttccctcagacacccccaatccttcccaaaccctggttcagggttggtttggggattacaagagtgagagagtattcctatccacctttttatttttatttattcattttctttgggggagagtaaggccttagcctgcctctgacccccaactgctgggactcaagagatggtgggttttcactgggtcagagtactccatttgggctcaaattggaacaagttttatatacatcccaccccaacccccagaccctgtaaaatctaagtaccagcagagacccagtctctaaacaaagtttaaaaaaaaaaaaaaaaaatgaaggttccggatagtgtcagtggaaggcgtgaggtaggtaggtgaattgaatcacctcatcttgctcactggtggctcatcaaaacccttgtcatccttcctatttctagtgagtgggtgtcatgggaaaggcccgagctattgaagtctgaaaccacaggtttaagaggggaggcacttttttaactgaaagctgattgctggaggctttcggtatccgttctttcccaccgggcagtgtttggtataaaaagtaccgtgcctctttaaaaaccccagacttgtaggtctggggaagaagacctttgcattacaaaaacaagttgagtcatctttaacctctgtctgccccgccttctgcagagtgtcagcaccttattaaatggtgcctgtccctgagaccgtcagatcggccctcctttgaagaaatccggaaccatccgtggatgcagggtgacctcctgccccaggcagcttctgagatccatctgcacagtctgtcaccgggatccagcaagtagcagcctttctgctgctgtctgtcagaccctccagggagggagagcttgtcttctggcctccaacaggaccctgcgtgacgatgcagggacagcaatgacaactcattccagactccaggtccctggaggagcctcccacaagggaaagagactacttcactggtcctgggcccctctttgcgcgccccgcccccagactcagcgtctagtgttgctgggctcccctgaatccatccctggttgggggtgggagtggatcagagccctgtcaatggaactttaatcaccatggagactgggtcaccaagatgggccaggggggaggggaaaacagtctgggggggtgggataaaaactagcaccatatttaagtccctgtcacctcttccaactcctgagtgccttctgtggggactccgcctgtgctgggagaaatacttgaactttacctcttacctgctgcttctcaaactctgcctgggttttgcttccttcctctcctctcctttcccatcccccacttcctatgaaaggtgccatgggagaggctacagggccaactgctgagccacctgccccttttctgtctcctttagtaaaattcccaagcaaactggtcttccttttttgtttcgacttaactgtttcaaaaccaagacctcacacagaacgcacaaccaatgcaaaaaaaaaaaaaaaaaaaaaaaaaaaaaccagacaagctgtaaatgtgtgtatagttccggcatggtagcctgcaaaaggactgtagatgataacaattttaaagaagaaaaaaaaatgcctttaagttattttatgtgttggggggtttggtttggtttttttttttttttttttttcttttttattcttttttgcttgtttttgaaagatggcacgttctaccccggaagttttaatgtatttatttatttatttatttggttgccttcctgtccaagcttccactgactgttgcccccggtttattgtcatgttctgccttttttttttctttccttcctcctgacttggggaccttttaggggagggctgtgacgcttgctggggtgttggggctccggtgggacagctgctgtagcccccttctccaggggcccccttggctgcttgctggagtgggtctagggtctgctgactgtacataagacagttccggtgtggtgtgccttccggatcctctctggggctgtgctttgagcagcgtgcagcccgctggttttatctgagtaaagtatactgtacaggggaataaaagagatcttattttttttttttatacttggcattttttgaataaaaacctttgtcttaaaccttgagttttccattcattcatacaaagnnnnnnnnnnnnnnnnnnnnctgacgtgtcatgtcagagctagcatcgaacacttgagttccatcagacaatgtggttgcaggaattactacaggtagcacttgagagtttgatttggtttttgttttaaagattttatgtatgtgagtacactgtagctgtcatcagaacagggcatcaggtcccatcacagatggctgtgagccaccatggggttgctgggaattgaactcaggacctctggaagaagcagtcagtgctcttaaccattgagccatctctccagcaccctggttcttggtacctcatagcagggtttctcttgagctctagctgtaactagggctgtagatgaggctggcttcaagctcagacctacctgcccggcttggtgagtgaccagaagcctagtgtttttgacacaaggtttgaagtctgtgtagccttggaacttgatatgtatagaccaggctggcctgaaactcctggatctgcctgcctttgcctcctaagtgctgggattaagggcatgtatagttccactggaaaagatttgggagccacgagtcctagcatcttcctagcagagtggtgtaatcctataatcccagcacttgggaactaagaggatgagagtcaggagttcaaggtcagtctcagtctgggatactcgtgactggtctaatcagctggaaagatgcactctggtagacaggaccaaaggaattcctatacattcaaggctgagcctgggctggagttccaggtctatcctatctcgataaaaggggatgaggatgggcaggggaagtggagagatggctcagcagttaagaattcttgcagagggcctgggtacaacttccagcacccacatggtggctcacaaccatctgtaacttcagttccagaggatccaatgcgctcttctggcctccaagggcactaagcgtgcattcatacaaatacacagataacacacctattaagaaaacatttcagccgggcagtggtggcgcatgcctttaatcccagcactcgggaggcagaggcaggcagatttctgagttcaaggccagcctggtctacagagtgagttccaggacagtcagggctacacagagaaaccctgtctcaaaaaaccaaacaagaaagaaagaaagaagaaaggaataaagaaaggaagaaagaaaggaagaaaacgtttgctgttcttgcaggggacccagaattggttcccagcacctgtatgacctcacaattgtctggaagatggggcccccagtttgcctcatgtttggtctgagtatgtcctaatagttgaaccactgctgatccaggtcctaaaagtaattctttctttctttctttctttctttctttctttctttctttctttctttctttctttcttccttccttccttccttcctttctttctttctttctttctttcttttttttttttttaggcaatttctcctgtagcctaggcttaaatagcccaggagagccttgaactcccgatctgtatctaggatctggggcttgctgccaccacacccaggtgtaaacattgctttcttgttgctttctgcccattagtaacagttctaacattcttccctcctgcaggggcatcttgacctcttcctcccctcttgccataatctcttaggaacttggccccattgcattgcgcttgtggaggatccaggccacagtgccctcccttcatcgagagatctcctctaccaccacatcttggactaggtcccaaaccccagcacagcctcggtgtggctcagaaaggaaggaaggatttctcagctcttgggggctgattttctgaagttccccttttccctacccttctgtcccctcctccttcctgtatacacactgcccggcagctgggtgtctaagcacactgtgggacctttccagtcaagttgcaagtgaacaattgaaagttgctagaaactttatttatttatttcatgtatgtgagtacactgtagctgtcttcagacacaccagaagggtgcatcagatttcattgcagatggttgtgagccaccatgtggttgctaggaattgaaatcccctgctagaaatgaaatccggcagagccttgcccttcttgcctttgagatgagttggggggggcctttctgtggctgttgagactgctgggggccatacagtgtgtctgtagaaagtaggttctcaggggctagagagagggctcagtggttaagagcaccgactgcttttccagaggtcctgagttcaattcccagcaaccacatggtggctcacaaccatctgtaatgggatctgatgcccttttctggtgtgtctgaaaatagcaacagtgtactcatatacatgaagtaaataaataaatcttaaaaaaaaaagaaagaaagaaagtagggtcctcgctaagtagaagaggtcagaggttgtaggagatgcttttaggttctgtttgttttgtttgttttttgttctttatgtaaaccaggttggtcttaaagtcacagagatctacttgcctttgccttcctgagtgctagggttaaaggtctgtgccaccacaccctgcattatttattttttattttattttaatttaatttaattttattttttattttgaaatagcatctcctgcattctaagctagacttgaaccctggcatgataggtgtgtgtgagctgaaactaggcattttttgagaaggggaaaggtccttgatctctctctctctctctctctctctcttttttttttttttttttttttccagacagggtttctctgtgtagccctggctgtcctggaactcactttgtagatcaggctggcctcgaactcagaaatctgcctgcctctgcctcccgagtgctgggattaaaagcatgtgccaccaccgcccggcgtggttgtcacttctaaggagtaagaagagggttgtgatctggggagagggaccggcccagctatcttcgcattagttcccatccaagagatggagacagatctgtttatgtccctgttgatttgctttttagctgtatgacatgttgtgacattatggacagacctgtgtttccaggaggcagagatggggatggatgtccttggcggaagagattgggaaatctccccagggaaggcagcttctcactgttttgttttgttttgagtcagggtctccatacatgtagcatgggctgggttctgatgctatggtgccctgggagctcagaaaacaacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggcacgtttctcgtaagtgttgctcagctcctttaactgctccgctggttcttggaaaccctcaccacaaggacctatcgagagcagtgttggagcagatatggcatagccctccccccccaaccccccccagttcatttccgcaatggcctgtgctactaaccccgattgccaacagcgaggttgcagtgacccctccagtggtggtgtgagggagtggaaacgaagcagaactcaggccaagatgaggagaccccgtattattttaatttacagtaataggacttccaatgtgcagaattcttggtgaccttaggtctgggatacagtacaagaccggctgttattgaattgtatcctgttgtttggcgagtctaacaccaatagcaagcaagttggtggtgtggctcagtgggtagaacgcttaccaggcatgcacgaagccctgggtagggtgttttttttttgttttgttttgtttttttacttattatatgtaagtacactgtagctgtcttcagacacaccagaagagggcatccgatttcattacaggtggttgtgagccaccatgtggttgctgggattttgaactcaggacctccggaagagcagtcagtgctcttaacccctgagccatctctccagccccctgggtagggtttgtaatccctgtgctggggaggtagaagcaggaggcccagatgttcaaggtcatgctcagcctgcattataggccaccctggactacaggcaggacagtaacagtcacgtctatgtgacccgatggttttcttagtttgtgtcccgatgcccccagatagaccctgctgtcctgaatgccaggtgtagctttttttttaccttaaaataaatgctttgccaggcagtagtggcccacgcctttaatcccagcacttgggaggcagaggcaggtggatttctgagtttgaggccagcctggtctacagagtgagttccaggacagccagggctgcacagagtaaccctgttttgaaaacaacaacaacaaagaaataaatgcttttacattcatttactttgatgttgttggttttaagatttattttcagtttgtaattatttgtgcacttgtgtgtgtctgtgcgggggtgtgcctacagtcgggcacaagtacttgcagaaatcagaaggggacactggaccctctggaattggagttgcaggcagttgtgagctgtcagatctgaatggtgggaaccaaacttggaccttctgtaagactggtatgtatcttaagccctggactatctctactgaccccatccgtgatcatgatcgtgtcaccatcaccatcatcagcaccaccatcatcatcaccatctctggctagccttgaattttttttttttcttttgagacagggtttctctgtgtagccctgactgtctttgaactcactctgtagaccaagctggactcaaatagtgctggggacagaacccagggttcctgcaatgctaggtaaaccctcttatcaactgagccacattgccgccagcccatgagttttgaataaacaattaattttgtgttttccaaagttttgtcattgtatataaaatacccttttaatctaactccctggaaccatgagggcccacatgaaatcaggggcagtagcagcgtggtgtgtaagggacccttccttgacttggagacatattgtcacagttgaattccgctccaactttggtcttcacgtgaccttggcagatatttagtttctgagttttgttttttttcttctcatccacgacagagaaatggtccggagtttgtgaagcctgtgccacccagccaacggtcattggtacaaatgaggcacagcttaaacaggacaccgtcgaaaggagattttagaatgagctagtctgaatctcggtgacctggagctagtggggtccagagatagactgaaaagggcgccaggaacttcaggggagggagtgcggacttgtttttcaagtatggtaatgtttattcggctgtgaaaggctgtcagaaacacaccctactgagctaatgcttaaaatgcatgcagtgtcttatgtgtataaattacccctgggtaaaatgacttaaaaaaaaaaaagttaatttcttttccttttccccatcaatgaaaacacgtccctgagccaaatataccacggaagtctcctttccggttagattattcatgtgagtgcgaacattctccccgtggattgatataaataaatgagaattggcttaatttcccaccttactttctgactgtagtgcaaaattagagagatgtgtcatcagggggtggagggggccgacgctgcgaccacgctacgacggagataaacttaaacgccgcatttttttttttcttcaaagtcataaacttaaagggaaaagttttgttttttgttttttttttcctggcgaagcactaaagcaaagtgatggttgctcgcggtggcggaacatgtctgggaacctcgcaccttgggaggtagaggcaggaaggtcaggcagccaacacttggtgagttccacgccagcctgggctatgtgagacccagttgctaaacagcaaagcgagatggtgcggtgcggcacaggctgacagctctgcagtagccaaaggaatcacgtgatccatctggttctatctcccatcatccctcatttctttcccctttggggtgaaatgtacacatgtatctttgaaggaatttttttctttaatatctactattaacatttttgcttacaactccttggcttttattgtctccacacctagtcaaagagaaactagacattttaatctatttttcaggtagccacgtaactagagatgagaagatgagaacggattttgctgtagatgtctatccatctctgtgtctttgggttttttaagatttactttattatatatacacagtgttctgcctgcatgtatgcctgcaggccagaagagggcggcagatcaccttatagatggttgtgagccaccatgtgggtgctggggattgaactcaggaccactggaagagcagccagagcgcttaacctctgagacatctctccagcgcagtccatccatctctatgcatatgtaggttaggagtagtgcaaggtcagagctcaaggtcctaagcaggtggtgcacacttgtcagcctaactctagggaaaaggaggcacgagaatcaggagttcaaggttaaccttggctatgtaacaagtctgcagccagtttgggctccaagagaccctgtcttggtaaaatgaagctgataagcacacttgctgctcatccagaggacccaagttcaagtcccagcacccacacaaattggagggcaaattggtatttaattatttactatctgtttgtgctattgggatttagaactgagctaggcaagtgctctactcctgagctccacccgttgctgcagtcttacatatccaggtgagcacgtggaggtcaaaggacaactggagaattgctcagaagtaaagagcactggatgctcttccagaggtctcaagttcaattccctcacccatatagtggctcacaaccatttgtaatgtgagccaggtctctcctggctcaggggtgcagggtgcaggaggtctaacttagccctctcgtttactttgtgccacagggtcagttgtccttgtcacttggctcttcaaacagttacatctttttgatcacctgggattccttcaggctgggttctgtgctctttattttaagaatattgttatattttaagggggtgggctgtggatcaggggagtgggagtcatttcttctaatcattttggtcccggggatgtaattcaggtcctcatctctctctctctctctctctctctctctctctgtctgtctctgtctctctctgtgtctgtctctctgtgtctgtctctctgtttctctgtctctctgtttctctgtctctctctctttgagacaaggtatccctgggtgatgtgaaacttgctgtgtaaaccagactggcctcaagctcatagggatcacctgccttagcttcccagtgctggggttcaagatgtacaaggcctggctggagagatggctcagtggttaaaagcactgactgctctcccagaggtcctgagttcaagtcccagcaaccacatggtggctcacaaccatctgtaatgggctctgatgccctcttctggtgtgtctgaagacagctacagtgtactcatat

SEQ ID NO: 1062 - DNA, 9261 bp, Mus musculus
tctagagtcgacctgcagcccaagcttccttaatggaatcttctggtttatttatttctcacctttggccttattttttcctgtgctcacttaatatcctggttgctgttgttgttgttgttttgtctgcttggttttttttttttcttcccttgttgatcatgaaccccaggcatgctagatgactatctgatcattgagctacatcctcagccataaggcttttccttttgacatatggtcttggttacaccactgtctggcttcactatactgctcagtttggcagtcctcctgtttcagccttccaaatattagaatgacaaggatgacccactacatcaggttcatgaattgctgttaagtgttctttacgttgggtcatctcccatcagaaacggttggataaagggtggttgtgcttgcagtgtgggcaagagggaaggcagaagcaaacgatccatgaatttgagaactgtcctggctttggcatgcacagtgagattgtatattaagaagcagaaaaaggaaacaaagcaggtagacagtataaatcaacgaagagatagcatacagaaagtcttcttgttttaaggcaggatcttttgtgtctctgactgactttgaactttgacctgactctacctctttgtcctgggatcaaaagtaccatttatgcagtgcccagggatcaaacctaggattttcttctgtatgccaagcaaggaccctaccaaccgagcagcatccccagcccagaaagattttttttctttgtaagaaccccacatgaccatcagatgggcggcagtgaacgaaggcttagaatttgttcagcaaaaaaatgtggaaatacacgcgccttgttcagaacgcaaggctttgaataagcgacaggactggagtgtatgtaggttggtgacagggtgcatgtgtaagaccctggatttcccaacatcagacacattccgagaagaggacagggcactttggacaggtggacttagttttcagaggcacaaagtctggaatgtgctgggagattgaaaacaagtggaaatagtcctgtttggacagagctgagggcctgatagggaactggaggtagttgtactggtgtttaacacatatttatttatagacagagtttctctttgtagacaaggctggcctggttagaatgttgtggttttaacgttgggcaccactctaggcatacctgttttctgattgcctgctcaataccagtgccatagatgtttttaggctgattaaagggagagctctgaaccctcaggagcagaatttgggccattctctctgctgtcgtatgaccctgtgtcatcccagtgacgagtcattttcctatctgcaaaaaaggaagtaattctccttcccctgggtttttctcctttcgtcatcagaaatgaatgagttagtccacagaacacaaacaaagggaaatatgtaatgttttgtaagaggcatccataaaagttatggagtctctgggcatctttataagcagcatggaaaacttgtaaaggaagcatttaaacgcgtgcgctaatgactacatccacaacaggctcgttcctcctttaaagatctctcagacctaagaacaacaacaaaaataacgaacaaggggtgtagctggctgtccatgactctggccaccagtatctcagtttatatggattacacagaatgagagtttacccatttccacacgtcgttatcaactctccatgaagttcaaaaggacaaaagatgaaagcggactcggctagctttccgtggtatttccacgtgcatgtggggactttcctttgagacaaggctggggtgggggccaataatatctggtatcgcctgactgctaataccaagctgatgagaaggtaactaccgcaacaacctctgattaaacccagcggcaccctcccaccctcgcccgcgatcaggaattttcctgctcctcccgccctctcagaaggggctgaggcagcatttggcaagagaaagctaacgtttgtgtcgtgatttcctctctcaggcgctcggacatggaccgaggggatcaggtaccccgggtcccttctaattctctctgcatttctaaattgagaatctttgtcaccggctcctcgcatcccaggtctcccccacttttcctcgcaggcctgtgactggcctcggtgtgcaaaatgccggtgactcacgtcttgcacagccttcgcccccaaaaacacaatcatcacccccaggatctagcccacatagcatcgtcaacccgccccagcagccttggaggtctccgggctgagtcacaccagaggaccaccctggtcggcatccacacacacgcggtccctactcatggcttccgcgcccgccacaccaacgcccttccatttctcacaacttgctacgctccagctccaatcctcgacccccctccacaacccaaatctccgggaaacacagagccggcggagctggcctcgggcggcctttgatggctttgttattgtttgggtttgaatcgataccccctccccatccttccacccccgcccgcgcgcgccacccagctcccgcctccctgcacgcccaggcccctccccctccgttttggcgccttttccttcccgccagtcggcttagaccattctgaccgcgaggcgagaggcggggcccgcaacgccttatgcaaatagggcgtcttctggttggctgaagcgcgcccgagggcggggccggggagaggggtgtagccgcgagggggcggagcggagggggagggccctggtcccgccgcctccccgccccctctccgccctccgcgccgagccagcccggctccccacctcgctcccggagaggccccgccccgtccccgcccgccgccgccctccccagcggcgcgtccgcccctttactcctggcggcggggcgagccgggcgtctgcagcagcggccgtggcggcggaggaggctggaggggagtcggcagtgccggcggcgggatcggcagtagcagcagcagcagcagtcacagtcagcagcagccctgggtcccgcagcgcctctcgccctgccgcctcccgcactgcctgacccagccggcgaacccgcccgcggccagccccgccagcgccctcagtcgtcctccgactcgccctcggccttgcgcgccagccgcagccagagccgcaacgccacccgcagtctgagtcccggccgtcgctcagccccagctcgctccgccgccgctgctgctcgtcccggcaccggcgccgcaccgacaccctggaggtggggatgctcctgtccaagatcaactccctggcccacctgcgcgcccgcccctgcaacgacctgcacgccaccaagctggcgccgggtgagtgtccccaccccaccctgggcgcgcgggtcgttgggacgccgggagacccccgcgtgggtcgagcgcgctgagtgtcccgtgcctctttcctaggcaaagagaaggagcccctggagtcgcagtaccaggtgggcccgctgttgggcagcggtggcttcggctcggtctactctggcatccgcgtcgccgacaacttgccggtgagtgggcaacgccgcctcggggagggcgcgcggagggatgctttgagcaggagggtctgatggagactcgggggtcttcttccaggtggccattaagcacgtggagaaggaccggatttccgattggggagaactggtgagtgagccggagccagagaccctctcatgggtgggtgggtggcgacgggcgtgccggaaccggcgcgctaaccctcgccctcactctgcagcccaatggcacccgagtgcccatggaagtggtcctgttgaagaaggtgagctcggacttctcgggcgtcattagacttctggactggttcgagaggcccgatagtttcgtgctgatcctggagaggcccgaaccggtgcaagacctcttcgactttatcaccgaacgaggagccctacaggaggacctggcccgaggattcttctggcaggtgctggaggccgtgcggcattgccacaactgcggggttctccaccgcgacatcaaggacgagaacatcttaatcgacctgagccgcggcgaaatcaaactcatcgacttcgggtcgggggcgctgctcaaggacacagtctacacggactttgatggtgagccaggccccggggagggagctgcccaaggtgccggcctggaagcctctggcggcctcggctccggccctttgtaaaggtcattgggccgcctggctcagagctggcaggggtggggcagaggcgagcttcccggcatagtacagccggggatttcgagctggttgaacgaacctgcaacatttctggcgtgattggggttttgttgttgttgttgttgtttttgttgttgctgctggtgtttgcttgtttttcttttcagcaggaatttattaaattccatgctttcccggtgaataagaggtcgtgggtagccggctgtagcccagatttctaaagtatgacccacttttccctccagtaggaggtggagccgttggtggcgggagacattggtgctgatttttttctttttctttttcttttttttttttttttcttttgtagttttgttttgtgggggagttttaaggtagttcttagaactgcagggttttgttttgttttgttttgcttttgagggtaaaggaataagagccgcggtttcaccccacttgggggtgttgtggggtgaggaggcctggaatgaatgttgtgaaataagatctgttgctggtttgaaaattagttgggagtctccgctgggaggatgaaaacctatctaccatagggaggggcttggatcgcgttctttcagcagtggagggcaggaatagtagatcaaagcgcgagggtgggtcacgatccgagtggctcacccggacaaactatggcctttcaaaacttgtgactctggcttgtggtttgaatttctttggaggatgccgggctgggctgcgttttttgtatttaacagttaatggctggctgagtcctcccctgtgttttccccccctgggcaagtctttgctgccccctgttgagcaccacgaggctagcaccttttttttttttttttttttttactccccaaagtttgtaaacaggaatcacgtggtctgaaaccagccctgcaactgtacctttccagtctagggagtgggagagtgcagtgtctatgccttgcttgcatagaacccggaggaaagcacaccctgagttagttgtgtataaaggcccttacctgggcccggtctagatgagactggtgtggcagggcctggggtccttgtagttaaaggctaacccactgagtggcctctagacttgagcttttcggtggctttatttgtctttgggccgatgtgtaagggatttgggtttagggtttttgggctcccagagagctaccatatcatttcttcattttctgtctggaccagagaggcagagatggagagaaaaaaaaatatggttgttttaaagtcaaatctgcctgtctgcctcctgagagctgggattaaaggcatgtgccaccaaacccgagccaggcagtgtctttattaaaaaatatttgaaaacctagtggaggtggtggttcttgcttttaatccagcccttgggaggtagaggtaggcagatctccgagttcaaggccagcctggcctacagagtcacttccagagctacacagagaaactttggaggagaaaaaaaaaattaaaagaagcggctcagactagctgctttgttaactttttttttgctaatgctggtttctttctattccctctgctggtagggacccgagtgtacagtcctccagagtggattcgctaccatcgctaccacggcaggtcggcagctgtctggtcccttgggatcctgctctatgacatggtctgcggagatattccgtttgagcacgatgaagagatcatcaagggccaagtgttcttcaggcaaactgtctcttcaggtaacttccctcagacacccccaatccttcccaaaccctggttcagggttggtttggggattacaagagtgagagagtattcctatccacctttttatttttatttattcattttctttgggggagagtaaggccttagcctgcctctgacccccaactgctgggactcaagagatggtgggttttcactgggtcagagtactccatttgggctcaaattggaacaagttttatatacatcccaccccaacccccagaccctgtaaaatctaagtaccagcagagacccagtctctaaacaaagtttaaaaaaaaaaaaaaaaaatgaaggttccggatagtgtcagtggaaggcgtgaggtaggtaggtgaattgaatcacctcatcttgctcactggtggctcatcaaaacccttgtcatccttcctatttctagtgagtgggtgtcatgggaaaggcccgagctattgaagtctgaaaccacaggtttaagaggggaggcacttttttaactgaaagctgattgctggaggctttcggtatccgttctttcccaccgggcagtgtttggtataaaaagtaccgtgcctctttaaaaaccccagactttgtaggtctggggaagaagacctttgcattacaaaaacaagttgagtcatctttaacctctgtctgccccgccttctgcagagtgtcagcaccttattaaatggtgcctgtccctgagaccgtcagatcggccctcctttgaagaaatccggaaccatccgtggatgcagggtgacctcctgccccaggcagcttctgagatccatctgcacagtctgtcaccgggatccagcaagtagcagcctttctgctgctgtctgtcagaccctccagggagggagagcttgtcttctggcctccaacaggaccctgcgtgacgatgcagggacagcaatgacaactcattccagactccaggtccctggaggagcctcccacaagggaaagagactacttcactggtcctgggcccctctttgcgcgccccgcccccagactcagcgtctagtgttgctgggctcccctgaatccatccctggttgggggtgggagtggatcagagccctgtcgatggaactttagtcaccatggagactgggtcaccaagatgggccgggggggagaggaaaacagtctggggggtgggataaaaactagcaccatatttaagtccctgtcacctcttccaactcctgagtgccttctgtggggactccgcctgtgctgggagaaatacttgaactttacctcttacctgctgcttctcaaactctgcctgggttttgcttccttcctctcctctcctttcccatcccccacttcctatgaaaggtgccatgggagaggctacagggccaactgctgagccacctgccccttttctgtctcctttagtaaaattcccaagcaaactggtcttcctctttggtttcgacttaactgtttcaaaaccaagacctcacacagaacgcacaaccaatgcaaaacaaaaaacaaaaaaaacaaaaaaaaaaccagacaagctgtaaatgtgtgtatagttccggcatggtagcctgcaaaaggactgtagatgataacaattttaaagaagaaaaaaaaatgcctttaagttattttatgtgttgggggtttggtttggttttttgtttttgtttttttttttcttttttattcttttttgcttgtttttgaaagatggcacgttctagcccggaagttttaatgtatttatttatttatttatttggttgccttcctgtccaagcttccactgactgttgcccccggtttattgtcatgttctgccttttttttttctttccttcctcctgacttggggaccttttaggggagggctgtgacgcttgctggggtgttggggctccggtgggacagctgctgtagcccccttctccaggggcccccttggctgcttgctggagtgggtctagggtctgctgactgtacataagacagttccggtgtggtgtgccttccggatcctctctggggctgtgctttgagcagcgtgcagcccgctggttttatctgagtaaagtatactgtacaggggaataaaagagatcttattttttttttttatacttggcattttttgaataaaaaccttttgtcttaaacctttgagttttccattcattcatacaaagatgtatgcttggtacagagccaggtagactgggcactttcagactagatctgatttcctgctggggcacagagaagtaccaggctttctgaacaaaccatgctggataaaacccaggccttccgtgcccactctaccaaggaaactccctgactatgaccaattccctttaacaaaagtttagggattgtcaccttttcaaagcaggtgcaaccaaattacagcaccaggaacatggggacaagacttggctaggactaaatttttctgacgtgtcatgtcagagctagcatcgaacatttgagttccatcagacaatgtggttgcaggaattactacaggtagcatttgatttggtttttgttttaaagattttatgtatgtgagtacactgtagctgtcatcagaacagggcatcaggtcccatcacagatggctgtgagccaccatggggttgctgggaattgaactcaggacctctggaagaagcagtcagtgctcttaaccattgagccatctctccagcaccctggtcttggtacctcatagcagggttctcttgagctctagctgtactagggctgtagatgaggctggcttcagctcagacctaccgcccggcttggtgagtgaccagaagcctagtgtttttgacacaaggtttgaagtctgtgtagccttggaacttgatatgtatagaccaggctggcctgaaactcctggatctgcctgcctttgcctcctaagtgctgggattaagggcatgtatagttccactggaaaagatttgggagccacgagtcctagcatcttcctagcagagtggtgtaatcctataatcccagcacttgggaactaagaggatgagagtcaggagttcaaggtcagtctcagtctgggatactcgtgactggtctaatcagctggaaagatgcactctggtagacaggaccaaaggaattc

SEQ ID NO: 1063 - DNA, 942 bp, Mus musculus
atgctcctgtccaagatcaactccctggcccacctgcgcgcccgcccctgcaacgacctgcacgccaccaagctggcgccgggcaaagagaaggagcccctggagtcgcagtaccaggtgggcccgctgttgggcagcggtggcttcggctcggtctactctggcatccgcgtcgccgacaacttgccggtggccattaagcacgtggagaaggaccggatttccgattggggagaactgcccaatggcacccgagtgcccatggaagtggtcctgttgaagaaggtgagctcggacttctcgggcgtcattagacttctggactggttcgagaggcccgatagtttcgtgctgatcctggagaggcccgaaccggtgcaagacctcttcgactttatcaccgaacgaggagccctacaggaggacctggcccgaggattcttctggcaggtgctggaggccgtgcggcattgccacaactgcggggttctccaccgcgacatcaaggacgagaacatcttaatcgacctgagccgcggcgaaatcaaactcatcgacttcgggtcgggggcgctgctcaaggacacagtctacacggactttgatgggacccgagtgtacagtcctccagagtggattcgctaccatcgctaccacggcaggtcggcagctgtctggtcccttgggatcctgctctatgacatggtctgcggagatattccgtttgagcacgatgaagagatcatcaagggccaagtgttcttcaggcaaactgtctcttcagagtgtcagcaccttattaaatggtgcctgtccctgagaccgtcagatcggccctcctttgaagaaatccggaaccatccgtggatgcagggtgacctcctgccccaggcagcttctgagatccatctgcacagtctgtcaccgggatccagcaagtag

SEQ ID NO: 1064 - DNA, 25221 bp, Homo sapiens
ggctaattttgtatttttagtagagatggggtttctccacattggtcaggctggtctcgatctcccgacctcagatgatctgcccgcctcggcctcccaaagtgctgggattacaggcatgagccaccgtgccttgccaacccgtctctttaaaaaaaattttttttacggccaggcacggtggctcacgcctgtaatcccagcactttggaaggccgaagcaagtggatcacttgaggtcaggcgttcgaggccagcctggccaacgtggtgaaaccctgtctctactaaaaatacaaaaattagccaggtgtggtggtatgcgcctgtaatctcagctactcgggaggctgaggcagaagaattgcttgaaccagggaggcgggggttgcagtgagccaagatcatgccattgcactccagcctgggcgacagagaagactccatctgaaaaaaaaaattttttttttttacaatatgatctctgcacttgaagagctgatggtctcattggggaaacatgagtcctttcaaagtgggtattaaattaatgcttgctgctccttaaaatgatgctataatgacagtaactacttagataacaaaagaatatgattgtatcagattagtattacaagtaactgctgtgagtttaaaaactattggctggagtggtcagggaaagctgtaagaagtccaaatggccttcagttggtctgaaaggacagacagaatttggggatgtgtgtgcaatttgggttaaagaatgtaatctgtgttgtctttaagccctgcatcagaggaccagctatttgccaacataactcccatttacaagagtaacttcagataaaaccctgatgactgccaagtctgactttctcatctagtgagtgggtgtctctctaataaagtagcatcactgaacacagaagcaagcttaacctatccagggaaaagtgacaccatttctataaagggaacagcacagctccctagttctccagagtgagcaagattgtatttagacatgcaaagaatctctgacaaagtaatacattgaaggccataaaaaacagctctgtatctgtagtatagttgttctagttctggctgtggtgagctgtcatgtttgttttagcagcatgccacctaaaaagagaagtaaaacagagttggaaaagaggaagtatatgttgaaaatgtaagtttctccaaattattgagtagatttcgtccaataatgttactacatgtcttttttatcatttggaacttggaacactctgtgtattaaccacgatataagcaaatattcctaaactataagcttcaaaggattatttgaatagagaatcttcctagtttcttcttcagtagactgaaatagccaggcacagtggctgacgcctgtaatcccagcacttttggaggccgaggtgggcagatcacgaggtcaggagttcgagaccagcctggccaacatagtgaaaccctgtctctactaaaatcacaaaaagtagctgggcatggtggcgcgtgcctgtagtcccagcaactggggaggctgaggcaggagaatcgcttgaacctgagaggtggaggttgtggtgagccgtgatcgtgccactgcactccagcctgggcaacagagggagactctgtctcaaaaaaaaaaaaaaaagactgaaataaaatatctgtcatcttttgcaacatgacatcaggagctcctactaattctctctggcttcttgcttttgatttaaaaacttttgaggccgggagcggtggctcacgcctgtaatcccagcattttgggaggctgaggtgggtggatcacaaagtgaggagttcaagaccagcctggccaagatggtgaaaccctgtctctaccaaaaatacaacaattagctgggtgtggtggtgcacacctgtaatcccagctactcgggaggctgaagcagaagaatcgcttgaacccatgaggcagatgttgcagtgagccgagatcgcgccactgcactccagcctgggtgacagagcgagactccgtctcaaaaaaaaaaaaaaaaaaaaagaaacttttattcattcatttcatgcgtattggggaatacaaaaaaacaacacaaagcatcttttgcttcacttcctgactctactcaccgtgttctctctctccttcctacttactcgtattttactcattaagacctgagttaagatctacatcctccatggagcctccccggacctcttcagcctcctctgaaccttgactttgtggatgatgctatcagaacttaatcacagaagaccttgttaaatctctttttttgtttgtatgttagagacagggtctgactctgtcgccctggttggagtgtagtggcacgatcaaggctcacagcaacctctgctacctgggctcaagcagatcctcctcccgagctcagcctcccgagcagctgggactacaggtatatgccatcacatccagctaatttttgtattttttgtagagacggggtttcaccatattggcccacctggtctttaactcctgggctcaagtgatccaccagcctcagcctcccaaagtgctgggattacagtcatgagccactgtgcccggccgttaaatctcttaaactcattttgtgttccttggaaaggcagaatggcatggtgggtaggagattgctctgccacttaacagtgtagccttgggcaaattacttatctctgttccgtttatttatctgtaaaccaatgaagatagtaaaaatgcccacctcataggatttatatggggatataaatagaacaatgcctagcacatcattgatgctcaatattggcttttagtaccctatctcttttgcccctcccgccaatgattttcatttcttagcctttatgttcaattaaaggatgatggtttctgccttcaatatatttatagtctagttgtagagatgagacaaatacagaaaaataagactatatactattagatgacaaattagatacacaataaagaaatgttttcatcactttctttgtagtgcttacaaggatgttccatgaaatcttttttgcactttttttattttaccttgatgaactttgtggcttttccaaagtcttacatcagcaattttattttacttttaaaagatggtagacaatcccctcaccagctcctagatagaagacattctctctctctccctcacacacacacacacacacacacacacacacacacgcacagacacgatggcccttttctttgttagttagacatgcagcgtttttgttcatgtgtctgcctggttgttctgatctgagggatacattttcttagtcttctaataaggtattttataacagtctccaggcttcctgtagcctttatatgttctaagctactcctttttatattcatctatccagcaatactcaggaactataaaatctttgtgtataatgccttcagtaaatattatttttactcaaattgtcagtatctaatgtgcaaaattccaaaaataaatctagattacttttatttcctctgaaaaacaaaacaaatgaattggtaataatttaaatatactttattgtaaaatagccctttcttttcccaaccttgctggctaaaatagatttataaaactgaaataggccaggcgcagtggctcatgcctgtgatcccagaactttgggaggccgaggcgagcggatcacgaggtcaagagatcgagaccatcctggccaacatggtgaaaccccgtctctactaaaaatacaaaaattagctgggcgtggtggcgcatgcctgcagtcccagctactccggaggctgaggcaggaaaatcccttgagcccaggggccagaggttgcagtgagctgagatcgcacaaccgcactccagcctggcgatagagactccgtcttaaaaaaaaaatgaaataaatatcatatccttatcaaggacaagaactagctaggcatggtgcctcacacctgtaatcccagcactttgggaggccaaggcggatggatcacgaggtcaggagctcgacaccatcctggctaacacggtgaaaccctgtctctactaaaaatacaaaaaattggctgggcttggtgacacacgcctatagtcccagctacttgggaggctgaggcaggagaattgcttgaacccgggaggtggacgttgcagtgagccgagatcgcaccactacactccagcttgggcgatagggtgagactctgtctaaaaaaaaaaaaaaaaaaaaaaaaaaaaaggccaagaactagttctagtgactacatagattccttgatcattctgaaattgggacatggtggatttcctaagtgtctcccactatcacaatgatttcaatttaaaaaggttttcagctgggtttagtggcttatgcctgtaataccagcattttcggccgggcgcggcggttcacgcctgtaatctctgtaatctcagcactttggaggcctaggcgggtgaatcacctgaggtcaggagtttgagggcagcctgaccaacatggtgaaaacccgtctatactaaaaatacaaaaattagccgggtgtggcggcaggctccagtaatcccagctactctggaggctaaggcagggagaatggcttgcatccgggaggcagaggttgcagtgagccaagattgcgccactgcactccagcctggtagacagagcaagactccatctcagacaacaacaacaacaaaagaaacgcattttgggaggccaagactgatggatcacttgaacccaggagtttgggaccagccttggcaaaatggtaaacctcatctctacaaaaaatgtgaaaattatcggccgggtgcggtggctcaggcctgtaatcccagcactttgggaggccgaggcgggcggatcacgaggtcaggagatcgagaccatcctggctaacatggtgaaaccccgtctctactaaaaatacaaaaaattagctgggcgtggtggtgggcgcctgtagtcccagctactcgggaggccgaggcaggagaatggcgtgaacccgggaggcggagcttgcagtgagccgagatcactccactgcactccagcctcggtagcagagcgaaaccccgtcacacacacaaaaaaagaacaagtgaaaattagcccggcgtggtggctcacccctgtaattccagctaggtgggaggctcaggcagcaggatcgcttgggcgcaggtctaggctgcagtgcgccgtgatccattgtgccactgcactccggaccctcggtgaccagagtgagactttgtctcaaaaataaataaataaaaattaaaacaaaaaaagaaatattcagtttttgttttgtaaagacagggtttccctatgttgcccaggctgctctcctgagctcaagcaatccgcctgcctcggcctcccaaagtgctgggattacaggcgtgagccaccatgcctggtctttttaaatttagaatgtttcctgtctggccaggcgcggtggctcatgcctgtaatcccagcactttgggaggctgaggccgccggatcacttgaggtcaggagtttgagaccagcctggccaacctgatgaaacccgtctctactaaaaatacaaaaattagtcgggtgttgtggcggacgcctgtaatcccagctacttgggaggctgaggcaggagaatcgcttgaacccgggaaggggaggctgcagtgacccgagatcatgccactgcactccagcctgggcgagagtgggactctgtctcaaaaacaaataaactaaataaaataaataaaaaactgagtaaattttttttaggagataaatgagtgatgcagattcaatacgtctctacctgattaattataaatagcgtatagagtcttagttatacaatcctagttatataaatgcattgactagacttacagacactttaaaaaattgtgtaccgatatcactttcaaactttcttctaaacttgttttttaaaaaaatttcgtgactacagaacttgctgaagtcattgtttttttgttttttttttttgcataagcatatagtccctggatgaagtcattcctttgacaatgacttgattaaacccatatcaggcagaatatgaaaaccacctaaggattaatttggatattgttcaaattaatattaataaatgctcctcttcccagagaactgttagcataattgtggccttttatccttccaaaagcacttgtcatttaattattagggtgatttttctgattctttgttagattctttgagatagcacaaatagtgctaattttattaagactatatttcgataaatcaaaacatcaagttccctactctcgaggagtaacttttgacccacaacacatctgaatgtttactaattatcttttaaagcagttttaagtaaatcaaagctgtttgccaagcaaggtccatgttttgtaacttccagctgtgaagcccccactatacaaagtagatatattaaatgttaatcactttagctctaattaaatatttagtccttcaaagacctagaaaaagtgaaaaaggttgaagttgatacatatttttttttctaaaaggcctaaaagatctactagaaacaactattttaaatcacatctctccccaaatggttaaaaatcgaactattaatccagtagtttacctttggtaccttctaggtgtaagaccgtttgggctgggcgcggtggctcacgcctgtaatcccagcactctgggaggccaaggcaggtggatcacaaggtcaggagatcgggaccaccatggctaacacggtgaaaccccgtctctactaaaaatataaaaaattagccaggcgtggtggcaggcgcctgtagtcccagctactcgggaggctgaggcaggagaatggcgtgaacctgggaggcagagcttgcagtgagccaagattgcgccactgtactccagcctgggagacagagcgagactccgtctcaaaaaaaaaaaaaaaaaaaaaaaggccgttttaaaaaacatcatcatcataaccacgatcaacattattgccatcatcattgctaatatttattagaagtttactctgtactgggttatatgctttacaaacaagagttttatttgctccttacaacaaccctatgaggtagatgctgttattatctccattctgtctaaagcttaataaggttaagtaacttgaccaatgcctaactagtagctgccagatcccggaattgaaaccaggctaacttagtttaaagcccttgctcccaacttttatgttcccgaagcccacttaattcatttaaatttggtataaattgactttaattatggcctttttgttagaatccattatagtcttctcttttatcaacaaatgttggataaagtatgcattcagggaggctgggcatggtggctcacacctgtaatccaaggaggctgggcatggtggttcacacctgtaatcccagcactttgggaggccgaggcaggcggatcataaggtcaggagttcgagaccagcctggccaacatggtgaaactccgtctctactaaaaatacaaaaattagctgggcatggtggcgggcgcttgtaatcccagctacttgggaggctgaggcaggagaaccaattgtttgaacccgggagatggaggttgcagtgagccgagatagtgccattgcactctagcctgggtaacagggcgagattccgtctcaaaaaaaaaaaaaaaaaagggcattcaaggaataggaagacaaagtataatggaaaagtaaatgaacaaaaaggatttaaaaaaacaaatcccaactgtcagattagtggacagtgaaccaatgctctgagtttgttcatcaatctgtggtagaactacaattgtttcctaaagagtggaaaggctttgaataaaagtggagaggtagagagggctctcccaggacaggttgattgcttccgcaaaggcaaagggtctgtaaagtgctaggcgagtgggaacaagtgggaatagttctgtttgactacatttgagggtttgagaaaggaaagggagggtagaagggatggaagtgggaatcacatatgtttaatgatgtcttgttcggtgccaaggacagttttagaccctgataagcggaaagctttgaatactcaggaggtgaatttgggtcatttcatctcctctcttagctgctgtatgaccctgtgccatcctatttatgtttcattttcctatctgcaaaaagggagtaattcttgttcccttgggttttctcctagtcataaaaaatgaatgagttcggccacagtacacaaacaaaaggaaaatatgtaatattttgtaggataaattcataaaagttgtggaggatctgggcacttttataaagcaagcactgtagaaaactttcaaaggaaacatttaaattcactaatgacagctatagggatcctgatttttcctttaaatggcaggcacttcaaaaaattaaaatagaatgtagttagctttcaattacttaggccactgacaattcaatttatggattatatagtattttaatttactcatttcacacgtcgttatcaactctacatgaagtttaaaaggacaaaggatgcaagtggaattggtcagtgttccgggttatttccaagggaggcagagggtggggggtttcctttgagacaagacttggggttggccaataattgctggtattgcctgcctggtaataacaggctgatgaaaaggtgactacaacgtgaaaactggttaaatcaagcgcaccctcccaccctcgttttagatgaggaattttccgccctcacagaaggggctgaggcagcatctggcatcacaacactaacatttgcttcgtgatttcctctttacccggccctttgacacacatcccttcccagaaatcaggattcgctggtgcttttgcatttctaaaatgggaatcccgtggctgagcttttagccggccggaacgactgagggctgcatccctttcccgcaggagcggggctcccgcctccagttctgttccaggcctgactcctccactccctccgtgactcatgtcctgcggatccttcgcccccgacgcgccccccaacacacaaacccccagaatccgcccccagcctacagcgcgacgtcagcccgccccagccgacttggaggtctcgggtctgagtcacacagaaagaccaccctcgtcggcatccccacacacagtccgacacccggcgcgccggcctccccgcctgacacactaacgcccgtcgtctccgcgcaacttgttatgctccggctcgagcccttgacccaaaaacctcagcgaaacggagagccgcagagccggcctcgggcggcctttgatggctttgttattgtttgggtttgaatcgatacgcccctccccatccttcctccctcgcggccctacacccagctcccgcctcccctcacgccccgcgcccctccccctccattttggcgccttttccttcccgccacgtcgtggcggcgtagagaccattctgaccgcgagagctgggcggggcgggggcggggcgcgccgagttatgcagatcaatcggcctctggttggctggagtagcgctggcaggggcggggccggggcgcggccacagagcgcgcggggcgggggccgaggggagtcgcccagtcccgccgcttccccaccccctctcctccctcggccggcccggcagccctgctccccgccttggcctcccggagaggccccgccccgtccccgcccgccgcgccctccccgcgcgccctccccgccggcgcgctcctcccctttactcctggctgcggggcgagccgggcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggtgagagcaccccccgcctccggcccggggatgcggggcggcggcgggatctcctgggtggggagctggcggctcgcgggccggcactgagtccccgtgcttccccctttcctaggcaaggagaaggagcccctggagtcgcagtaccaggtgggcccgctactgggcagcggcggcttcggctcggtctactcaggcatccgcgtctccgacaacttgccggtgagtgggcgccccgcggtggggagggcgcgccgggcggggggcgcacgggcgtgctttagcccggacgagggaacctgacggagaccctgggcttccaggtggccatcaaacacgtggagaaggaccggatttccgactggggagagctggtgagtgccctgcaggagcgacccccaggatgagtgggtggggtgaggggcgcccccgactcccgccctaacgcggccccctcgcccctgcagcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatggtgagccaggcccgggagggagctgcccaggtgactcggcccggcccggcccagtccggaggcctcggccagtctcccgcgccagccttttgtaaaggtcattgggccgcctggctcgatgctagccggggtgggacgcaggagagcctcccagcgtagtaaagccggggattttcagccagctgaacctgtaatgtttctggcatgattttattcttcaagtggaattcagttagttccaggctttcccgatgaataagaggttgtgggcaaccggcggtagcccagatttttctaaagtctgacccagtttccccgccagtaaaaggatgggggcgggggaagaggtggaaattgatgccggttttgtaatttttgttttattttataagggagttagttttctgtatggtagttttagagctgcagttcttaactcctttctgatctagggaaggttaaggaataggaactatattattactggtggcttttttttttctttagtgttaaggggagagagagtcaggaatgaatgttgtgaaataagatctgtcgctggtttgaaaattagttgggtgtctccgcagagaggatgaaaacctatcctagggaggggcttggagcgggttctttcagaaaagaaggaatggagagcctgagatcaaagctgcggagggtgggtcatcatctgagcggcttaacctaacaaacgacagcctttcaaaacttgtgactcgggcttgtggtttatgtttatttgcccttggaggacgctgggttgggctgcattttttgtatttaacagttaatggctggccgggtcctcccatgttttttctttcaagtctttgctgccccctggtgagcaccagcggcatggcccctcctttttcttttactacccaaagtttgtaaacaggaatcacgtggtctgaaaccaaccctgcagctctgtctacctttccagtctagggaggaaagggtgtgggtgtctgctcctgcttgcatcgggtggggaggaaggcctcccaaagggcaccctgacttaggatgttgtgcaagcatccttgcttggatcctgtcggccatgagaatctcacccgggctcctgggcagtggtgaatgcaatttaaggatagtctatgagatacctttcttggttgtgcagacatgcatcccttcatccttcgcaggcggtcctgcctcacagggcctcaagttttgggtctgcggccagctgtgtttgtttcttggagcagttcataaagaatttcagtttatggtttgggctagcagagaggtgggtaatgctttgggttggagagatgccgtaaggtgcgcctccactctccttagcccagagggaaaaatggagttcacctagctcctgagagaagggattttttttttttttaaaagaaagagttatatataccacccagcttctttgtgcttgtttttgctaaaagtgtgttttctcttctattcccttggctcacagggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcaggtaactgatggaaacccctggccatggggttattggtcttaatggggctattagtcttcatgggacagtctttgaaattctggagagcttcactctccagtagattctgtcacccttggcttagaattgtaggtgagtgatttacacttgagctggcctcataaatcacatggtttgcacttgagctttccttgggaggtcagaggaaggcatgtgtgagcatattaagaagaaaagacaatctggcttctccaaaaacttttttaaaggtaccaacagaaacctgataattcctggctgttttgccagggagtaaaaagttaaaagctcttttagcatcttctttaaggcagcagctccaaatattttggtaccagtgacctcactgtgggtggtgttcgtgtttgtaagttggtaggtgaattgaatcatttcatcatgctcagtggtgtctcatcaaaatctcttgtcatcatccttcctatttctggtgagtgggtgttgtgggaaaggcccccactattgaagtttgaaaaccacaggtttaagaggggagtcagtttttagctgaaagcagactggaggacccagatattagtcaataccttcctattgaagggtacccagcacagtgttctagaaaatgcttggcctccctgggaccccagacttgtgggcctctgagaagcaaatggggaagacctttgcagtgtaaaaacaagttgagtcattcataacctcgtctatcctcctttctgcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaactcgtggcttctaatcgtctgtgcggaggcattgctaacctgcatttattgagcatttggtaagtgccaaagaattgtaggagaaaggaattctcagcctaaatctggcttccttcaacattgggatttctaggatagtcatcttcctgaaacgaatgtatggtcaaggggtaggaccagtattgtcaaaatttgggcaatatctggcatgggaggcctaataaaataaccttttccagattacaattttaaagctatgcaaataggatagatgtgacaattttcaagtgttcaatagccatttatggctagtggccacctcatataaaacatcattgcagaaagttctattggatggggctgatctagagataacaaatacatacctattaccaaactaacccttgaagcttttatcagttgtctgccactgatagtaaaacattttgagcatgtccccttggtacacgtgaagtttattgaaaaactattgcctctattactctcggttcctgattcaagtttccttcacctttagtgtgaggtttagtttcttttcgagactgagtctctgtcaaccaggctggaccagctggcgtgccactgccagtggcacgatctcggctcactgcaactttcacttcccgggttcaagcagttctacctcagcctcctgagtagctgggattacaggcgcccgctgccacgcccagctaatttttgtattttagtagagacagggttttaccatgttggccaggctggtctcgagctccttgaccttatgatccgcctgcttcagccacccaaagtgctaggattacaggtgtgagccatcgtgctccgcagcctttttttttttttttttgagatggagtgtcgctctgttgcccaggctggggtgcagtggtgcaatctaggctcatcgcaagctccgcctcccgggttttaagtgattatcctgtctcagcctcccgagaagttgggattacaggcatgtgccaccaggccagctaattttgtattagtagatacggggtttcgccatgttggccaggctggtttggaactcctgacttcaagtgatctgcctgccttggcctcccaaagtgctgggattacaggcgtgggccaccgcgcctggcctagtctttaacaatagtataatttattatgcagcatagaaaaaataatagaacggtgtggtgacactaaagtcgtgaccagataagacccagtctacaaaaaataagtgaaaattagctgagcgtggtggcatacacctgtagtcctacctatgcaggaggctgaggcaggaggatcgcttgaacccaggagctccaaggttgcagtgagttatgatcacgctattgcactccagcctgggcaacaggtaaccccacttaaaacacacacacacacacacacacacacacacaatagtggatgggtagaaatgtgagtttgacttaaggtttccccctctgatgtgtttgacaaagggctaatattgggagtaggtgaaatgttagctctgccattttcttactgcttattcttgaataattagtatttttagtccatggtttctttgcagggatctgtttaataggccctttgtccattttgtgtgagtttagttaaactggatggcaagacccatgaatccactttgtacgtgtggcctgaatacatcctgatattttgaaagcacactggagtgccattgtcaattcatatattaagtattggtaaatgttggtttcttgtttctttataaatatccacagttataatactccctccctgggggtcatcatgctcccaaccctcaatgcatccacacaccctttggacactggcccatatgcaccctcgaggttgctggagggtgcagactataatacccctcactcctcattgggttctggtgtatgtctacccttaagcttagactagatcccatacctcagctcagcccccatgtggctataaagaggaaggaaggatgtcttggttctggggggctgattttctgaggttccccttttctctaatctctcccatcccccacacaacatacacacactaccaacatcttggagcctgagggttgcatgcttcgtcctttccagtaaagctgacacttggataattaaaagttgccgcaaactattaacgaaatcaggcaaagccccacccttctctttctcgaagtgagtttctggcagtttccccatctaatgagactgctgcgggggaatagaagaaagtatctctgaataaagacagatcgtgctcctgttggatgcaagagattaagagttttagggggagggtgaaaggtcatatttaatctcttctcaggggcagtttgacatctagcgtggaaagggaatcagataaccaataagtctgcgggggatcaatgtcatggccagaggaatatagagagcaatggttaaaagcattgacttgggaatcagccttgagcttacttatctagaaaccttgggcaagttattacaccctctaaaactaatctctaaacagagatactcctggattggattattaggagactgggttaaataacagatatacttacatacagaaaaactactatctcccgcttacggatgcatacacatgtagcaaaagtacaaagaagtacagggtggggtagggtgtggtagttcacacccataatcccagcactttgggaagacaaggagggatgatcacttgagcccaggagtttgagactagcctggccaacatgacaaaaccccatctctacaaaaaaatagaagcattagccggacgtggtggtgcgtgccggtagtcccagctacttgggaggctgaggtgggaggatcaattgagtccgggagatggaggctgcagtgaaccaagatggcaccacaacattctagcttgggtgaaagagcgagaccctgtctcaaaaaaacaaaacaaaacaaaacaaacaaaaaagtacagggtgataataagtttccagagtcagggaagtggttattacctttggggagaagggagggaggttgtgatttgtggaaagagaccttcaactattttggcaatgctttattccataaactagatggtatgagtaaggtgtttgtattattcttttcaacttttgggttgttttaaatgttttatgataaactttatttttaaaaatttttctctggctgggcgcggtggctcacacctgtaatcccagcactttgggaggccgaggcaggcggatcacaaggtcaggagatcgacaccatcctggctaacacagtgaaaccccatctctactaaaaatacaaaaacttagccaggcatggtggcatgtgcccatagtcccagctacccaggaggctgaggcaagagaatcgcttgaacccaggaggcggaggttgcagtgagccaagatagctagccactgcactccagcctgggcgacagagtgagactccgtctcaaaaacaaaaaaaattttttttctttgttctttctttttaaacatttatttatttattttagctgggagtggtggctcacgcctgtaatcccagcactttaggaggctgaggcgggtggatcatctgaggtcagcagttcaagaccagcctgaccaacatggtgaaacccagtctctaccaaaaatacaaaattagctgggcatggtggtgcatgtctatagtcccagctactcaggaggctgaggcaggagaatcacttgaatccaggaggtggaggctgcagtgagccacgatcacgtatagcctgggcgacagagcgaaactctgtctcaaaaaaaatatatatatttatatatataatatataatatatattatatattatattatatattatacataaattatatattatatatataatatataatatataatatatattatatattatatattatatattatacataaaatatatataatatatattatatattatattatatattatatataaaatatatatataatatatataatattatttatttattttgagacagggtctcactctgtcacccagactggagtgcagtggcataatctcggttcactgcaacctccacttcctgagttcaagcaattctcgtgcctcagcctcccaagtagctgagactacaagcgtgtgctaccacacctgtctactttttgtattgttagtagagatggggtttcaccatgtttgccaggctagtcttgaactcctgatctcaagtaatccacctgccttggcttcccaaagtgctgggattacaggtgtgagccactgcgcccggtccattttttttttttcttttgagagacagatttttgctctgtatcccaggctggagtgcagaggcatgaacttggctcacggcacccaggttcaagcgattcccctgcctcagcctcccaagtagctgggattacagggacctgccgccatgcttggctaatttttgtatttttagtagagatggggtttcatcttcttggccaggctggtgtcaaactcctgacctcaggtgatccgtccacctcggcctcccaaagtgctgggattacaggcacgagccactgtcctcagcctttcactttttcttttaattgagacagggtctcactacgttgctcaggctaatctttaattcctggcctcaagtgatcctccctccttggcctcccaaagtgctgtgattacaggtgtggaatatcatgcccagcctatgataagcttttaaaagtgatgaatatatttgtgcgtatcatgtaggaggcagcagatggagttattactgcccttggctgaggggatctgggaaggcttcaaagaggaggtggcatttcacctggattttgaaggatggagccttagcctgcttccctgtaaaataggcaccaaacatgcagatggagcagagaaatctggatgtgctaaatgtttttcccccactagaccaggaatcagcaaactatggcctgctgcctgaactggtccctgtacagtttttgtacggcttgcaagctaagcctagattttacatttttaagtagttgaaaatcaatcaaatgaagaataatatgttgtgatatgtaaaaattatataatacttggctgggtatagtggctcatgcttataatcccagcactttgggaggccgaggtgggaggattgcttgaggccaggagttctggaccagcttgggcaacctagcaagacttccatctctacaaaaaataaataaaaattagtcaggcatgatggcctagctacttgggaggctgagacaggaggatcacgtgagcccaggagtttgaggttacagtgagctatgatctcaccactgcgctccagcactccagcctggttgacagagcaagactctatctctaaaagaaaaagaaaaaaaaagaggccaggtatggtggctcatacctgtaatcccagcactttgggaggcttaggtgggcggatcacctgagatcaggagtttgagaccagcctggccaacatggtgagaccctgtatctacaaaatacaaaaattagcccagtgtgttggtgcctgcctgtaatcccagctaccagggaggctgaggcaggagaattgcttaaacccataaggtggagcttgcagtgagccaagatttctccattgcacgccagcctgggcaacagagtgagactgcatctcacaaaaaaaaaaaaaaaaaaatatatatatatatatatatatatacacacacacacacatttgtacacacatatgcaactcaattgtctgtgttcataaataaatcttgtccatttacatattgtctatggctgcatttgtgatacgatggcagagttgagtagttaagacactcagtatggctggcgaagctgaaaacatttactatcttgtcctttacagagaaatttgctaatctctacactagattatggtcccattgactcattttttgttgttgttgtttttttggggtttttttttttgagacagggtcttactccgtcatccaggctggagtgcagtggctcgatcagggctcactgcagccttgactttccaggcttaagcaatcctcccacctcagtctcctgagtagctgtgactacaggtgggccccactgtgcccagctaatttgtttttttgtttgtttgtctgtttgtcttgagacagggtcttgcaatgttgcccaggctggagtgcagtggtgcgatcacgacacactgcaacctcaacctcctgagctcaagtaatcctcttgccactgcctcccaaagtgctgggattacaggcatgagccattgtgcctggtctgaactacatctttgataactctttttttttttctttttgagatggagtctcgctctgtccccaggctggagtgcagtggcatgatctcggctccacctcctggttcaaacattctcctgcctcagcctcccaagtagctgggattacaggcgcctgccaccacgcctggctaatttttgtttttgttttgttttgttttgttttgagatggagtctcactctgtcacccaggttggagtgcagtggcaccatctcggctcactgcaagttcagcctcccgggttcatgccattctcctgcctcagcctcccaagtagctgggactacaggcacccaccaccacgcccggctaattttttttttttttttttttggtatttttagtagagacggagtttcaccatgttgtccaggatggtctcaatcttttgatcttgtgatctgcccgccttggcctcccaaagtgctgggattacaggcatgagccaccacgcccggcctgataactcttaacctagtgccaggcatgtagtagttccttagtgataatagctaacatacagtacctactatgtgcccagcactattctgcatgctttgcatgcattaacttatttatccttaaaacaactctatgacactattggaaagtacagggggaaacactgttatttgttttattttattttattttattttgtatttttatttatttatttttttttgagacagtctcgctgtattgcccaggctggagtgtaatggcgcgatctcagctcactgaaatttctgcctcctgggttcaagcgattctcctgcctcagccttctgagtggctgggattacaggtatgtgctatcacgcccagctaatttttgtatttttttttagtagagactgggttttgccatgttggccaggctggtctcaaactcctgacctcgggtgatccacccgcctcagcctcccaaagtgctaggattacaggcatgagccactccgctctgcctattttattgttttagagatgagggtcttgtcatgttgcccaggctggcctcaaaatcttggcctcaagcaatactcctgcctcagcctcctgagtagctgactgtacaggtacatgccacctagcccggcttgatgcagttatgtatccacatttcacagatggggataacagatgtgcagagcagtaaatttcatgtcaaaggccacatattaggtagtggtcaggtcagaatttggacctaggccatctgtggttctatggtcatccagactccgcgatcttggctcactgcaaacatttgtgtggattagccacctcaaggtcccttcagggcccaggatctggaggtgagaatggttcttccccagactccagagttgggtaagccattctgttctgtggaaatagtcattatgaactcctgtaaactatctttcacttgggcctggctggggaggaagagttggaggctgaaaagggagaagaaaggggacccgggggggttggggtggggcaggggcacatttcttgtaaatgttgctcagctccttcaactgctgtgctggttcttggaaaccttcaccacaaaagacctatcaagaacagtgttaaaaaagatatggcctcatcccccagttcatttcctgcccagccttgcactactaaccccgattgccaagagcaaggttgcagtgtcccctcagcagtgctgtgggaggaagtgcaaaaataagcagaactaggggcaagaccagaggactgtctttatttttatttattataacaggacatccgatgtacagaagtggattcatcataatccttggctcatcgtatattctcatccttggtccaagaatggtcttttgtttatatatatatatatatatatatatatatatatatatatatatatatatatatatatatatatatttttaaatcggagtcttgtcacccaggctggtatgcaatgacgtgatctcggctcactgtaaccttcacctcccaggttcaagtaattctcctggttcagccttccaagtagctgggattacaggcgcctgccaccacgcccggctaattttttgtatttttagtagagacaggtttcgcaatgttggccaggctgatctcgaactcctgacctcaggtgatccacctgcctcggcctcccaaagtgctgggattacaggcgttagccaccgcatctggcccgttattattatattttatcatactgggtagtgaatccaccacccagctcaaaaaacagaatattaacaatgacatccatctatctatatgatcctctcttagtccatttcttacctcccccagatacaacccactgtcctaaattttgtgtttggcattctcttactttatattttatttatttattttgagacagagtctcactcttgcccaggctggagtgcagtggcatgatcttggctcactgcaccctcatcttcctgggttcaagcgattctcctgcctcggtctccgaagtagctgagattacaggcatgtgccaccatgatttttgtatgtttagtagagacagggtttcaccatgttggtcaggctggtcttgaactcctgtcctcaggtgatctgctcgcctcagcctcccaaattgctgggattacaggcataagccaccatgcccggcttatttatttatttactttgagcttgtcacccaggctggggtagtcgcgcaattgaggctcactgcagcctcaaattcctgggctcaagtgatcctcctgcctcagcctcccaagaagctgagacacagacatgttgccaccacaccttgctaatttttttttttttgagatggagtcttgctctgtcgcctcggctggagtgcagtggcacaatctaggctcactgcaagctccacctcctgggttcacgccattctcctgcctcagcctcccgagtagctgggactacaggtgcccaccaccacgcctggctaatttttttgtattttctagtacagacagggtttcaccatgttagccaggatggtctcgatctcctgacctcgtgatccgcccgcctcagcctcccaaagtgctgggattacaggcgtgagccaccgtgcccagcccaccttactaatatttaaattttttgtagagatgggtgtctcactatgttgaccaagttggtcttgaattcctggcctcaagcaatcctccaaactcagcctcccaaagtgctgggattacaggcgtgaccactgtgcccggctaacttttaaaattttttatagaaataggattttgcaatgttgcccaggctggtctcaaatttctgggctcaagtgattcacccgcctcggcctcccaaattgttgggattacggatgtgaggtactgcacctggctaacagcatagcagcattctttcactttaaaataacattttattttataggtatgtatccctaaattatggagtatttagtatttttattttgtcttattttatttcatttcatttttagatggagtctcgttctgtcggccaggttggagtgcagtggtgcgatctcggctcactgcaaactctgcctcccgggttcaagtgatt

SEQ ID NO: 1065 - DNA, 2623 bp, Homo sapiens
gaggaggcccgagaggagtcggtggcagcggcggcggcgggaccggcagcagcagcagcagcagcagcagcaaccactagcctcctgccccgcggcgttgcgacgagccccacgagccgctcaccccgccgttctcagcgctgcccgaccccgctggcgcgcctcccgccgcagtcccggcagcgcctcagttgtcctccgactcgccctcggccttcgcgcagcgcagcacagccgcacgcaccgcagcacagcacagcacagcccaggcatagcttcggcacagccccggctccggctcctgcggcagctcctctggcacgtccctgcgccgacattctggaggttggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctacaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggcagaaccctgccaatggaactctttcttcatcatgagttctgctgaatgccgcgatgggtcaggtaggggggaaacaggttgggatgggataggactagcacattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaaatgcacaaaccaagcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatgggaggggccattgctgactgtgtatataggataattatgaaacacagttctggatggtgtgccttccagatcctctctggggctgtgttttgagcagcaggtagcctgctggttttatctgagtgaaatactgtacaggggaataaaagagatcttattttttttttatacttgcgtttggaataaaaaccctttggcttt

SEQ ID NO: 1066 - DNA, 942 bp, Homo sapiens
atgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctacaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatag

SEQ ID NO: 1067 - DNA, 47493 bp, Mus musculus
  misc_feature (1241)..(1975): "n" at positions 1241 thru 1975 can be any base
  misc_feature (13629)..(13648): "n" at positions 13629 thru 13648 can be any base
  misc_feature (15882)..(16151): "n" at positions 15882 thru 16151 can be any base
  misc_feature (22065)..(22084): "n" at positions 22065 thru 22084 can be any base
  misc_feature (26266)..(26285): "n" at positions 26266 thru 26285 can be any base
  misc_feature (30454)..(30473): "n" at positions 30454 thru 30473 can be any base
  misc_feature (31687)..(32259): "n" at positions 31687 thru 32259 can be any base
  misc_feature (40899)..(41095): "n" at positions 40899 thru 41095 can be any base
  misc_feature (42909)..(43118): "n" at positions 42909 thru 43118 can be any base
tgagctgttgatcacatgctgcatttagagagagttctgggactaaagctcagagagaagacacaggcccatggccagagaggccttagctatgtgggccttgccacctgtacccaggagcacaccactccctttggaaagagcacccttctaacacctatcatcaaagtcaagcagacccagtcagtacagcttcctttctctcccctggccttgctcttttgccctttgcagccaaccagtgggttgagttgagtggatgcccgaacagagtctttccagtggacaataggcgctgtactgaagcatggtggacgcggggacatgtttgaatatttctgatactttcccccatcccaccatgtgacaaccttccagctctgagacctagaggaacctggcctctgcctctacctaggtctccctccagggctccccaggtgacaccctcgaggtgtctgatacattagtgcttccacattccttcaccagcagaacgtgccgctgccgcccagagaggctggcaaacacatggccgccggcgcgggagcctcccgcctgccaggactcgttcaaagtatgtgtcagtaatcctgctggcccggcggggcaggacaggcgctggctgggaaggcttcaggcagggccctgtgctgactggagtaaggacttgggacccctccccaactcagaaagtgctggatcctcaaggagggcttccattttctggggatgctgtccattcgtgggaaggcagcggattgttggggatctcaggaacacaggtaccgtggggacagctctccatctgaatggttcctggacagccccattcaaaagaggacagtgtgctttgtccatgaacagagtgagtcccataccctgggtctcaggtatgagtgtggaagcctggtgatgtcactgagaggcccagtgctccagagagaaaggcctgagtgggacccacagcattctggcccaggacccttatcaacagagacttctctactcatgatcctccttgttccctctgggcctgggcagagccttaggaaccctacctgctaggatccaactcagtgcttactgtgcctgattccatgccagcagcggataagagaagtcaggcaagcaaggcacttcctgcaccagatatagatgcagggagaggtggacagacacagtcccagacaggcaggtagcgctcgcacacacacacaaacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagccttggcccagggaggccagtgctggcccaggctgggctggcctgctgcccatctcccagtcctggaccagcctccttcctctactgcatgtcacagccagcgtctctgctatatccctggccaggtgcccggcctttcaacaggagcaagggaaggaggagggagaaaaaccattagtgtttgccggctgcaggcgtggctcacgtggctgcagccacaggatgaaactcctagtctaaggatggggctatgttccaaaacatagcgagctctaagtagacggcgatgcctacccctttaaagacaaactaggaacaagtaataaaaaattaacagcattagtgaaaatgaaagcaagaggagtctgagatctgattggcataacacgggcattttcactggtgtggcttgttcttgtttgacacacacacacacacacacacacacacacacacacacgctcgcgcgcgtgcgcgcgcatgcttttgtaaggataaaaagtttcagcctcactttctaaggcatagtttaaacatctgcattttgggatcattttgagggcggcctcagcagttacctgaggtctgaagtgcttagggtccactgcctaactttggctgccagtccttctgctaggacccaagaaaaggcttggggtggggtggggtggctggacctttcagagaaggaatggcaggagaacactaattttatttggtgggggtttgtccagaggaccttacaatgtgatgtcaagttggacagttaaaattctagctgaaagtaagattgtaggcttctcccaagaggctgtcctccaccctggttggcagagagaggggaaatggaatgaattcctcccaccgtgaatcacaaaggccaggtgcagagaaatgggtgcagcgagggtgtgcctcctcccagcttctccccaggcccaggcagggccctcctgccctagctgtttccatcaccccaaggcagggttcagaccttacggtgacctcacaactggaggagctggatgtggattggaagtgactggttacagggtcttccattcttaatgctcttcctgggcaaaagataagggctcagcctaagtcaggacacggggtcctttgagtaacctgagggttctctgtctttgtctgcacatgggtttacacacgttagagggattctgtgtgaaaggggagggaagagttcatacaacactcctggaggctcagggcgggcccaggggctcaggaaagactaggtgcgttctggatgggatgaagacccccgtttgtctggctggtagctgtctcttgggccttgtaagcaggcaagggcgactggctaactgccagggctcaggtcccactggtccctgtcccttctccaactcctgatatctcttgggggttggatctgataaatattggcctttaagagagagcaatggctcaagagggcagtggaatttcagatgtctaggggaaattatgtctatcattaagttctgggagaatcaggtggagaaagcagaaaaggcaggtggcaaaggccaggtcagggcccaggaaggcactcaggtgtttcgagtttggactcaagccttagcaaaatgcttgtctttggagtatctttacagttatggaatgtcaggctagaagagacctcagatcagcagcttaaaactgtgtttctgtcactatgctccaaccctacggttggtcacctacggttcagctagggacactgaggctccaagagtctcagagggcagaccagaatagaccagcacagtgatgagatgatgagatgagtcctcacagttaagatcattgctctcatctcccttggtgactctcccttgatggaagtggtcctgtaagtgaagcctgcctcttttgtaacactgtctcattttgatgtgctagctgcacagttcggcttgatgcatttctctgtattggactcattcatgaatgttactttgcttaatacattttaagactattacagtgtatcagggccaagaggatggctcagtcagtagattatgtatctgttacacaagcacaaagacctgtgtttgatccttaggacacacataaaaaaattatctggtagtatagttttgaaataccagtgttgaggatggaaagacaggcaggcccccgaagttcactgaccagccagcctagcctaaaataagctataggttccaatgaaagaccctataacaagacatagttcctaaggaacaacatacaggattgatccctgcccatctagtgcatgtgttcacacctgaacaggaatgcgtgagggggtgcccttgggagccagtgtgccttggggaccattgtttttgccatatcaacctgaagtcttgatataggctccactcaccaagccttggtttcttgtcccaggtggtcttgggtcgcacctgtcctagtttgtcacatacagggtctgtgaacatatcactcgtgagctccacccagggcaactggagctgagggtgggcagatatgggaatgggacaatgatgagagatctgaagggacacacacagcaagagatgatctgtggaaaggtcctgagtagcatcaggaaggggcagctgtccacaggctaagccaacaagcttgtggcatgtcgttgtgtcatgtgcccctggagcttggacacaaggtgcctaaaaggtggcatctcccagagatgcctttttgttctgggtgttgggactcaggtaggggtagaagaatccagtgcagtgagaaggacagtgctgtgccccttggttcttgtcagagcagagcagatgccccagatttaagaacttttgcagctcaaggtgtcagccagaccaggaagccacttctaacctcactcgcattgttggggctcattttgtgtttttgtaggactgagttctccaggactgggtggctgtggcttagggtagcccctgagagtccctctgtggtctcagagccagaaactcggaggcaaactccatgctttggatccaacttctgaaagcacacatgagtagcataaacttagaactccagactcagtgtatgccccaaagtcctgacattctgggcatagttttggacctcagaactctgggaatacctcagaatttgaggtgctgctagattctgggcttggagaggcttctggggataggggatggagtcaggcagctgtgtgtgctagagagcagctgtactcagcctaagctgtagaaacctggtgggcatagggaccgctgaatcatactcctgtgcagtgtctcagtgctaatctcgtgcccatgctcccaatgggacaagaaataacattctcacccccagctctgctcattgccatgggacctcaccctggatcacaaaaggagatgacacgctgctgttacagccacatcactgagggaagacagctatcatcatagtgggtgagaactggagaagaagttacagatgctgttgctgtttagcgtagcctatagaagtctagcacacacaatagcaggacctccccccgcccctaaaaaattccaccttgctcgccttcctatagctcagctgatttggttcctcatagctgtgctgtctccactttccttctgggctgttttgtttagtttttcattttaaatatattttatttatttattgtatgtgttcatttgcacttgtgcacaggccacagcatgcttggggtggggggttggaggacaacttcaggaatctgttctctccgtccacagtgtagattctagggaatcaatgatgtttgtcaggcttggcaataggcacctttagtcactgaaatctctctcccaccctggaatgtgtcttgatgactgtacaaagggctcctggcactcaccttggagacagtgtcccctcattctgatgttaagaaagagtaaaccagtacatacttgtggtccccggtgagggaggttgagtctaaagaatcatgagtttgaggctagtctgagctacctagcccgggctagcctgagctaggctgagcttgttgcttagtagtagttgcctggctggggcaagtctcattagtggagaaggaggaggagggagagagccaggaaatggtaagttagccagaagtttaggagaacacttgagaaagtcctggggagggtcagaaattcattggctacatgaagaattagagactgggatatatgggactctgtctcaaaaacagaaaaataaataaatgaataaatgtttgactttgtacagctttccttctgtattctgtaggcacaggcttagccagctgaaaattgaacatgtttggaaaaactgggcatggtagcacatgccttcaattccagcactctggaggaggcagaggcaggtggatctctgtgagtttgaggctagcctggtctagagagtgagttccagggtggagtttagttagtagaatgcttgcctcacacacacttgggaagtagagacagggggaggaggattttaaggtcatctttagcaacttagcaaactggaagttagtctgcactacatgagagacagacaggcaggcaggcagacagacagacagaactaaacaaactaatacaaacctaagctgaccatcacagcccagctgaagtccagaagtttatcgaacctcctcaaccctgcctgcccgtctccatcgtatgacagccaccctgttcagtcttcagcattccttcccacaaggcctctgtgcctgggctttcctgatggtccagctctcagggaacaagaaatgatccaggctgcgattcaaggcacttcagaggctcttgggtccagagaatgttctcttccacctttctaagtccatgagagagagcaggagggatcctgctggtgctgcccacaccctggcctcctagctaggggaggtggcgagcagggacctgcccagaggaagggaagcagagaaggctgactcagcatctccagaggaagggggctggggcgctgccatggacctgggaagtcccttctctgccttccttgggggccactcccagcaaggtgggtggggagctgaggtctgaccactccatgccattggaaggagccccctcttcagcagcatcctcttcttccgaacccacatcatcagcacccaggatgagtgctggtttctggcatctaacaaaggagaccacctactcttgggaactggccactggcctaggcagttcctcctgggaagacagaaatggccaggttctggccaggttctctttttctgctatttgagaatggtcatgctttccattgtctctaagtctcctagttaactgcattcacagagtgaagattgtcttctttttggatggatagacagatgcccttaccctctttctgggagctatgaatgtggctcagtgggtagaatgaatgcctagcatctgtgaagtcctatgtttgatccctggcactgcagaggcagatggatctctgtgaatttgaggccagcctgatctacatagtgagctccaaaacagccagggctatgtagagaaaacttgtttccaaaaaaccacaagaggctgggcgatggtggcacacacctttaatcccagcacttgggaggcagaggcaggcggatttctgagttcgaggccagtctggtctacaaagtgagttccaggacagctagggctacacagagaaactctgtctcaaaaaacgaaaacaaacaaacaaacaaaaatagaggaggaagaggaggaggagaaggaagacgaggaggaaaggagtaaggtagggggaggggggacattgcccaggccaaaggaaaatcttgctttgccacaggtaggagagtcttggtgagtgtgggtgcagtgggcagtggggttcatgggtgctgaaagaaggagagctgaagtacttctggatgtgggtaacaggcagagagcagatgagcctgatgggacatgatgggacctctggttttagggtgactagccaaaagtgacaaggtacagcagtggctttccaccttggtctagtttcttcctctctactcagagcacctagccaggcccctcctctctgccatccttgagggcaaggagcacagatcccagtccactccatatggacgtgtctcagctctcaagccaggaccttggacagtgatttcttcatttcccaccaagtgtctgctctccccatactcagaagtgcctctgtggcccatctagtgccaccagggacacacagacagccatggtggtctgtacctagagaagaaagtgctgattccgcctgcaggcagggaggagggcatctctgagccagactaaccatggaggtcaggggcctggagaggagagacagctgctgagagtggaagcaatccccagcctacacagggctggacttcttatgaacgtggggcaaagagaggaaggataaaggagcaaagagcaggctctgtcatggtgtgcacagggatgcacgctgcacctaggccaggcatgtgatgatgtgtgacgcaggtctctggagtatttcaggagataagagaggccagctctatgggaagtagaccacaaggatggatgtgctggggacagccaaatctctgcatgtgagggttctacagtcacagacttagctccagaaaagtcctaagtgtttggaaaagccgtgtacagcaacacagacctgtaatcccaggatgctgagactacacagtgagaaccaggtcagccagtggtacataacaagaccttgtctcaaagaaaggaaagaggagagatgggtgttggaagccaggcccaggggctcgtgcctgtaactccagccagaggctcagaagatcaaggtcggcactggctacacagcaagtttgaagctagtctaggctacatgagaccctgtctcaaaaataagaaaaacaagggctggagagatgactcagcagttaaagatcgctaactgctcttccagaggtcctgagttcagttccaggcaaccacatggtggctcacaaccatctgtaatgggatctgatgccctcttctggtgtgtctgaagagagcaatggtgtactcatgtacataaaacaaataagtaaatctctttaaaaaaaataagaaaaacatgaaaatgaacatggtggggggagagggagagagagaaacactatttgggaaggttgctgcatgtgtactgaccgactgaccgtgtgtgggcttccggtgctggctttccctgcagtgtagtgtgacagtctgtggccttagaatccttgtcatctaggtttggcatggacagaaaggtgtgtggactatgtgcaaataccatgctacttaatacaaaagatccaaatgtctgctgtgagcgtgtgggtacgtgtgtgtgtgtgtaggccaaaagttgatgttggatgtcttccgtcactccccactttgattttcggtacagggtctgtcactgaacccagaactcccctggctgcctttgctccccacctcagtgctatggctgcagacatttgccaacctggtttttacatgggtgctaaggattgtatctcaggtcctcacactcacctggcaggcatttgaccaacaccttcctccccatcccctcctcacatgtttttttagaggacatttgcttctccccctcccccacgcctgagttggctagtgccccactccactgagacacctcagcagccatcctcatcctatgttctccgtcagtgtctgtatcctccaatgcctatagaggtcttagccacaagctgagggtcccaggaatgcaggtctggttcttacacaccgtgagtcatgacagtgtgacatgtggtctacatcctgggtacatggtcaacatgctgtctctaggtgcccttcctgtcggaagcagctccgggccgatcacatgcacatagcccagagtctgtccgtttccagagatggtctcaatcacctccttgtctttccaccaggtccttggctgtgggaccccagtactcctctctgagcactcagcccattctctgtgccagcatcccaggcctggtgcccaagcagctgcgcttctgcaggaactacgtggagatcatgcccagcgtggctgagggtgtcaaagcgggcatccaggagtgccagcaccagttccgaggcccggcgttggaactgcaccaccgtcagcaacagcctggccatctttggccctgttctggacaaaggtaccctggggtggttagggtcatctctatatggacatcataaggccttccaaactctaacctggctgggcttgctcctcccgaccaatggagggccttggagaagaaagggggaggggaagggaaccgtaagcccaccaggcgggcgggagaggcttggagtatgttggggaggtggttcaccagccagcacccctgggctggtttggaaaggagagaccggcaggagagctaggtgttagttagctgctggcaaagagcaaattatcctaaagtgtagtggttaaggcagtaattaccatgtgttgacctcctgctgccgggggtcaggggctgggttggctctgcttcccatccacagggagggaggtccatgggaggctgtctcagcaccagttgctagagagggctctgaagtggggcaaaggcttctttctgtggtctctgggacccaggtctgagacagagagggagacagagatagaggaggcagaatcagagaggcagagaaatagaagagagacaaagatggcagagactgggtgggggggagggggccgaaaggagagagaacacacaccaaatgaaagctttcatgccttgaacaagaagggaaaatcatataatttaaatcactttagaacatacaatctcagcacacttagcacacccacagaattgcgacactaccactcctaattccaaaatattttcatcctctcgaaaggaaatcccaaacccattatgcagtgcccctggcaaccactggtttgcttcctacccctgtggttttcttattctggacatttcctctctgtgtaattatgcactctgtggccctttgtagctggctcctttcactgagtgtgaggtttacaaagttcatctatgttgccacacatatcaatgcttcattccttttgatgactgaatactattccatttcagtgtgtgtgtgtgtgtgtgtgcacgtactcgtgtgcaccttaaattttacatgtcaaaaaaagaattttatatgtaaaagatgatgccatctgtggatttcatttcttttattggtatatgtttattgtattgggttttatgtatatcttcatacacatatagaatgtattttgacctgacttaattctgctgcccaggacatcagtcccctgtgggaccaaagtggagagagtgggtcaaaactctaagcagtggatgtccgtgtttcctgagtcacccagcctttgtgtttgctgcagaggtcaaaatacagcacctgtggctttgcaagcctggctaggaagcatggacactgaactgtccccaaggagaacagcattgtggagaagaggctggggctgggttcctgcagtggtcttcctgtgaccctgaaggtgtttaaattctttcttctggtgaggtcaaagcagatgacctcatgagcctttggggtggaagtaactctgttccctgcagtctgaccctcccctgactttcacttccagcagtccactgtcggcatggctccacccagtcccatcagcctccattcacaagccagctcttcacttcatataatgacatcatgccaccagtcctgaccctatggttcctctgaccccctttcacctaacgtcatgacccaccattgattgtccttcctggtggcattcaccagctcacttccaggggtgttagcgtccctatctataaaatgggaaagtaattgcagcttgcaacttgagagctgtgagtcaggctaattacacagttgctccccacagaacagcactgctgtatacaggggaggatcaagtccctaggccggtacagtttaccaagcatgccttatagtatgtgcacgggtggtccatcctgtgtcttcatgggaatgtgatgtgtgtacgtgcagcagtaaaaatgctagtgtgtacacatgttttcctacatgaccacatatgagcagcacacgtgtattctgttgctttttgtttttgtttttgtctatttgtgttttgttgctattacaatgtacctgatactaataatttgaagagggaagatcgattttggctcttggtttccgagggttcagcccatggttagaagacttcactgccttaggcaaggcagtcacaaggtaactggaatgtgttaccaaaggtttcttccttcactggaaccagaaagcacagaaagcaacaggaaggagccagaggtgaatatctttctaggacataccccaagcacgcttctaccttcttcccccatgagctccctgtctcttaatgataccacgatatcctcactctgtcaagtctgctcattagttccaagctcaggttccaatcacctcaacagtccttcccagacaacactccatttcaaaacatagcagcacgtgtggttatggtatgtacatacgtgtgcacacatggcttcagagtggggctgcactcacatgtgaatctgtgtgcacaggtgtgggaggagctgagagttctacatcttcatctgaaggctgtcagcagaatactcacttccaggcagctaggacaagggtcttaaatccacgcccacagtgacacacctactccaacaaggccggccatgccttctaatagtgtcactgcccaggccaagcatattcaaaccacgacagttgaggagcctttagagatcctgagaagctggcctttgaaggtttctgcctgaagtctgtgctgcagtgaacaagcctgactcccattaccacagacagagcccctccaacctcctgcttctctgtgattgactgaaatgagccaaacattacttctgttgggtattttatcacagcaattataactaatacatccacctccatgggggagtctgtgggagcatgcacacacaccacctccctcacaatgctaaagtgagtctctcacaggagcaaggagggcaccccatgattcgccaactatgtttagagctgaggaaggggcaggcttttatatcctgtcatgctaacagagcgggtagcgctcagtttctcctcttcaccagcactcggtattgttattttcttgcagctgtcttcatgggcgtgagcattttttcttgaatttatcagttatgtgtgccctttataaaaaaatctatctattcagttcttctattcatgttttaataaggttatttctatttagtttgagttttgattatttgtgttttccttaatcatagttttagtttctctctctctctctctctctctctctctctctctgtgtgtgtgtgtgtatgtgaatgcttatgtctgccttggtgaatatgtgaaagtcagacagtccgaatctggttctcttcctaacctgtggatcccagggattgaactcagatcgaattgggttcannnnnnnnnnnnnnnnnnnncaagcctccacaacatggagacaaaaacatgcagacatttaaagtatttttttatttttacttttaaaaaatgtaaaaattcttttagtgtatagcctgtgtatggtttagtgtacctgtgtgaaggtgcccttggaggccaaacagggtccagaccctccctgagctggagttactggcagttgtagctgtccagtatgggtgctgggaactggacttggtcctctgcgagagcagcccatctatcaactgctgactggtctctctagcctcctacaggagtctttaactttgatgacaagtccccaactctctctttggctttttagcgctaagaaaatctggctgaacccaaggtcacagatgtttgctcctccctgagccccccacgcccgagacagggtttttctgtgtagctctgtctgtcctagaactcactttgtagaccaggctggcgtcgaactcacaaagatccacctgcctctgcccctcgagtgatgggattaaagcggtgcaccaccatatcagctacagaaagcctgctttttctgtttcctcgaaagagtcttatagcttcaagccagaagtgatggcatgtggctctattcctactcagcagtcagaaacctgagctctatacatttgagaacaacctggtctatatcctggtctgtatggtgacttccagaccagtcagggctcagctcacagtgcttttacatcaaaaaaaaaaaaaaagaaaagtcctatagcttttaatctgacattaggtctatgattttgttttaatattttgattaaatttatattttgtgtgtatgggtgtttgcatacatgtatgtttatgtaccacatgcctggtgctcacagaggttagaagatcccctgggactggagttatatacagttgttgccatgtggctgctgaaaattgaacccaggtgctctgggagatcagccagtgtttttaacccctgaaccatctctccagccctgcttgatatatatatatatattatgttatttttatttgtggtatgagaatgggatccaacttcatctttttttcttttttaactttggcttgtttgtttcttttttcaaaataaagtttctttgtgaagacccggtcgtcctggaactcaccatgtagaccaggctggactccaacttaaaagagatccatctgcctctgccacgtgctggaatttaaagcttgtaccaccaccacccacctccaacttcattcttttttttattttcatttttatttttttctttttagtatagaatagagtttatttagggcatggggaggggagctaagagagtagtagaggcagagaaaggcggagagaaggagagagtagagaagtggaggccagccatgaccacgtggagagaggggggacaaggggacaagaggcaagagcataagcaagcaaagctccaacttcattctttactgtgttgaaatgcagttattcaaacagcgtttgttataaagagtattgttccttcttgaatggccttagctcactcattgaaaatcacctggctttgtatgtttgcattgatgaacatataggctgtttgctccattccactggtcactgagtattatcatagcagtgtcatgcagttttcctgtctatagctttgtcctgtgttttttttttaaactcaaagttgctttggtatctgaggccgtttatgtatgttatcatatgtatgttaggatccactggtaatgtccgtttttttagacttattatttttagtgtgtacgagtattttgcctacatgtgtgtatgtgtaccatgtgtgttcttggtgctcacagagatcaaaagagaacattggatctgctggaactagagttatagatagtggtgagctgccatgtggtactggaaactgaacccaggtcctctggaaaagcagccagtgctctcgattcctaaaccatctcttcagctcccagttggataaaatcttggagatcttagggactgtgtgggagaaggggggggggagaagaagggggaagaaggagaaggggaaggaagagggagaggaggaagaagaggaggaggaagatgaggaggaagggaaagaggaggaagagaaagaaaaggaggaggaagaggaggaagaggagggagaggagaaaggggagaggagaaggaggaagaggaagcaggagaaagaagagaggagaaggaggaagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacagccctactgcatcagtgacacttggcggctcccatctctgagtcttgtacattgttttctaaattgttcccgagcatttcttccattgttatctaccgtgacattcttttctttttaaaaattaattaattttatgtccctgagtgcttttgggcaccactgtcatgcctagtgccaaggagatcagaagaaggtgtcggttttcccggaactggagttacagatagttgtgaactgccacgtgggtgctgggaactgaacctgggtcctctccaggagcaactagtctctctcctgggataaccatctcttagccccatcttgcttttcttactctgtagaccaggctaacttctaactcacagagatcacctgcctctgtcatccaagtgctgggattaaaggagcacacaaggcttcctgctcatcattgttttatttccgttttgtattgtgtttggattgtttgttgctaggaggcagagatttgttgagctcaatgaggtgcagtacaattgaccagctgctccgtgacctggctgaagctattgataggctccaacaggttgtttgttgtctactattggttccttgggctgctctacgcatagggtgatctcacctcttcctcccatgctggatgctctttattcctttacttgatatccagggtgagagcatccatattttcccaaccttgaagtgactgctttctgccttccccatagacagtgatagctgtgggtccatccaggttttaattttgtagattcagaagtaagaaccctttactcgtgtataagtagataaaggatttttttaaaaaaatattttatttatttttattttgtgcatatgggtgttttgcctatatatacacctatgtgccacattcatgcagtgttcacagtgtccagaagagggcgttgagtccctggagctagcgttaaagatggttgtgagacaccatgtgggtgctgggaatagaacctggggcctctggaagagaggccagtgctctttaatggctgagacatcgctctagcccttaaagttagcagtgttttaaattttatttgttttacacacacacactcatgcactcacacatgtgcgcacacacatgattgtgtgcacatgtgtgaacatgtatgcaagtgtctatggagaccagaaaggatcattggatcctctggaactggagttacagatggtcatgaagagccatttgggtgttggatcttctacaagagaaatacacactcttactggctaagctatctttctagccctgagagtttgttttcaataatccattcttttgatcttttggaattataccaacattttaatgacaatctattatcaaaaggtttatagatggggcatagtggtatacatctttaatcccagtacttggaagtcagaaatagatggatctttgtgagttcgaggccagtctggtctacatagccatgtctccaaaataaaacaagttctccaaattcatgagcacacaactcaacttcattttatttatttgtttccttgcttagagatagcatcttactatgttgtcttggttcttattgaatgccccagttcaatgaatcctactgcctcaaccctctgagtagctgaggctacaggcatgggccacccattcattttcctttcttaagttccacggcaaacataactggaggtgagcagaatttcacaaggtgctgtaactagcggcaagcacctctttcttgatttctaggacaaattctctggggctaagcacattctagaaagatcgagaaatcgtccagaaccagagctgggacacgagaggctctccagtggatatgtatatgatggcaagcgctccatcccacgctgcagatgcacacaacctatgtgctttcagtcagcactctgctgggcagccccggtgctctagcctatgcattttgctctgtgaatgtgtcagatgactgaaagacaaggggctggtgcctgggaatatcttggaaggcttccttggggaagcggctccaaactctttgggcagacagtagtatggttgtggggagcccaggggtgagagaaaaaggagcaggggaaggcagtggggctcagcagtctgactaaactggagcctgaggcaccgtggaggaagagagaggatggctgtgcctgaggctagagccccgtcacataattttgggcgaggttaggggagctgcagaatgttgagggtctcccagtatgctcttgggcaaacacaggctgtctagggacaagcagctgccacaggtcctgccctagagagcagatagtcacatcagccttggggctgagggccgcgcctgcccacattcctctgcctacacccttgcctcctagaagccacctgcaggacagagagaacctaggctgtctggcctcagcatcccatccctctttcccatggcagcactggaggatttcctgccagacggcagcctgcacccctgcaactgtcctccctgcaaacatgacttaggcctctctcagtttgctgctcccttcttcactctgtcccctccggtccccaaaagccccatcctcctcctcctgcttatgctcccctcctcagtccttgttctccttctcttctggtggccaggggagaaaggagccctccgtgtgcccccagaaaggctggctccagaagtccttgtgccccccaccccctgctgcctgctggcctcgaagtaatcaatctgattggattagggtcagggcaaccctaatcatgtcaaaggttaccctaggctttgtggcaaggaccacaggggtgcctggccacccctgccgaggtggcctctgttgaacagagtttaacatctaccagccagctgggaggaagggagccagcctcttgcgtgcatgtgtgcatgtatgtgagcttgtgcagccatgtgttatagaaaagcgtgtgtgcatgtgttttatatatgcatgtgcgcatgaatgtcttacgtgggcctgcgcacttgtgaatatgaatgtgtttgtgcccatgttagtgaatatgtctgtccgaatgtgtgtcatgcatgggcatatttcagtgtgcatttgtgtggatgtgccttacgtgggtatgtgtgtaagtatatgactgcatgtgctgtgtatggatatgtggagatgtgtgcacgtgtcagtgcacatatacatttgtgcacctgtgtatgtactcacaggtattgattatatatgtatagatgtgtgaatggtagctacacacaaatgctcgtacatgtgtgctcaggtgtctgtctctgtgtgggtgtgaccatgtacacggtacaggcgtgtgtgcatatgtatatgcattgagcatgcatgtgtgaatgggtgcctgtgtgtatacaaggcaagtgtttgctcatatctaatcccaaaaccatctgccctgtgtcagcctaaaactcaggatgctaacctgagcgtgaggaagctctagcccttgaatgcagaacgaggtcctagagggctctgctcttgcacccaaaagtagcagggagcgacctacctacctactcgggatcagaaagcatttgaagaattttgagtacaggatgattgtgaaccgtttatatcccttgaggcaagcctcagacacttggaggcaggtactaggtgactcccctgtattgacctctggcaagatgaaatgggtggggtggttgcagggccagcctgggccagaggtaggggtcacaggacgaaggtcaataaaacagctggtcaggctggaaggggacaagtgggaggctcacaggattggggggtgggggcagagtccaggaagcaggttattaaacactatgtgtccttgtgaggggacagctttcttttggctgtgtgtgacatttgcatgtaagacataaaggcacatggtctggagcccacagccatggaaactggggtctctacctgcctgtgtacgggggtggctgtgcctggagtcctcagaagctcctagctggcttccctatgagggaggagcatcttctacccaccttgcaacactccaccccacttgggggtggtctccccaagtccctaaggactcctgggggctcactgcttgtacaggcaacctttattcactgcgaagtcttcatttgggccttgctggcctggacagtgtctccagccagagcatcttacctcgtgttgggtgtggtcccttcctccagcctgtgacatacctccaggccagccataccctcaacccatagtggctggactttgttgggtcccccaaacctctgccacaactattagcagagttggttgcttttgaacatcagactctcagtatctgctgaactcaccccaagccctacttggcttctgggcagggaacaacagcttggcctcttcccctcccccaggcaaaaccccttcctgatgactggcctcagcttcgtggctcctcagggggtggtcctccacctctctgtgtgctcagcctatggaaggatcgactccaatgagactagcctgcaagacagccggagcttaggggttccggagggacagaaagggcagctttttagggaagcagagtccccaaatccaggttgcgacccctgacccccccatccgaaagtgttaccatttacgatgcgttgggggtgggggggctcccctggctccgggggcctctccggtatatcattaactctccgctgtgggaggggggaccccggccgatatcccactgcgctcggctcggagcacaatgtccctgcgaggacgacaagattaagcacaagggaaaagtgaaaatgctgttggcgattcacacgcccttcggggtgttgaattaaagcgtctgaaagaggatttcccctcgcgcccgacggcgcggcgggcagcgcatacttccaggttgctatgactggccggcgatcgcctaatcaccggccagggggaaattcatataaaatatcgctggccattgtggggctaacgcggcgtgacagtgtcgcacaaagccggattcatcagccccagcaggtcagccaggcgcccggccgcgcgggcccgggcggtgtcaggggccgcggccacggtggggcaccggcgcattccgctctcaggtggctccggggccttttgtgcctccgtgtgattaccaaatgccaccgcgacaccccctcccggccgcccggctcctcgaggccaggaaaagggcctggggaaggagggacggtgggcagccttggaggggaggcgccagggcggggcctgggctgcaagctaccagctggggctgctcggttctctcgtctgccctctgcctgctgtgctgaacacgggtgggggaagggatgcccacccactgaatgtgttatggaagcactttcagacatcgggatgggaatgggatagatagatggtttgtctttcctcagcgtgacaggagagtgacactcccaagggaggtgatgccccatgacctgcaggctctggccagtctgagcaattatggctatgccatagttgggccttcttcccaccagtggtcggatagtgatctcccagttggagtctggaaattgagaggacagagaccatctggaggttgttgcctgacaaactcagcccaggctgccaaccctaagccttctgtggtctccaggagggtgtggtggatgtaatgtgcagacataggtaagggtgaaccttctgtctgctgggattccctggttctagtcctgtgcagggaagcttcaacagagatagagggtcctaaataaacgcatacatagcatatgatcctaaaggttcatgcaccaaactttggtgcacccaatttcaaaaataaataaataaataaataaataaaaatataaaannnnnnnnnnnnnnnnnnnnccaatttaaaaataataataataaaaatataaaaataaaaataaaaataaaaaggtactactggatttaaaggcacagattaacctcaactcattaatagtaggcaatttcaataagcccacacacacatgcacacacggacacgcacacagctcgtacctggttctggagagtagacaccttccatatgattcatttcacttctagttctgagcctagtgcctagctcattatggactctcatattctggataggtgatggacggatggacagatgaatggatgagtgggtggatggatgataaatgggtagtagatggataatgagtgcgtgatagatggacagtagacagataattgagtgggtggtattttggtggaggatgggcgtatgataaataatgaactagatgaagggaaaggaaggaagcccagatagtgatactttccttaaacccagtaagagcgcagcaaagctgagattgtttctgcagggggactttgctccccacctcccaggatctgggtgaagagacagtggcctcaattcataatcctcccacgtcagccttcctggtgctggaattacaggcctgagccatgacaccgtttttggaatttgcttcttttatagaacaacttcttcaggtagtttcttttctttatctttacctgtatctgataaatagacagtatctccagccctccaaaagctcttcttagctctgcccccagatgactggcccagatgggcaacactagtctgtaagagtcctgtgctcaggcacccaccccctcctcatttgatgatcaatagccatttgaagggtctgatgtcatgcacttgttttctggagggaggtgtgctcttggaagccctcacctttatgctggccatttctgctgagtcaacagaaactgaaaggtgctgtgtgtgccaggaactttgctgtggtgtgccccattcccattcactctctgcaaaagagatagctctgggagagtgcttcatagctctggtagagtggttcattcaccatggttgtcctaaaaccctatgggactctgatggaagcaaagggtttcctctctgagaaaatgtgtttgttcccaagatccacgttttgcctctgactcctgggtagacccaatcttgttggattaaaatccctgccatcctaggatgtcacctaaacattctggagcctttcctttctaggtctcctgcagacatgttctcagttattattaagtatcttaagtatagcgaagcattgcaggaatggtgtggaatctcaggtccctgtcttcctctccacacacacagccttgcacactgctgtggtacatggtaattgatcatgaaagccaacctgacttggataacccaggtctttgtgcctccatgtcccttgagttccaccatccttcccttttgtactgcccaaatcatcaccatttataggaaggaccttaatctggctttagcagctgcctccaattcatttaagtagagactatacatttttagcaagaaaacattgaaaacgatacaatctttcctaggaggtagatggtatctattcactgctaggaatgtgaactccactccttgcatagtgtgtgatggtgatatcttgggaggtggggttggggtggggaactgcttaagacttttggctgcagcttgcctccatccttcttttccaagcatgttccatttcacattcacctagccaaatgtgggtttgcagcccacagttcctcccctggcttctcagatggagtttctggactacttggactttcttacttctggcctttatttcttccccagcctgttgaaagccagctccagaacttgccctgccttgacttgatcgggagcccccacctcctcatttgacagtagaggaaactgaggttcaacagaaagggaggacttcccagcctgctggtgacagagctgagcaagaatgaactcttgcctacttcaagttctatgttgttctctccttctcccaaggacccttcccctcgagtgtgcctaccagctccaggctgtttgcgtgtgtcttgataagcagggagcctgaaggccttgttctgggcagggcaaggcctagagtgctgggcccccttatcttttggagccaagaaggatgggggaggagcgtttgggtgacacttgagctggataaggtaaccaaggctgccttgagacttggaatgtgagggtgtaggcagagaagtagacttctgagtcgcacccaagagaaggtagctcaaggcctctggccccagactcaggttctatgcagaaagaaagaagactggagtcttaggggcacgaggaggagtgccttggctccttcaaagatcaaataggggttagagatgtagctcagttggaagaatctttgcctggcatggacaaaatccccaggtttcatttccaacactacgcaaagctaggcgtggtagcacacagctgtaatgttaacacctggtggagttcaaggtccttctaggctacacagtaagctccaggcaagcttgggctgaagtccctgccaaaaagaaaacaagaaagaaaaaagaaaaatgacggctcgaaggggtagcctgtgctctggaatggaaataaacagtgaacaagatgcagatcccacccgtggggaggatctggactggaagtggattccagaagacaagtcttcccgaggaataggcacagctgacatgttgggtagatagtgcccaggaccttggctgccatgctacagagtgaagctggtaacactgaggctggggtagagcttgagcccagggaagaatgaaggctgagtgtgaccagaggccagtgagtgctgagaagaggaggaagacaaggctggcggcaggaaacctttagagaactttaggaaggctgtgtatcacactggctctgggcacggagctgggcctgcagtgggtggctgtgtgcttggccagtggaggctactgaatactgggtgacagttcaattgagagcttctctgtggttctggtagttccttgtccatcgtaatgtgggaagagtgggaagcagctggactcctagatacctgcagaagttgtccaggctctgacagtgccccaggttgcgggcagaacagctggagtctgctcagagatgagagtaaatgtgtgttctttgattctatgtgtggacgctgactgaactttgtgggtcagtctgagtgtgagtgtagttgtttgcagtttctctgtccctgtttgggctttgggacacacagagtcccgagagtctaacctcttagatgcagcttgaggaaatatggaaagctagtgtgtgcaggaggggtgaagaggccacaactttttatgaaaagtctcacaatcccaagagggtcacccggcccaagaaatcctgcgcaggcaggcctgcgaggctttctgtctggaatggtttctagccgggtgtgtaaaatctctgctagtcaacaagtcagatttgtatccatcttactcagaacaccgtgcttatcatacagcaagcacttggcacacctttatctggtgtcaagtagacgagggagtgtcttctcttaggaagaaactcctatgcacaattggtgtgtgtgtggtggggggtgtgaatcaatgcaaccactatagaaatgtttgtggattcttaaaaaatgaaaaatggaactaccacaagactctatttcacttctggacctatatccagagaactctatactctatcataaggatatttgtacctccgtgtataatgctgctttattcactatagcaaagaattggaattaacctagttgtccattagcagatgaatcgatagtgaacattttgcatatatataaaaatggatactattcatctcttgatttattttttgctgccttttgtagtcaatattatatttcgttatcacaatattatcatttcaagatccgtccacatgatttgccctctcaatctgaggcccctggtctagacctacagtggatgcctactgccgggaataatgcaaagtctggactgttgtttttcctgtttatgcagaccggtgataaaatatcagatatgttagacacagtcagatttaatgaccaatctccaaacagaacagttacagtacagctgtggtannnnnnnnnnnnnnnnnnnnctagtctacttggcttgcagcaagctaggtagttctgggaccttaatgtagtcctccttgggactctccaggaagacagaagggatagagtgaatcactctccatacaaaaaggatttagtagagtggcttacaagctgtgatctggatagtacaatggctgtcttccaacagaaagctcaagaatccggtgttgtccatagactggatgtctcagcagctcttcagtatacactggaatcccaagaaatgggctctaaactcagtgaaggaataaacttaccagggagagtgagggcaagcaggccaaaagcagaggtgcttccatgtcctttgcataggctgtcaccagcaggcatggcccagatttagggtaggttttctgacctcaaatgatccaatcaagaaaaatccctctcagtgtgtgctttgcacaccgttgatcccatcgctcaggaggcagagacaggcagatctctgtgtgacctaaggtagcttggtctacatagtgagttgcaggccagccagggctatgtaaaggctctgtcttaaagcaaaaaagccagacaatgttgacacacacctttaattcgagcacttgggaggcagagacaggcagatctctgagttcaaggacaaccagagctacatagagaaaccctgactcaaaacaaaaacaaacaaatccctcacagacataccctgcaggttcccctttaattaactctagatatactcaagttgacaaccaagaatagctgtcctggttggacttgaactcaaagcaatcctcttgcctcagttttccacatgcaggtattacaggtgtgtaacataagttctggtttaaaaatctctcgttaccttaatttttaatgtttatttatagatctaattttatgtcaaagatctaattttccttttgttgttctgagatggggtatcatgtagcacaggttagccttgagctgtctcaagctaaagatgaacctgaagctctgctcttcagcttccacctctggagtgatgggatttcattataggccttcacaagctcacttcaggcagggctggggtttgatctctattcctttggcatgtctctacccattgagccatatccctagcacactcattttatttgtttttttgagacagcctcatgtagcccaagctggcctctatgaccttgaattttttatcttcccgcttcctcctccctgatgctggaattacagagtgtacagctatgccccagttcatgtgctgccagggatgtgaacacagggctccattcatgccaggcaagcacgctagcagctgagctgcacccaaggccctacttctgttagcataattgtaagtatttttaaggtgctgtgcaatatttcagtataggattatgttttttaaatgacccaataagggttcttaacatgtccatcaagaacattcaaaatccttttcaagtgatttttaaaaatacgatcacttgtccactgtcctcacatgactgttcagtggcacaccaagaccccttaaccatcatctgaaattcagacccactgatcatcttccctccaccaccgtcccaggccctgcctccgtaagtaacccattccacttcctgctaggaacggagtgcttttagattccacacctgaattagaacatgaagttcttgtcttcctgtgcctggctcattcacttatgtcctctgggtctgtcaatcctgctgcaagtgacagggtctcattcttttgtagtgtagccttggctgccctggaactcactctggagaccaggctggcctcaaactcagaaatccacctacctctgcctcccaagtgctggaattaaaggcatgcaccaccactgcctggctagggtctcgttcttatttatgactaaataacatttcgctgtgcacactacagagctatcgtaacaaagcacatacatacagtgctggcataaagggacacacacaagctgacgactcaggacagcagttcgagagctaactccacatagtcccgcccaattgttttttcagcaaaaggtatgaacgtacattggagaaaaaagtctctctgacgaatggagctgggaaattggatatctctatctacgtaagaacaaattcagtccctcctgtttcctatgcacaaaacccaactccgtgtaagacctgaaactactgggacaaaaagcataggcctgggcatggtgatgatgcctttgatcccttttgtgagttcgaggccaggctggtctgcatagagcatcccaggccagcttgagagatagaatgattccctacctcaataacaacaacaacaacagcaacaacaacacacacacacacacacacacacacacacacacacacacacacacacacacacacactcactcactcacttaggaaaaacacttgggtcatttgggtcaatattcttcataaaagatcctcagaagagcagtggtgagaccctgtgagcactgagttctcctctcttggccctggttttggattcctgccttttggactacaaccctcctcacctggcctccataaccccctatctccttcctctgcagccacccgggagtcagcctttgtccatgccatcgcctccgctggagtagctttcgcagtgacacgctcctgtgcagagggatcagctgctatctgtgggtgcagcagccgcctccagggctccccaggcgagggctggaagtggggcggctgtagtgaggacattgaatttggaggaatggtctctcgggagtttgccgatgccagggagaaccggccggatgcccgctctgccatgaaccgtcacaacaatgaggctgggcgccaggtatgtgcacagaagcccagggctgtagagcaagggctgctttttcaccgggatgtccagtggggcaggacaaggggtagaggggaggtgctcttggtgaccaggctgctctgcttgccttctatcaagggacattgtgcccagctgtacctcaagtgtccagtgtgctcccagagaatgccagactcacctgtggacatagggttcctggaagtagacaggtggcagaagtagctgcagagcacatagtctctgaggattccgcgatgaggagatgtccatgagaggacaagacgtgaagggaggagaagagggatggagggcagacacgtatagtaggtacagattgaactgagatagagggttagagtgatagagatgattgatacaggctactgaaacagacgagagggtgagagaggggaggggaggggagagagaggcagacagacagacagacagacagagagagaggagagagacagagacagacaaatagagagatagagagatacagagagatagaaagagacagtcaggcagacagagagagagagaagggagacagagatagacagaaagacagagacagacacagagagacagacaaagatataggaagacagagagagaggagggagagagacagagacagaaagacagacagagaaaggcagacagagagacactcacagagagagattatcacaaggatctggaaatacagaagggagccatgctaacagaacactgttgaaggttccctccctctgaccaggttatacctggatctcaggagctaacactgggatttcaggagaagcaaaggtctgaactttcatgcacagacagtgttttaccacagcagctcatcttcaaatacgcttagcctccctcacccagagagccctgcttcccttctctgagagtccagataggtagtgctcagcagcatagcagagccaagaactgagtaatgggctggagagcgacctcgaaccactcaggaatgcatatcatcaggtgtcaggtatggagagaaacagagctgactgtgggggtcaaaacagagagacttcttcacagtgtattttaaaggcattttaagctaggtatgatggtgcaggcctgtaatccggacgcacaacaaaggcagggcaggaggatgagaagttcaaagtcaacctcactatgtgtttgaagccagtctcatacttaagacctagtctcaaaaataaagaagagaaagaaaaggaaagaaaaggaaaggaaaggaaaggaaaggaaaggaaaggaaagnnnnnnnnnnnnnnnnnnnngaaaggaaaggaaaggaaaggaaaggaaagatactgtagccaggcacctgcctatctttctctgtagcagacattcagagatgtgcttttctgaggacaaactgtcacagtgaaacttacttccatacataacgaacttcagacctttgacctcttcctaaagcccaacactagctcaaaggctctgacccttcagacaaagaacaggatactctctctggaaaacccagctcttccagcatgaacagaggggtgcctagaacagggatcactttacagtgagtgtgttgggagtgacaactgcctcccacctgcaggaatttccagaaagcaatgtggggtgcaggggtagtggtgcaagtctttaatcttagcactccagaggcagactagtggttttctgggttcaaggccagcctggcctatctagagagttctaggacagccaggatctctgaatttgagtctagcctggtctacagaatgagttccaggacagctgggcacaaatttaataatgtaaatacataataacaacatttcatcaggagttttgaagggtatgttcacgagagacaagggaggacatgaggagaaaggcaaagacataaggcaggagctttcctagaactgatgttttagaccacacaggccggactgcaaggatggggatagagagagagatgacttgggtcaagagctcttgatgtgctttttagaggaacagcatttggttctcagcatctacaccaagggactcataactgattgtaactccagctcctgctaccttctggcacatgcacacacatggcagcaccttaacacacacacacacacacataaaacatttttaatctacaaaaatagggaagccatcttccccaagatgtattatgaaattcagagcacaacctaaagaaaccctccaaccttcaaagagaccacttgatgtccctgcaaaggttgagggtgggaggaggagagcaacaagagcatcattggaagctagaagaaatttgagcaacactttgggattccgagtgataaaacgattttaatccaagaattttattcccagccagagtatgaaagatttgcttttctactacattagaaaaggtttgactttagacagtatcatttcccaaggtttaccaggtggctgtgagtacgtaggggtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttctctgtatagccctggctgtcctggaactcactctgtagaccaggctggcctcgaactcataaatctgcctgcctctgcctcccaagtgctgggattaaaggcgtgcgccaccaccgccctgcaaaagttgcttttcttatttgaccatggacttcctgtgataggacacgggtaactagcttagtggtagatctttacccactgagccaccttaccatccctttaaaatttttttttcttttttgagacaaggtttcatgtcttccaagctgacttgaattttcaatgtagccatcttccaacctcttgcttccacctcccaagtgctgggactgcagacatgtactaccacttttagcttatgagatgctggggatccagtccaggcctccatgcccagcacgcagggaccccatcaactgagcttcatctccaaccctggcgattggacatcttaaagattggattgcttagagaggagaaaatacagggctgacccataacgagtgtgttaatcacataacagaaagttgtatgggaaaggaaatgtcaccttagagtaagcctgctaacacagccagaaccgtgggcagtgagtactgaagggagagatcacgctactgttttcagggcgggaacggggagggtttggctgtatagtgggaggtaagagggcgtaataattttcacacttcatggtaagaaagcaacagaaaatacctcccattcaaaaatcaagacacagcaagacaagtgctgtgacagcccgcataccacaaggcacttccttgcgtggtcaggaaacacaccacacaggcaagcaccggccccatccctgttttaacagcaggtctcagtggctattgagattcttgaccaagtaaaacaaaaccaagagagactgaaaaaggagagatggcaagagtctcctctcagaaagcctggctgcaagagagagggatgtgggcgctggactagctggataagccaggcatggtgttattcttccatgcccatgggccagtttgataggcaggaagggtaaagaagcagtggaaagtcaggtgaggtgcaagcagggccgaagccagaatgatcagagcattaagcccatgctgtccaatatgaatccttgcaagccacaacctgagctgcttggatagttactagctctcaggtagttatagtgaaaggatagctagagctggacggtggtggcacttgcctttcatcccagcactctgagacagaggcaggtggatctcagtgagttagaggccagtggtctacaaagttctgagacagccagggctgttacacagggagaccctgtcttgaaaaacaaaacaacaaaaaagaatacactgagagtttggagagatggctcagtggttaagagcactgactgatcttccagaggtcctgagttcaattcccagcaaccacatggtggctcacaaccatctgtaatgggatctgatgcctacttctggtgtgtctgaagtcagctacagtgaactcatatacatagaataaaaaaaatctttttaaaaaaagaatacacagttaaaatacacttggagtcctttgaaaggcagtcttacggtgtagctcagactggcctccagccctcagtaccccagccttagcatctccagtgccactgtgattgttcatagtcatgctcctccagcacgctgggctggctttgatctttcatcactctctcctccttctgtccattttatgacaaatgacctgtcaccatagggaaggcagtggccagtgacacgtggatataacccatgtctcagactcatggtagttttacagagcaggtgggaagcaggcaaggtccttgagaaggaagcttctagcaacctaatagtttcctgcctcggtttaaaatgttttagctgtcatggtaatggaacagacttactgggtaaaatgagaccttcaatatgtgaacataatgcactgtggccaagcaggctaggaagcatccttatcgcctgaaaaatcatttcaactaggcatgatgatgcttatctgccattccagcacttggaggcacagacaggagaactgccacaagttcaaggctagcctgggctatgtcactgagttccagaccatccaggggctacatagtgagaacctgtctcaaaatgaatttttttttctgtttgaatgttcaaaacctactcgtcattttgaagcagtactttgtctactgtggtggacgctttgtgctatagaataccaacagatatctattcctcccttccaatgatgacctcttcaagctcctactacttcttagcattgccacacttgggacccagcatccagcatgagaaccttggccacagccagatctaaacaatagctaaccccatggccagcttgttatttcagtagtgcagtggatgttgaaattatgaatgcagtatcctgcatgtgtttcctactttggggcttaaaagactcagtgtgtgctttgcacataacggtgcttgttggaatgtaagaggaaagacaccaggagctgtccagagcagatgcttacagcctgggcaggaaggctacatgtctggagcagaggaactgggatggtccctgtggtggagggggcttggaatctgagggcaatggacaaggcccccttgtccccacgcatttccctacagaaaaggaggtaggagtccctacttcttgaaacacctatttccttccctgtaaagggagcaaggtctacattgttcatagggaaagctgctgtccatcccggccctgtgagtatagggagcactctaagcagcccagctcagtcttcacaccgtagcatctgctctccacattgtccctccagcatccccaacctgaagctccttgcttcctgtactccgtcctagacactcctgcaaagagaattagctagacccacagggagaaagcagctcccaggctcctgagggcttggatctggcagagaagacccaggtcaccatagagaagatagtagcactaggtgaccaaagagaggagtctgggggcgggggcttatggagaaggtgggctgcagagagcagaccccctggttgagccgcgctagggaccagtgcagacacacttctgtgcttgcctcctcaggccatcgccagtcacatgcacctcaagtgcaaatgccacgggctatctggcagctgtgaagtgaagacctgctggtggtcgcagccggacttccgcaccatcggggatttcctcaaggacaagtatgacagcgcctcggagatggtggtagagaaacaccgagagtctcgtggctgggtggagaccctgaggccacgttacacgtacttcaaggtgccgacagagcgcgacctggtctactacgaggcctcacccaacttctgcgagcctaaccccgaaaccggctccttcgggacgcgtgaccgcacctgcaatgtgagctcgcatggcatagatgggtgcgacctgttgtgctgcgggcgcgggcataacgcgcgcactgagcgacggagggagaaatgccactgtgttttccattggtgctgctacgtcagctgccaggagtgcacacgtgtctatgacgtgcacacctgcaagtaggagagctcctaacacgggagcagggttcattccgaggggcaaggttcctacctgggggcggggttcctacttggaggggtctcttacttggggactcggttcttactagagggcggagatcctacctgtgagggtctcatacctaaggacccggtttctgccttcagcctgggctcctatttgggatctgggttcctttttaggggagaagctcctgtctgggatacgggtttctgcccgagggtggggctccacttggggatggaattccaatttgggccggaagtcctacctcaatggcttggactcctctcttgacccgacagggctcaaatggagacaggtaagctactccctcaactaggtggggttcgtgtggatgggtgggaggggagagattagggtccctcctcccagaggcactgctctatctagatacatgagagggtgcttcagggtgggccctatttgggcttgaggatccagtgggggcggggcttcaccccgactgggtggaacttttggagatccccttccactggggcaaggcttcactgaagactcatgggatggagctccacggaaggaggagttcctgagcgagcctgggctctgagcaggccatccagctcccatctggcccctttccagtcctggtgtaaggttcaacctgcaagcctcatctgcacagagcaggatctcctggcagaatgaggcatggagaagaactcaggggtgataccaagacctaacaaaccccgtgcctgggtacctcttttaaagctctgcaccccttctgcaagggctttcctagtctccttggcagagctttcctgaggaagatttgcagtcccccagagttcaagtgaacacccatagaacagaacagactctatcctgagtagagagggttctctaggaacctctatgggggctgctaggaaggatcctgggcatgacaccctcctacgatagcctgcatccgctctgacacttaatactcagatctcccgggaaacccagctcatccggtccgtgatgtccatgccccaaatgcctcagagatgttgcctcactttgagttgtatgaacttcggagacatggggacacagtcaagccgcagagccagggttgtttcaggacccatctgattccccagagcctgctgttgaggcaatggtcaccagatccgttggccaccagcctgtcccgagcttctctagtgtctgtctggcctggaagtgaggtgctacatacaggtcatctgccacaagagcttcctgattgctaccactgtgaaccgtccctcccccctccagacaggggaggggatgtggccatacaggagtgtgcctggagagcgcggaaagaggaagagaggctgcaaatgcgtggtgactgactgtcttctgcctggaactttgcgttcgcgcttgtaactttattttcaatgctgctatatccacccaccactggatttagacaaaagtgattttcttttttttttcttttctttctatgaaagaaattattttagtttatagtatgtttgtttcaaataatggggaaagtaaaaagagagaaaaaaataagtttgtggtttgttctagattttcccttttattaacaagcattaggtgtgcatactaatggagtttggtatggaattcttcgatgatcctccccacccccaagggtaattcacacctccctgtcccttatcacttgtgggtctgcactatgctgagaacctaaacatgccaactcaggttcagggtcccagagccaagtagagactgtcgacaagcctccagggagggaggtggggtcagaattccaagaaaagagaattgaaatagctaagtcaagaaaagagccggtcaactgtagaaaaatctggaacagggtagatctgagagcttgaatagaggggtgcaggtgggttaagtttaagcaagtatgggagcggggtaagcatacagtagttaggatactttggtagttccagtgaacagatgaaaagtcacaggagaagaggcttaaccaagaccccctcacacgctggggatgcagaggagacgtggagcagatcgcctccctgtgacttcatgttctcacagcccattccccagaatcatgtatttagggtggacagcccttggtatttgaggacagtggcctggcttgctgctgctggcttcttatgtgtaaagtcaacagatcttagactttagtcctcagaccctgtcaccaggaatgtttcagattctcacccaaagaaagcaatgggagggaggggtctttgcctcaggagctgccatgttcccacttgctttcacaggggcgccagggcctcagtcaagacaggcaaggctaatcatcctgttggcaaaccaaatgatggggcaggtgtcagggcgccctgggagtgaggctagagatctctcacaaagccatacttcttttaaggccacacatctgcccaagcaagcctaccatgtctctgctcctctccctggtcccccatctccatccccatactgtccccacctctgagtcctattctgatgtccagatgtcagggcaaaggatgccctgcaaagctgagagcagcagtcccagtcctacctctcaaaacccaagctgaagccgagtatagcagtgcacgcctttaatcccagcactcgggaggcagaggcaggtggatctctgagttacaggacagcctggtctacagagtgagttccaggacagccagggctacacagagaaaccttgtcttgaaaaaccccaagaaataaaaaaattaaaattaaaattaaaaaaaaacagggggaaaaaagcccaagttgagcacagtcattgttcttgtgtcccatttatatcccaacccagatccaagtgatttgaaagccagttagaagatggccataagaataagcctaggaagtgtcttatgatgtccaaggtcctttagctgtcgtgatacatcatgacctcatgaaccttagaactaggaaaccctgctggcctctagaggaccaagggaaaggatctgaaatatagtcactgttgacataggggaatgctggttaggacaaccaggaagatcattaagtgtcctctcaaccctcccaggggacagtgggactgcctgtcccagaagaggggaagataattcccagaccctaagagctgggaagagaggcagtgaagtgagaggagaaacaggcaaggcccttctagacccatttgattcaacactgtagagttggtcggtgatgacagctaaagccgaggctgctgtccacatgccctgtgaatttgtccacaggcctggtaacagaatactatgtcacactgcctgaaactctgaatgccacttgtcagagcaggctgccactggttttatggcaggaccacttaagggggtccttaaaccttcaaagcaatcacaagcaggcctaagaccatactagactcacctgtatccttaaagaagaatattgaggagcctccaggtcttgggacataaagatgagaccaggcatggctccactgcatgctccaggcacatcttttgttcaccaacccactggctaagctttctgatcttccagaacacagattcaacctgtagctgctgatccatggtctgagtcagctcagtctaccacactaagattctagaccctccgtggtcacactgtcatacctaaacaccaatgtgcccagagtccaagtagggtacaaaaggaatagccagcctggcttgaaggtattggcctataatccaagctgccccagaagctaaggcagaaggaccacaaactcatgattgcctgggatacagaacaaggtgaagatcagctaaagcgattgagtgagaccctgtcaccaaatgaaaagtgataaagaactggggtgtacctcagtgacagaggactttcctaatgtgtgaggctctggactccaccaaagcactgaaaagaaaagaaaaaaaaaaatcacagactgtgagggatgctgacagctaagtggccttgggaaaggagtgccatcctggggctctctggcctctggccaggtctgtttggggtttgtggaggaagaggcccaggttctggattctcagtacctcttctttagccttctgattccctgactcctggcaggcaggcaggcactccaatgacatctatgccttcacacggctccctcttctcattctcagggctgcaggtgtatgtacaccaggccctgacctactattggcaggactacctaggatttcccagtaagggcaagggtcagtgggggggtagggagggcaactagctgcaggtggacactccaaaaagaggatgccatggtccagggccagccaaggcagaaggatgggcgcccattctcccctcagggcagtgaatcatcaggtgagtgggcaggttcaggaagagtccaattagcccgctgggccatcttgggtgctaacaataatagagccatcagtccctagggcagtgatgagagtcctcagttaagcctgtccgacagatgagtagtccctctaagttggcaccctgggcaggagccaccctaattgctacctgctgccctagtgcccagatgaaagggacagactcgactgggaggcggcagggcagtggcaaaaccagcatgtcacgagggcctggaaagtcagaggccaatgggtatggggtgccaggctgtctcaagaccccagtagggtctaatgtcacatggcttttggggatgcagagcccatatgcccaggcagaagacagatcactttagaaggtcaaaggctaggaagcatatagcctacagaggaggcagcattggcctgagggcttgtcagggacacaggtgggctctggtgtctggtgtcagtttctgagcagcagcccctacaagtccaggatgaaagactaccctagagattgtcttggctatccacaggagatacacgactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccccccagtccgaggagtgggaaatcccaggccccactcagacccaagctcgcagctgtgggcctcagaagcagcctctctggtgagtttacagcccctcccgctgccctggagaaggaggaaatgagcgggaggcctgttcacaggtagttgagacagcccccgaataaccatataaaagggccggaggctgggggccccacccagccaggacaggcttggccatccccttgcaaatctcacactcagtagctttgaagtactggaaagggtgtggccaacccccaccttagggccccactgaccctccctttttctgtcaccccctcccctggatgcccactttctgggtcctggggctcagtttcctctcttcagagacagactggaggctgtcaccatggcctggcctccaggaaaacctactcttggtcagctggggtgcagccagctgtggttcccacccctggcttgggactgagaaaatggacctgaggactagctttccatgatgtgggcaagtgtatgaccagaagccagagtccccagcccaagcagtcttggtagtaggatctagcactgccttttccagggaacactggggacaacagggcagccaggagacaattttgagaagtccctaggaccttcctgaaagctgaccacccactgttggggtgagagaaaactatgatgttctgttgctgtgtagctggtgatcaatagctgggccaactctgagtcctagcaaacctggcccagccataatgatctaccttgaagggactttgggatacattactgccctggagtccagcgagcgtcctgggacagattcttctccccctggctttaccctgcaccatgccacaggccccaggtcccacctctcttcaccagtcgctcaccttccacagcctagtcctttcaggggttcccaaatttcttttcagaaactctcttggaggggggggtacccagaacaacacactctgagattatagccttttaggatcatcatcctctctaaggacctctgacttccagagccagagtagaaaccaggtatacacacttactatccctacagccctaaggggccagcgtgccatcctactggagtctagtattggacagatatatgagtctgggatagtccagttggctagagtctttcatagatttgaattgaactgtactctcaatgctactcttgggctatgtgggaaggcttccaacaaggtgctgcttctgccttctgatgtttgttaattctgagataccatacagatgccaagacaaatagtgcagggcagctaggaagccctggaaagggcccccaactccaggagcttgggcactgcctacccttcctaccctgccctgctttgcctggtcgggcagctgggacggagctgcaagctgtcagaaggtgctaattgttgtttagctctaagccggctccttgctctggtcttttttccaccctctctctcttttttatttgagcgtctagaactcatggtaaatagtcatttggctctcagagccctgcaaattggtgtttatggtgtgaagatgaggaggacccaggactagtccaccaaaacacaggccagtgaagagggaggagagagggaaggaggcataggcccagctgggactgggcatcctccacgtcccatccaggcctagctctctgctgcttgatccaggagagcttccaggaagaggctcctccgtcatccttatcagtggggagactggagattgaagaactagagcaggacccatatttagcataggagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggaaggaaggaagaaagggaggtgaatggggagggagggagggagagaaagagagagacagaaaaatccaagtacatgggcccttcttacccagtggcctcccagatttgagacaggaatgtatggcttctgtatgatgcttgtggggtgcagggtgtggaaggcaggtgccagaggaattccaagcccgagcagatggctgggagggcttctcaggagaaggggacttccccagttgttcgcctctcagtgcagagagcaggcaggcctgtgcagaaccctcagactccttggcagtggtggctcagcagcctcccttccccatcccccaggctcctcagctccctctactgcaggaagcccagggtgttcccacagcctcactctgtcccttctccattcctggcacaagcttgagacactctgccaccccacagtgccagactttataaagcaagctggcttctaagcagcccaccagacacacagccctggaggggcgagtcccaaagctctaagaaggccatttgacgtctgtagcttggagtagactccagggattacacatgcttcttccccgactgtttttattgtccaggtctgggttggggcaataaagtgaagtgccagcttgcacctcggggaccagggactaatctggtgggagtcgtgacccaggcaacagtccatatgccatggacctgatcctacacctcctctgcttaaggatattccatggtttccctgtgtccaccaggtgaagtttaacttctcaagcctacgtacctggcaatctatccccttaaaagagtcctgatgtatggcgtgagagactgagaaactgtcctgcacaggaggtgtatacggacattactcttcagactgcaacggacgcccgcctctatcactcattccctcagatgctctcggacctccatgccagccttctcaccagttctaaaagaagtctctctcgggtctctagccttctctctcccaggtcctgaactttcaatgggttcttctgactctggaactggttgcaattccttgaccttctctggtcacattcaggagcccccatcactgtctctggggggacactggaagtaccagcttgacctcagggacctgtatggcaataaagggggggaggggattctgatgtcagtgtaaccttgatcattcctggggcttggaagcatacccagctgaaccaagagcttgagcttccaagtgacccatcaaccagaggaccccacacctgtgagagcagggagggcggcctcagaaccgaggccttgtctggtccttgctgttgtatgatgggaggttgtttgacagatgcaatggatgaaccatgcagaatccaagcatgacagggatgaggccacagcgcaggtggcgaagggccatgtgaggtctgggaaggtggaaaggatgcaggagaggaccttacaggggaggaggatgccagtggagatggttcaggagaggacctcgtgggcgggcctgaggagacagtgcagatgaggtgtcagtaaggaggatgcaagcaagaaagatgcaggagatgatggagaagctgaagaaggcactgaagaaggcacagggaagaagagtgcatgttaggatgttcaagcagagacggtgcagtggtgagggtgaaggtggaggagattcagatgaggatggtacaggtgggatcctgcatatgctatcaggcaggtggcccagaacaatgagcctggccatggtctatgagggacgcacacactgggaatggtacctacaaggttctgaaagtgcaggcttttggagaccaccctccccccaaagaaaggggtttctaccccttctccagttcttcccttgtgctttaaccaaaagcaagtcttgtgcactgtgcccaaccaaccctgcactctgctgaacctgaggcaagagtagaaaggctgctgtcttttctaacctgtaccctgagccaactaggtcagagtcagaggcctcacatacgtgagtagccctggttggagggatctctaaaccccaccacagtcctgggacagcctgctgtttcctggggtcaggggtcttccatgggcccactgccgtcctagtcagctttgcttctgttacttggggattttttccagtctttcccttccgtttagaaatccttttcaggacagatccctgacagaggtgctgacatcattaggcctcctcaagggcacaggcccacccttctgctctggctacccctatccctaacccacagcccagctctgccagggtccaggcctggctggcagcccgcagactacccagaccaatgtgttggctctaggcaggcaggcatcctgaagggtctaacagtgtcctttgccaactctccactgaagccgatgctggcctgtgcctttccctctgcctcttatcttctttccctcgctgccaccacactcaggaatcatgggaccctctggtctttgagctacagctctgtgcaggtagcacagcctcctccttcccttccctccctcatacatgtggctgtcgacccctgtctctgcaataagctctgggtgcctctgactacgcctctgacagtcctaactagtgtgggctggaacacagtggccaacatatgtaaatgctggaaacccctctcataatagagatggcaggtgtggagctccgttgagcctgaaggtagagggcagagtagtgatggtctacgggccacatctggtccctaatggtgggagtcaggacctgcctggtttcctcagagccagagtgggaatacagaggcatctggtatcttaggtcaagggatttctccagcccttacaatgtgagcaggatgttgctgtcaaggctactggacagctccaggctctggagaccacctgaggagatatggacgggccagcccctggcacagtccagattttaccacggacccagcctggggcacaggtgttaggggtggggctcatgttggcgggagtgctggctgcggatgcttcagctgggctttttaattaacctctgctggctgctccaaagggccccaattaagtgcagaatgcgatggcagagtggggtcaaagagaggagctggttttaattaaagtgcagtggcctgggcaggagcgcccccgcctgaccgcctcctcaacaggccctgctcagctcaaaggcggtcacatgacgggtagatgacagagaactctgcagtcctgtctggctgagatcccaccagataacagcaggaccaagggctgccttgtctagcctgtgtgtccactgccaggcagcccctcttcgagccactttgtcctctctgacctcttctcatttgtcacctgacctggaatagccatctgctaccctctcaataagcaggtccctggtataataagcatctgtggtatgtctacttcagaagcagcaaaaggaataaaacaaacaattccatcagatgtgcatgggcaatgggattaagcaaaatggggggggggcgggggagggggaaggccagtggagagctgtttaacctggtaaaggagcagatagcagcaggaaggggagggagctcacctggagaggtaagggcctggtaaaagccagagcaggatctggccagggctgagttgctgaggtaccagcaaggccaaagcctgcaagcaaaaataagagagaaagccaggcttttctccaaatggccagaagactactgaggactctcaacataattagctttccaggaaatgtaatgaaaaaccctgggcgagggccggtgagctaccaccaagcccggaacccacacagtaaaagacacagctgacttctgcacacacacaaatgcttgtataagcatatacttatacacatgcatgcatgcacttggaagtggaggcagcagcattagaagttcaaggttaccctcagttacatagggattctgggcctgcctgagctacatgaggtcttgtttcaaaacaacatcagcaacaacaaaattggatcctaaggtgacagtagagtgccagcctccctcctgctgcaaattccaggcaggtgttccccacctattacaatggtcccaagtaattttttttaatgttatgggcattttaacacacacacacacacacacacacacacacacacacacacacacacacacagagagagagagagagagagagcatgcgtgcaaggggataaggcctttgtgcttcacttgggaagaacaggtgtttcatgagtttcttgtgaggagaaacatttgctaggcatcatagccctctaggaatctcactggctaggaagacaggatgtcttccagcatcttgaccca

SEQ ID NO: 1068 - DNA, 2814 bp, Mus musculus
gaattcatgtcttacggtcaaggcagagggcccagcgccactgcagccgcgccacctcccagggccgggccagcccaggcgtccgcgctctcggggtggactccccccgctgcgcgctcaagccggcgatggctcctctcggatacctcttagtgctctgcagcctgaagcaggctctgggcagctacccgatctggtggtccttggctgtgggaccccagtactcctctctgagcactcagcccattctctgtgccagcatcccaggcctggtaccgaagcagctgcgcttctgcaggaactacgtggagatcatgcccagcgtggctgagggtgtcaaagcgggcatccaggagtgccagcaccagttccgaggccggcgttggaactgcaccaccgtcagcaacagcctggccatctttggccctgttctggacaaagccacccgggagtcagcctttgtccatgccatcgcctccgctggagtagctttcgcagtgacacgctcctgtgcagagggatcagctgctatctgtgggtgcagcagccgcctccagggctccccaggcgagggctggaagtggggcggctgtagtgaggacattgaatttggaggaatggtctctcgggagtttgccgatgccagggagaaccggccggatgcccgctctgccatgaaccgtcacaacaatgaggctgggcgccaggccatcgccagtcacatgcacctcaagtgcaaatgccacgggctatctggcagctgtgaagtgaagacctgctggtggtcgcagccggacttccgcaccatcggggatttcctcaaggacaagtatgacagtgcctcggagatggtggtagagaaacaccgagagtctcgtggctgggtggagaccctgaggccacgttacacgtacttcaaggtgccgacagaacgcgacctggtctactacgaggcctcacccaacttctgcgaacctaaccccgaaaccggctccttcgggacgcgtgaccgcacctgcaatgtgagctcgcatggcatagatgggtgcgacctgttgtgctgcgggcgcgggcataacgcgcgcactgagcgacggagggagaaatgccactgtgttttccattggtgctgctacgtcagctgccaggagtgcacacgtgtctatgacgtgcacacctgcaagtaggagagctcctaacacgggagcagggttcattccgaggggcaaggttcctacctgggggcggggttcctacttggaggggtctcttacttggggactcggttcttacttgagggcggagatcctacctgtgagggtctcatacctaaggacccggtttctgccttcagcctgggctcctatttgggatctgggttcctttttaggggagaagctcctgtctgggatacgggtttctgcccgagggtggggctccacttggggatggaattccaatttgggccggaagtcctacctcaatggcttggactcctctcttgacccgacagggctcaaatggagacaggtaagctactccctcaactaggtggggttcgtgcggatgggtgggaggggagagattagggtccctcctcccagaggcactgctctatctagatacatgagagggtgcttcagggtgggccctatttgggcttgaggatcccgtgggggcggggcttcaccccgactgggtggaacttttggagacccccttccactggggcaaggcttcactgaagactcatgggatggagctccacggaaggaggagttcctgagcgagcctgggctctgagcaggccatccagctcccatctggcccctttccagtcctggtgtaaggttcaacctgcaagcctcatctgcgcagagcaggatctcctggcagaatgaggcatggagaagaactcaggggtgataccaagacctaacaaaccccgtgcctgggtacctcttttaaagctctgcaccccttcttcaagggctttcctagtctccttggcagagctttcctgaggaagatttgcagtcccccagagttcaagtgaacacccatagaacagaacagactctatcctgagtagagagggttctctaggaatctctatggggactgctaggaaggatcctgggcatgacagcctcgtatgatagcctgcatccgctctgacacttaatactcagatctcccgggaaacccagctcatccggtccgtgatgtccatgccccaaatgcctcagagatgttgcctcactttgagttgtatgaacttcggagacatggggacacagtcaagccgcagagccagggttgtttcaggacccatctgattccccagagcctgctgttgaggcaatggtcaccagatccgttggccaccaccctgtcccgagcttctctagtgtctgtctggcctggaagtgaggtgctacatacagcccatctgccacaagagcttcctgattggtaccactgtgaaccgtccctccccctccagacaggggaggggatgtggccatacaggagtgtgcccggagagcgcggaaagaggaagagaggctgcacacgcgtggtgactgactgtcttctgcctggaactttgcgttcgcgcttgtaactttattttcaatgctgctatatccacccaccactggatttagacaaaagtgattttctttttttttttttcttttctttctatgaaagaaattattttagtttatagtatgtttgtttcaaataatggggaaagtaaaaagagagaaaaaaaaaaaaaaaaaaaaaaaaaaaaaaaaaaaaaaaaaa

SEQ ID NO: 1069 - DNA, 1059 bp, Mus musculus
atggctcctctcggatacctcttagtgctctgcagcctgaagcaggctctgggcagctacccgatctggtggtccttggctgtgggaccccagtactcctctctgagcactcagcccattctctgtgccagcatcccaggcctggtaccgaagcagctgcgcttctgcaggaactacgtggagatcatgcccagcgtggctgagggtgtcaaagcgggcatccaggagtgccagcaccagttccgaggccggcgttggaactgcaccaccgtcagcaacagcctggccatctttggccctgttctggacaaagccacccgggagtcagcctttgtccatgccatcgcctccgctggagtagctttcgcagtgacacgctcctgtgcagagggatcagctgctatctgtgggtgcagcagccgcctccagggctccccaggcgagggctggaagtggggcggctgtagtgaggacattgaatttggaggaatggtctctcgggagtttgccgatgccagggagaaccggccggatgcccgctctgccatgaaccgtcacaacaatgaggctgggcgccaggccatcgccagtcacatgcacctcaagtgcaaatgccacgggctatctggcagctgtgaagtgaagacctgctggtggtcgcagccggacttccgcaccatcggggatttcctcaaggacaagtatgacagtgcctcggagatggtggtagagaaacaccgagagtctcgtggctgggtggagaccctgaggccacgttacacgtacttcaaggtgccgacagaacgcgacctggtctactacgaggcctcacccaacttctgcgaacctaaccccgaaaccggctccttcgggacgcgtgaccgcacctgcaatgtgagctcgcatggcatagatgggtgcgacctgttgtgctgcgggcgcgggcataacgcgcgcactgagcgacggagggagaaatgccactgtgttttccattggtgctgctacgtcagctgccaggagtgcacacgtgtctatgacgtgcacacctgcaagtag

SEQ ID NO: 1070 - DNA, 72332 bp, Homo sapiens
  misc_feature (70768)..(71491): "n" at positions 70768 thru 71491 can be any base
ctatgggaaaacttcaagcagcccaacatagatgtaagtggagtccctgaaggcaggacagagttatcacaaggaagtgccttatgcatttgtagaggctgaacatgtccaaaattcataggccaggaactcaggaagaccatagacaggctcaacccatgggctttctgtctctatccagacaacccaggaaaaagagagaggacaatgactaatctcaataattagaaaggtgacatctctacagattctatagatattaaaaaataaacaggaataaacatctacatgtgtataaattcaacttctgtaaaatgaacaaattccttgaaagacatcaactaccaaagctcgcacaagaaataaataaacaaaatggttctatagctatttaaagaactgaattgtggttacaagccttcctacaaagaaacttaaaggccagatggcttcattggtgaattctaccaaacatttaagcaagacataataacaatttccacaaactcttccagaaaattaaagagttggaaatactcatgagtatctcatgaggccagaattaccctaatgcccaaatcagacaaagacattataaggaaaaaaaattctagatcagtacttctcaggaacatagatgcaaaagttcttaaccaagttttagcatatccaatccaacaatatataaagaggatgatacaccatgagcaagtgggatttatcccaggaatgcaaggttagtttaatatttgaatataaattaatgcaattcactatattaattggctaaataaaaacatataattgtctcaatagatgcagaaaaatcatttaataaattccaatatttatataaaaactctcagcagattagaactagctgtgaactgcctaaacctgataagtggcatctatgaaaaacttcagctcacatcacactttaataaaacactgtgtgtttcctccctaaacatcaagaacaacacaagcacatccactctcaccacttttatttgacactgtcctggagtttctagctagtgcaataagacaagaaaaagaaatgaaaggcatctagaatttaaaggaagaggtaacctgtctttattcacaggtaacacaattgtttatatggaaaacgccaacaaatctacaaaaaagaataagtctgctggaactaataagtgaacttaggacagttgcaggaaacaacatcaatgtactaaaagtcagcacttgcaacaaaacatggaaatggaaagaaataataccactttaaatagctgatagcttctggactaagaggaagctgcaggtagagggggcaggtggaagatttaggagagtatggaggtggttgctgagcctgatatgagaagaacctggacagaacaggaacaaatgctttgccgaagcttctggacccactgggctggaggacaaccagcaaggaacagcaaggaaggaaccagcaaggaagcttctggacccgttgggttggaggacaacctcagcaaccctctgaggagggagagacagaaactctctgcagagactgcaggttgtgacacagaagctgatggcctcgatttccctccatgaaatgggacagtagggtgccgttgacagtcagaaagggtgtgcaggaggtggatgctagggaggaagcccacaaaggggctgatggactggccttgtaagaaacaaaacatcatgtctccttggagccatgtctcctgtgcctcgccagggacagtgggccccagcttcttcgaccagggaagatggcagtcaatggataccccaatggctttttctcttcacctgttccccccactctcctgttccctagaaccatgttcccacataaaccacctgcactcactacttgtatcatgttctaaaaatcccaccatgtccctggagctcaggatcttcaaggccaaggggaggccctaaaggtgaagttgggggtgaaccagagtgaaggagagcatctccagtgatgagggagtccaagacccatgatcctgggtgatgggggtggacaggaggagcgtgactgtcaagctgcccaggcccaggcccatgtgtgaacagcagccctgtgaatcttgctcttggcctctgagccttggctctggcttatgctccaaagatggtgacactgcatctcctgtggtctcagggatcagctgggtcatgcaggtttcagcaggggttgtggtcaccactattcccatgagagaggtcatacccacaatgtaaaatcccacttgggctgcaggacagccaagggctagggaggaggcgccgctcatgtcacccacaaccttgcccagaaggggcactgcctctaggggaagattggacccaggcaccccttcagtgccgccctcctctggcatctccacttggtggcagtattggcccagaagcggaactccagcaagcagccaccaaccggtccctaagagctgctgtggcagcaaaacttagctctttcccaacaggaaagtctggggagtctattgccctcatttcacagggaagtaagttatggcctgggaaccaggattctggataattaatctgcaggattccagaactccatgatactgtgattttttttttttttttttttgagtagtggtctctctctgtcacccaagctggagtgcagtggcacagtcatggctcactgcagcctcgaacttgtggcctcaaccagtcctctcacctcagcctcctgaatagctgggactacaggtgcataccaccatactcagctaattttttatagagacggagtctcactatgttgcccaggctggtctcaaactcctgggttcaagagatctgctggccccagcctcccaaagcactagaattacaggcatgaactacctgtctggcccattgtgatttttttttaattctcaaatttgattttcttatggttctaagactctccatctatgggtccatgcttgaagaaccataagattctaagatcagagggttctactgactcagttcccctgcatcctataattctgtgtttggatgattccagcatttcatggccatttcatgggatcaaccaggattaaccacatggctaaagggagaggctgatggccctacttccatggttcccagattccatcttctcttcctcatagggaggtccacaattccccacatatcaccaggccacctgcaaggagagcaggtccaagaagtcaccttgcaatgagaatgagatcgtgtgcctcctacatcatgccctaagggagagaggacagcatggagctaggaggtggatggctggggtgtcaactgagaaagacatgcctgttggaccccagagttgacttttatggcatccaagagctgcctgtgagaacacacatggtttgatttgtgaagggatgttcacacaaccatcatgcgtcagccttctcaaaggtggcgttcgtagcacagcatgcgaagggctttgagtcaacagacattcctggaaagaaagcagtgtgggggtatggaaggatccctggaggctgggacctggagaccagggtctttcctgcgggcccattgctccttccactttgccttgagcccactctttccatacaaggagaggctgacctaaggttccagttgctttcatcaggtgggatctggtgaagggtcaaaatggaactctaagatgggtagttgaaggggtgacacccgaggagagagtgatgtctcaaaacagactgaattatttcccaaagaggtgccccaagcccctgcaaatgcactctctaggaagtctggccactgggccccttgccctcgtcccacagggcagctcagaaaggcaagctcatgaggaccggctcgtgtccacctacccccctcattgcctacaaggactcccgagcatgccccccatcctggcgcaatcttctgccctggagccaggaaaggatggccttctgagttggagtcctgcagtcggtcttccagtcttggagggaaacatatactctacaaatggtgagcctcggagagagcccagccctgctgtgctgcctccaggaggttcaggcggctatgcctcctcattcagcctcactgagccttttccacttccagaacatggtgaaattcacttccctctgaccacacagtgcttggtggatcaccgggcacacagtgggcctacagtgggcatggtagtcgctgtcatcactccgctccaggagccttcaagaaatcatctcatctgacaacccacatttaccataaggaccttttggaggccaggcgcaggggctcacccctgtaaccccacagtttgggaggccaaggcaagaggattgcttgagcccaggagttagaaactacagtgaactatgatggcaccactgcactccagcctgggcgacggagtgagaccctgtctcaaacaaataaaaaagaaccttccggagaactgaaggaaagtggaaatttgataagagatctgggctggagaggagaaaagtcttttaaaatataaatataacggcaagctcagaaagatagatacagggcaatggtaagaagcagacaggtaaccagattgggctagtgggagatgctcattgagacaagcagtgcagtggtgtgccactgtgagggggaaacggggatggtgcccccgccatcctgctttgtgactggcgtgcacggcaagggggcagagcaacaacttctgtgggctggacctgccctgggcaggggccacggggaggccacagactccggtctgaataaatacacagcaggaacccagagctgtggatatgtagaccccacacacagcctcccacagagggcaggtaacccacaggaagacagacagccctgagctcacagccatacctgcaaagccctgccaggacatacccacatcagtaatgtccacgggggctctcatggtgatattaacgcggaggaggtaattcccacagtgcctgagctgaacaatgccaacaaaggtggagacggggcggagggacagacaaggaatgtagagaggggctgcagacaggaagagcaactcacaactgtgcaggagggctcatcggctgtgacaggaaaacacacagagactgatagaaagacaggacagccatagacaggaggtgggaggcagacaggtctgtggcccagagaccctgtctcaccacagcagctttggggaagcaggtggccacgtcattttccttgtctctgtttggctgacctgtgcatctcaggcccagccctggctgctgtttttccagctgcagttcccaaactgtgtgctaaggcaccctgggacgccacagcaaattcccagggtgttgcagaatatcacgcctgtaatcctagctctttgggaggccaaagtgggaggatcacttgagcccaggagttcaagacctgcctgggcaacatggtaaggccctcgtccctgcaaaaaaaatttgttttaaagaaagtacaattgagtcttggacaacatgggggttaggggcaccaaccccctgcaaagtcaaaaacttgagtataacttttgactccctgaaaacgaaactactaacagcctcctgttgaccagaagccttgctgatcccacacacagtcagtcagaacatacgctgcatgccacatgtgttatcccctgtgttcctacaataaactcagctggagaaaggaaattcctgctcagaaaacctagaaaagaagccagactcacagttcatgaggcggcagtgggtcctcataaaggtcttcatcctagtggtcttcatattgagtggctgaggaggaagacagaagcggggcttggtcttgctgtgtcagggtggcagaggcaggagaaatccatgtataagtgacccacacagtgcaaacctgtgttgtttgagggtcacctgtcctgcatgaacatcaccttgtatggcctgagagccaggaccttgaacaagaagtgagagtgttgcttctggagggccagtaactgcagttatgtgaggatgaaataaaaatatgattcatttatttttaactgatatgattttttttcaaatagctactgatcattaagtggttggacctaattacttaataaacaaagctcttaggtatttattttagcctgaggagctgggcaaagaatgactataagttgttttcttgattaatttaatttaatttaatttaattttatttagagtcagggtctcactctgtcacccaggttagagtgcagtgatgcaatcatagctcactgcagccttgaactcctcagcccagatgatcctcccatcttggcctcccaaagtgccgggattacaggtgtgcaccatcacacctggccaattgaaagttttgatctcaagaacccactgcttatggagaaggcatccaaagagtgacccccacaaggaaggtcagggaagcttccagaagggaccaagttccaatggaactgactgtggaggggcactccatcttctgaccctggacccctaccctgtcctgctgctgttccttccagggtccctcagccagaaagcccccagagccttgaactctgtctgcccaaaccccttctctgttttcccccaacttatttttgctcaaatgagaaaaaaaggaagcaaaagatgaccagttagtgtctgaaatcctggcttgccccacccataacagggactcacacccgctgtagacagggaacccactacctcacacagcaaactgtccatcagagatgcccctcccacctggcttaccccacccaagcaggtatcttacagagcttccggggtgggcagcgcctcctctcgcctgggggcctattctggaaggagggagcacgctccctgggccctccagcaggccagaaatgatgttccctccagcaccatccatacatggggagttttgttttatcaaacacatggctggctgctcagggcttagctccagagctgcccggttgtcaggccttctcacacgtgccctctctgaggacgattagccctttcctgacgctggcttgcaaaggtctcacccacctccccgttccaagtgttggaatgtgggtctgtgtcctggccaacaaggaggtctgtggagacaggaccgggtctcagtcaccgttcagcagccacccggcatgcccccaggagcctgccctatgccttgacctcaacctacgccatcccagtccccagcgcaatgcacaggtggggacatagaccttgacagactggtcagggacagctccctttaggcaacagcagagggcgcttccagggaggcccctcaccttcctctgcaccccaagcaagggacaagaggtgctgtaggcaacatcacccgagcctggaagacactcaggagaagcccctcaggcccctgacacccagctggggtcccacccttgctctcccactctgctctccaccccaccccagcccagccccactgacttggctgctcaggagccgaggctctcggaggctcacagagggaaagaggagccccacatggtacaggcaggtaccgaggagctagttccagaagcctccactcgttcctccatgcagcctaccctggctccctggtatccagagtcttcagaaacaggagccctcgcttgagagcctggcctgggcaggctgagctcctgcctggggcctcggagtctgctcctcccttcatcttctgcagcctgggaagcggccggatctcagtgtgtctactacccaggtggcacgggcagaggatggggcctgatgggggagaagaaagcagccaggaggaggggcttgggaaaccaaggggcaagagggcaggactgagcaggctgcgctcacctgcccccttcagagaggtcacgaggcccatcctgtcggtgggcagagctggcatcctctagggggctctaatccccgagcctcatttctggggaggtgggggtaacaagagtctgcgtgcctcaggctgggctcaggcgcccaccccacctgcagcccaggttttccccagtaccacaattgggtgggatttttgctgcaaggccaagtccagaggagcacaaacacgctcctcccctccccctccctgaccccaccgccgcttcattccagagctcttccctctttccctctgagggtgggggccccgcagtgcctgggagaagcgggtgggcggccgggcatgcgtagcggaaactggattcccaaggtagtgaggagcaaagggaactttttttcaaagagaaaggctgtcactctgaattcaggactcctgacatagtcaccaggtgacccctagggccggtgtccacaggaccacaggctccctctgcaaacgcagaaccaagttgtgagtggggcacactgtgggaagcagctgcctccatcagccagccagtgacacacctggggacatctcagccaccccctccctgagaagctgcacagaagcggccacatgcccatccctgcctctccatgcacctccctcccgcaactctgcagccgcacaggaggcctagcccacaggctgggcagtgcagtatccccagagaacacaccacggatgagtctggagttgcttggagctctcagaagctcccggagcctccttcctcaattccaacgcggtaaccaagattcctgctgagcttaggtcacagtgtgactgcaggaggaccagccgcgatgggagagtgcctcttaaccatcccagttatcaggtcccccgggggaggctggggacacttcccctctgcaaattacaatctccccaggcggctcccggggcaacacatggatatgcaaatgactgggagctggagagttgactggtcactgggtgaccttgggcaagtcactttccctctcaggtcttcccctctccatcagcaaactcctaaagcttaactaaacagtcagaaatccctctgtcggaacaggctgcatagctctgggcagacctggaggttggtggtcccagaacctgggggcagcactgcgcttccccaccgtcccatcgcgtcaggggcttccactgttctcttccctggtggagtgatggggagaaaaatggaggggtcaatccctgcgccacagagagagtcccactcgtccccagctgtgacccacagacgcgtggctgcaccttggaggtccacctggccgctgtccccattgcaggctgcacccatcccggaccctttctatccgccgaaggcgcaggcagctctggtctcagcggaaggagtccggccgcaggcagacggggccaaaggacgtgcacccgacaaccgtccgctccctccccaaacccccgccccgagaaggttgatggatgaaggggagccctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggccggccgcctgcccatctggcgcaccccagcgcgccgcgcacacctgggggcccgcacaccagcacgtcctcagacacaccgacacccacggcagcaggcgggggccaacgccgccgccgcggttcgggctcccgtggccccgcctgcccctgcctgccccgcccgggccccggccccggcgggcgccccccgcggcgctgccccgcccccgccgccccgcgccgccccgggcctcggcccgcagcccggccgccggcccacctggcgcagcgccgccctcggagcccgcgcacacccgcgcacccgcggccgcaggagggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatctttgtcttgtcggccctgagggttcctagcctcggtccccatccacctcatatgcatgtatacctccttttcacctgggccccctgtgttctaccctgaatggaccctgagacaccctcggggacagtcaggcattctgcaggggagccaggaggagcagagaagtgaagtccctgtaccctccgcaccctcctatcaagagtccaggacagccctttggccacacagggaagcggggcatagaaccccacctgacactgaccggggtgggtggtgaggacccctcccccatccccaccaccactttgttctcagtagggttctcacacttggggattctctgcttcctgagaagcagcctccccttgggggaggctggctccctggggacaagtctgcccccttcttgatcccctctctgctcccaggcaggctgctcgggctggagcaaagacatggcttcccccaggcatgagcagcaccccggcagcatagggaagaagactcacagaaggacgcagtgctgcaggacccctgctgctggacccctgccgctggcatcctacagtttaatagccttaatagccggggaagattctctctctttctctggtcttctacccagtagagcatctcctcctttctcctgcctccccgcatccaccccagattaagcatcaccaggggaggaggggaccttggcccctgccaggtgggctcctggtgagccccagtggaacagagcaggctggggtggggggcctccctgtaactcctcacctgtgcccccagcccctccctaacatgaagccgctggccccttgattctcccccctccaccatcaccggcacatgaaagtgaaagtgaaggggaatctcctcacctggagaaacaaaccaggaaacagcccaaatcagggtaattaggcttttgaagttggcagagggagaggcaaaggtgtccctgtggccagcagccctgtgagagtgtgaagggccacctgcctccccagggctgggtggcccagaggtgtcttatacccacgcagcagatgccagtggtcccaaggctgagcgggtctgaaatgcagagagacgggcctagcctaacactgaatggcccagagctgcacagatgtccaggggcatccattctgagctcatccagtgacagagaggagacaggcaggagaccagaccaatgcatatgcatctgcccacctgcgtcccatgaggccacagacggcaggaacctagtggccccagcctcccagcacgccccttctaagctgagttctcaggaacaagaattcttggaagagcccacatggacagaggacagggcagctgcgctgcaaggagaccatggctccatctgagaacaatccccaggcacacccgcactccagggcactctgagcacctctcccttcttcccatgtctgggttaacggaatcttgtcatctccccagggaccccaccaggaccctagaggtgggcctgtgcctcccgccaccgcctccccagggtccaagcccacttcagggcttgcaactggattttgttcatctttcaagtccctctgctgcctttaccagactgggctgtggcactcccgccacggccacctcctgcttccgttctcagtcctggccctcccctgggacccacaccctcccagccacctggagttgctgccaggcctggccatagccaccgtcgctgcctagtggagcacagcaagctccaccccttacccagccctgctctccctctcaggccgttccttctgcccggccgtcaccagctcctgctggactatgggatcccaagcacagaggcctggctgcttgcagatggccaccccagttgtcccagcgaagtgcagtgtgggctgtgtccagccttttgcctgcccctggcctgctccacagcctcgctcatgctccctccagggtctccctcacatccctctgggcctcgagcttgtcactatgacagaaacacatcatgacctccatttttatagggcacctcacacagccctcaacagaagatgtaggccctttcaggcccccactctcctacacactcatgggtgcaaacaacctcctgggcacaagagctcagcccctcctcctagcccttcatgggctggagggccagcacacttggaggccctgctcagccagtgtctgcactgcaccaccgccaggcacttcgcccctgtgtcctcagtcctggtgggcctcattgtggtggggagacagcctgactggaagaggggtcgggtgaagaggcagcttagagaggcaggagccaggaaagggtgcaggagagaaggagctcggctggaatgatgggtcaggcatacgtgtgtggtgtgtgggcaggtggctgcagcatgggtgtttcggggactgagaggggccagtcgagcagggcagggacatggcccagggtacccagaagctcagatgggaagggccttgtgataggagggatggttgccactcccagagtcaccctgcctccacattagcctgccactggcccactccctctgcaggcctggcctcaccctagccccttcttccttctcccttcgcccgcatctgtctgtgtctctctgtctctgtttctctcttccctgcctctgtccctccatatctccatacctttgtctctcagtttctccctgtctgtctctctctcttccctgtatctgtctctgcccgtctctgtctctatctctctgtgtctgtctctctctttcagtctttgtcctgtctctctctgcctgtttctgtcactctatctcttttcatctctgtctttctgtcttttgcagtctctgcctctcgtctctgcctctggtgctgaggacagcagtcactagcaaataaaactcgtgaaacgagctgagtggagccaccaggccagccctcccagagctgtgggatctcagggccctgggggtggcattgcttctcagagctgcccacacacaaacccctcctgagggtgacggtcaggagtggccacacgtcaagtgtctgcaaccagacattggccctgcataactgccaggatccgtagccgcctcagggacgcacagcacccttccagagtgcaaagctcctcctgcctggtgctcgcacctcaggcactggccagcttgggcccttgaggccagctgcccctctgactcacggggcttgttctaacgatgtttgcttcgcataagcctcctagaatcttttgtagcagggagagcaggatgagtagatacagtcatagcagcccagtcttaggggtggtgactgcccggtggccacttcttccactgggtcccttgtgcacatcaccgtactgtgaggagggaagctccggtgtccagcagccctcccaagatacaggtgacagggctcccgccatctccatccagggaccccgttggggcttctcaatgtggggcctaccatgcagagcccaaatgtgaatgcttggccacctgccatgaagaaatcagaacagaaatgggaatttaaaaaggatttggtgacattgtagcggtttgacggtgctgcaaccatttctgtggattttgtaataatggaaatttaaaaacaaaccaaccacgtccctctgttgggactctagtctgagaaagccagcctgaagccacacctggagtaatgggggtgggggggctctctcaatgtggaccactgcctgtagccctcatccattggatttttgacccaaacgtgagacttctaacttgccccctttaagagtagttgaagggctggttgctgtttctgttcagaagacccgcttcatgtctctgaaggctattggctggggaagaaggattagactgtggctcaaggggcaggggctggggcagaggttgcaggtgccaaggaggctggttctggctcccaaagagaaaaagctccctagggatgagagcctgtgccccaagtggtaccagggaggtgctgagctgcagctaccgaggccgaagaaaaggaatgtcattcacaaaggagacctgtacagccccacagacagggtctcgctctgtcacccaggctggagtgcagtgatgtgatcttggctcactgcagcctcgaccctcatgggctcaagtgatcctcccatctcagcctcctgagtagctgggaccacaggcgagcaccaccactcccagctaatttttgtatatttgtagagatgggtttctctctctacaagaaaccatttctctctctagaagaaaccatgtggcccaggctggtctcgacctcctgggctccagcagtcctcccatcttggccttgtgagtagctgggattacaggctcgtgccactacgcttggctagtatttttcattttttgttgagatggggtcttgctccgtggcccaggctgtgcactttaatgttggacaatcccccaccccacccctcactggttacagccctgaggctggtgaggggcacatggcctcttccttggcctccctactggcctccccaggtgacaccctggaggtgtctctcacgttgctgcttccacattccttccccggcaaaacgtgccgctgccgcccagggaaactggcaagtgcgtggccgcgggcacaggagccgctgtgcctgctgggactcgttcaaagtatgtgtcagtaatcccagctgggccggcgggcaggaggaggtgcgggttgggagagctccaggcagggctgggcagcctggactgggaagggttgccgacacccaggagggacctgggggccttaagtcctggggaccctggccggctcacaaggtgcttgagctgccgagagtggtcttctaggcagctgcagttccaccactgggtgtgagaagaaaccagaaccttgggggtctcccaggcaggtgggtgccctcgggcagtctcagcctgggcgagatgggaggtcatccaccaacagggaaacacttcgagcctcaggtctgaggaaggaagccttatcaccgcccatggagtggccctgatcttaagaagacaaagatttggaacaggatgtttgctccagaggccccacagaggggaagcccacctgcccaagcaggaccctcaatggcagagacacccacctgccctggtcctccacacctgcctgcattgcagctgtgctggagccagaggggtcccaggaggcgaccagctggactcagggcacaaattgcatcctggaggggtggccctggcaggtccgcgagtggggtgcactgggtccctctcaggccaggaggaggctgagatgacatccagcagggcagcagggcctgagatcagtgtccccattccatgcactgctcccctcctctctcagagcttcaggtaggagaggggtccattaccccatttgacagatggggaaactgaggcccaggaggggaaagagagaaagagcaaacaaacaagcgagtaacagggcccgagttggagcccatgcccaccttccaggcctgtccacacgcctgcatggagcattactgtgaggtccccacgcccccagcaaacatgcaagcacagagccgtgcccttggtacatgggtgctctgagttcgctaaattttactgctaaaagacaccaggcctggacttgagaaacctaagagcctgccagcctcagaaggacttgcacaggaacagtggaggctggatatggtggccactcaggacccccacagctgtgtggctgcgagaaggcccccacgctttgccctgagcttccatccacagggattaggtagcacctccagtgccgccacgtaagatgggaaattgcacatgggaccaaaccaagccggggaggccagcgtggcccggactgggctggcctaccgcccgccttgtggtcctgggccagcctccttcttcccctgcatgtcacagccagcatctctgccgtacctctggcgagctgcccagcctttcaacagaagtgagggagtggggaagaaaaaccattagtgcttgtgggctggaggcatggctgctgtgactttggccacaggcggaagccatgggtctagggactggggccattttataaaactacatttgtgtgtgttctgagtgaatatgacagcctccccttcaaaacaaacgattgttaggaaaaaaacaaaacaaaacaaaacaaaacctaacagcattagtgaaaatctggaaggaaagacaagtctgtgatcttatcaactttttcaactttttgtttttctaaggatagaaacagtttgtgttctgtttttgaaaactcactaagcatcatctccatttctggggccttctggatgatcacacgatggttccactaggtcttgtggtgctggtactgcgatctgctagcccagccctgccgttccctccagagctgggattccagggaaaggggacagagcaagagaggctggagatattggaagagcagggtcacattcccttgggacaccaattttgcacagccagagggatatctggtgtcccatccagttgggcagttagaattccagccactcagctgtgtggcagctggacgtgggaaacatggactcttcctgggacgctgtggtgttggcagtgagaggggagagggaatgaattcctcatccggtgaatcacaggctcggggtgcagggcatgggggcagggagggcaggctggcctcagcctctccccggggactgggcccagccttcctgcccctgctgttcccaccaccctgaggcagggcccagacctcactgtgatccagatcgttggcatccaggaagtgagtagggagtgacggatggcaagaccaccacccccgcctcccccccacccccgccgcccaagtgcttacctgtggttccttgtgtgagtgatcctcagcaaggacccttcgtccttgaccagacacttgtttgcatgcctacaaagcgtgggagaggtcgaaggggagattggagaattcatcagaagccccagaagcccaagtgggagctcctggccctgcctgctggctggggccacgcttgtcttagggcaccaggcaggacagtggccaatcgtggctgctccgcctgaggccatgagcaggcaggagccacggactgacagccagtgctcagggtctgtctgtgcccgtcaccttctgggcacccgatgttgcccctttctgtcccccgcatgtgctttaagcgcctgctactaccttgctcttttggggatcctactgactagagggtggaggtaggtccctgaccccccagggtgattatcagcaaggctgactccccagggactcaacccaagggagcccccaaggaccctcagagtcctcatgaagacagacaggggccatggagcaagtttagactcaaggaagccatagaagtttccccgtcagccttagaatgtccaagctagaggcagcctgggtgaacccagcacacattccctgtggcactcacgctcctggggccaccctgggaggaccctgttctaaaccacaactgcccagttcagttggggaaactgaggttccaacagtcccaaagctgcaggtgcaactgttagggccaccacccatgtccccctgggtggcctcctggggtggaaagggggctgcattggggacaggaagccctatgatgtcttgggtcatcagctgcaaggaggctgtccagggtctgtgtgacttgcgccatttatctctgactcatttataaatgttattttgcagggactggggtttcatacgtgtacttgtccattctgcattgctataaaggaatgcctgagactggaaagaaaaaaggtttaattggcttagggttctgcaggctgtacaagcatggcaccggcatctgctgaggcctcagggagcttccactcatggtggaagtcaaaggggaggtacgtgtgtcacacgcgggagagggggcaggggagggtgccaggctccttctaacaaccagctcctgcatgaactcagagggagaactccctcattaccgcagggagggcactgtgccattcacgagtgatctgcgtctgagacctaaatgggtggggcccactaggccccacctccaacactgggggtcgcatttcaacatgagatttggaggggacacacatccaaactatatcaacacatttgaagggcattgtaggatcttagaaagcagtggcccctggaggccaacatgcgggaagccctgttctgctgtattagccggtggctgtggcaaagctccattccctgagccttggcttcctgctctgggaggtcccagtgccacctatccaggtcctgtgggtttcagggagccacataactagagcccgtggggaggtcaccagtgagctctgcccagcaggtggaggccaggtaaggggctgggtggtggtagtaagaggagcgatgctgggtattggaagggagaaacaaccagcttcagcaagcctccctttcagagacaagagtgctggaaaggtggagaggccgcaggaggagggaagaggagggactagctctctaaagaccacagtggccaggcgcggtggctcacacctgtaatctcagcattttggaaggccgaggcgggaggatggcttgagtccaggagttcaagaccagcctgggcaacatagacagacaccatctctacaaaaaatacaaaagttaaccgggcatcatggcacaggcctgtggttccaactacttgggaggctgaggctaagatgggaggatcccttgagccctgtaggtcaacgctgcagtgagccctcagcctagacgacagagcaagacttcatctctaaaaaagtaaattaataaaatttaacaaataataaaggccatggcagtgggctggcggagacagcggtggctcgggcccctggagcttgcatagcaagatgctggaggtggcagcctggccttcagatccttctccttctctgggtctgagaagcttaggtgttggaactcagaggtggtcaggaaatgccagcatgagcaggaaagtgagagggagtatctgctggctcccagtgctgcaagaccctatctctacaaaaaatacaaagcaagagaacagcacgggggctttgccattggctaacgcagactgacctccccagtttgggcatgaacatccttttcacgttccaaggtgggatccgggagtccaggttgcattgtatttgatgcaccctgagaacttgcgctgagaacaggaccctggggacactcgatctcgaagacggggttctcattcactctccatttgcagagcccctcccccactcactgcagccaatactccctggcgagaccctgagacaggcctgtctgtcccttgtcccaggcaagcctggcccacagggtgtgggaggaggaagttacaggtcatagtttcccaagcactgatggattccgggcatctgcattctccttggattagaaatttggatcctaggagcttttgggggctggtgtggggatagtgcctgtgcaatttagatttttttttttttgagacagggtctcactctgtcacccagcctggtgtaatcagagctcactgtggccttgtcctcctgggctcaagtgatcctcccacctcagcctcccaagcagcggggactacaggtgtgtgccaccacacccagctaacctttgtatttttgtagagatggggtcttgctctgttgcccagattggtcttgaactcctggcctcaagcaatccacctgcctcagccttccaaagtgctgagattacaggcatgagccaccatgcccagccttatatttgattttctttttaatgacccaactgatccttcaaggcccagccaaaatctggtggcccagtgagcctccagggccctcctctgcactgctccctggccccacaggagctccccgctgcctgccagctttccaccctcctcaggcagggtctgtgtggcccaggccttctggtggcctggtgctatcagaaggagaaatctctcaggaagcaattcaacgaactggaggggccctctggtccacaggaggcaggagaagcccatcctgaccccaaatccacaagggcccgtcaagggaggggtcccatcagggctgtgagaggccagggatgctggagccacctctggcctggcagctggccacctgcaccctggccatactcaggaaggtggtgggccagggcccacccgggaggagggtgagaggggcacagaactggctgactcagcaccctgagaatggaggcttcagacttgggagtccacctctctgctttatctagagaccagggacaaggccgcccctcccagccccgagcctgcgagctgaggtggtcccggctccatgctggtcatagtgttctgggggtgggcagagtgacagcccccaaaatgaatccagcatctagcctcggagaagggatgagccttggaaatggccgcatcccccaggccagtccctgttttgtaagcagcaagctctaagtggattcctttgtttctcctcattctaagtctccaagtaaaaaggacattcaactactcttgcttttccttctttcagacacctcttgctcacttccctggctgtaagctaggctggccctggagcctgggtacccggcccttctcagacacactcccaggcctcagccatgacactcaagtgtttgtcctctacaacattccattaggaaaattttcaaacatctggaaaagatgcagcctttggacatcaaagccttgtgtgtccacagctcacactgaagtcagcctgctttatctcacacccaccaccctctccattctctatctatccgtcttatctttttatgcttacgtcagtctgctctgtcccaaatactgtagcaggcacgtcctgaaccagtgctggatgttttgcaagtaacatcccacatggagtcacaccatagaatgggtgaaggggaagcatctgggttcatggaatggaggcacctcacctggggcaaccacctcaccctggcttaaaaatggaagccccttgcctgggcacggtggctcatgcctataatcccagcactttgggaggccaaggcaggtggatcacctgaggtcaggagtttgagaccagcctggccaacatggcaaaaccccgtctactaaaaatacaaacattagccaggcatggtggtgcacacctgtaacctcagctactcgggagggtgaggcaggagaatcgcttgagccaagagggggaggttgcagtgagctgagatcacaccactgcactccagcctgggcaacagagcgagactccgtctcaaaacaaacaaaaaaggaagcccctgcagtcctgggcgaagcagacagttggtctcccggcctcacccatgggcacccccaggcccctctgctggcgttcctgggtgctctgaggtgcatggtttgaaaaccacgagtccagcccctacggtcacctccctggcctggttcaacccaccttctcctgtccagaggcctctcacccacagtccaggtcacagacagctgaccttggtcaccaccacttggccctgggcagtggcagtgcagaccataccccagggaccccggatggtcatccagttgccgggactcaaaggaagagagaggatgaggaaggagacatggaaaaagactacccagctacctacagcaggaacaccaacccaggctgcatcagcacttcctggaagtgctgggatctacaaaatggtggagggggtgtgcagggacacctggggcaggatacctgcgtgtagtgaatgaataaagaagtgaacaagggagccgactgtgcaaggacagactgcaggggtgcaggcttgagtggtggcctggggatgcacgtggggtctggcgcgaggttatgcactcaaatgagggacagacaggagggagggtgactagggagagggaggccagatctccagggggtagacatattggggaccctgaacactgggagtccggtccggaggccagactggttggatccagtggacacatcgacaggtggtcataagcataaggaactctctccctccacccacctccaccagtgcccaaaaggacctggtgatttctttaaattgaggtgtattttgtacagcaaaatggaagaccctaagtgcatggctcaattcgttctgacgtgaagcactcacataaccaacatcgcagtcaaacgcagagcacttcggccaggctggcctggcagagcttccctgatgacaggcacattccctatctaactgtcccattcagggtagccacgggccacacgtgaagcatggctggtgccaccgaagggctgagttttacatttcttgcattttaattaattttaaacttaattacattaatttaaacggcacaggtgtcgaatgccttttgccaaaagcagagcacagcctgggagctgttgggacctggaaaacgaggagtgaggttgccacggtgctgacctctcccgcggatgagtgttgcctggtcttgagctcagactgggggatgcggagggccccaggagcatctcacagttgagcccctcctccccacgtgctcacgggagcccatgccttcgggtttctgagcagcctggcaccctagaggcagtcttcatttgtttattcactctcctattgacggatgcttgggtggcgtccaagttcctgctctcaggctcaaaggcctgggaagattcctgaacacgtctcattgtggacacgtgtttacatctaggggtacatagccaaaagtgggcctgcgggctggcgggatgggtctgagttccacagtgatttctgcgctgggtcacgcctacatcccggaagccaggcctcctcctccaatcccaaagccaagggcatcccttctctgggcagcccccacctgacccggtccccagcctgaggttctcaggttctagccctgagtcccccattgggctccaggtcaacctggtgtgaacggggcccatgcagttgtgctgagcaggaatgcggggctgcatcatttcctgttacagatctggacgacttgaattctgagctgagttttggggatagggcaggtcagggtcctggccttgtaaaatcagacttccagataaaacatacagaaaaacacatagatgatatcaaaacatctagaaaaaattaaatagccagcattgagtatttattctgcacacaacattgtattaagcacttcctgtataacatacaggcttaagagctgggcaaggtggttcatgcctgtaatcccagcactttgggaggctctagcgagaggtcacttgaggccaggagtttgggaccagcctgggcaacatagcaggaccttgtctctacaaactgtaaaaataaaaattagctggctctggtggtgtgtgcctgtagtcccagctaatctggaggctgcagtgagccatgatcataccactgcactccatcctgggcaacacagtgagattctgtctcaaaaaaagaaaaattagaaggcatggtttatgaacattattttagaggccacagagaatccttaattgggcttttaagtaaaaattctcttacttgcaaaataaaaaatcagatttccttcatggtggaagctgcgtctcgccccccgaatgcacttgaggccccagagcaaagggtctgtagcctgctcatctgtgtcgctgtcccagccccacactcaccaccggatcttgccctctgcaggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaaggtatgggggtggtctgggggagggcagatgagtctggagtgggacagagtctcccgcctagcgctgcctgacattctcatctgtgcacacggtgggaacagtgcctcacgcggacgctggggtccttcccgcttacctccaggaggacggtctggggctgaagcaggactgagcctgtggggttattcgggtatccctcctcctcctgctccctggagaggaaagcgggcattctaaggtgactccaaccatggccagtggcggggctgctcccaggagccagggcacaggccaggcttgcagaggaaatacacaaacttaaagacctacaagaagggagaggtttgggggcaccctagagaagaaagagagacagagagaaagacagagagagacagagagagagaaagatagagacagacagagacacagagagagacagagacacagacacagagagagaggaacagtgagacggagaaagagacagaaagatgcagagagagacagagaaagacacacacacagagagacaaagacagagagagagacagagagggacagagcgaccaaaagagaaagacacagaggaatagaaagacagagacataaagatgcacagagacagagagagacagaaatagagagagacaaagagggacagagagagacacacagagagaaactgagagacagagagacagagacggagagaacatggacaagattaaaactttagcatctttttttaaaaagttgaggtgaaattcacataaccgaaaatccgcgattttaaagtattcaattcagtagcatttggtatactcacagaattgtgcaaccatcacctgcctagttccaaaatatctttatcacccaaaaaggaaatctgtgcgcattaagcagccattcccgttcttctcccttccatagcccctggcacccacccgcctgccttctcccctgtgatttagctactctgcctgtttaagaaacggcatcactcaatattttgcgtctggctttttttcactgagtgtgttgattcacctgcactgtggatagtttcagcacttcattcctgttcatgggctgaataatattccattgcatggatggagcacactggtttattcgttcttcaggttgacgcatatgagcgtggtctccaccttttggctgctgtggccttttcttggacatgcatgtgtttgaacgccgttttcacaccttttggtttctgtatctaggagtggaattgctgggtcacagggtaattctgtttcgctttgcttgacctgggaggtcaaggctgcaatgggctggaaccatcacactattttccacagcagttgcaccattttatattcctaccagtattgtttgagggttccagattcatcctcactgatacactgttttctggtgtttgtatttcttacttctggccatcctagagtgtgaagtagaacctacttctgatttcagtttgcacttctctgatgaccgatgatgccaagcaccatttcatgggctttggggccatttgtagaccttctttgaaatgtttagtcaagtcctttgcccatttttaaattggattctttgtctttttgttgttgagttgtgagtgttctttatatattctggatactggatgtgcatcagatgtatgattggtgaatatttctctctcatcgtgtaggtttttttcatttttgtgagagtgtcctttgatacacaaaattttttaattttggtgaaatccagtttatatagatgtcatactgaagcaagaattagctaacataaggtcacaaagattcacatctatgttttcttcaaaaaacctaatagtttatcttttactttgaagtatttaatctattttgagctcatctttttatatggtatgaggtaggaatctaaccacatttttttgcatatggaaattcagttattccagtaccttctatggaaaaaactgttctttttcccatcaaatggtcttggcacccttgttgaaaatcaattggtcatagatgtataggtttatttctggactctcaattccagtctattggtctgtatgtctgtcctgtcaccaataccacattattttgattgttgtagctttgtggtatgttttgaaactgggaagagtaagttttccagctttgttctttcttttccagattgtttgggggggacaggaaaaaagattgttttggctatttggggtccctttcaaatatatgtaaattttaggagcagtttttccatttgtgcaaaaaaaaatgctgctgggattttcatggggatttcactgattctgtaggttgccttgggaagcattgcctccttaacaatattaagttatttaattcaggagctcagggtctttccatttatttaggtcttcttccttaattttgtttgtttgtttgtttttgtttttgagacagggtctcactctgttgctcaggctggagtgcagtggcatgatcacggctcattgcagccttgaccttccaggttcaagcgatcctcctgcttcagcctcccaagtagcagggaccacaggcatgcgccaccatgccctcccagtgtttgtattttttgtagagatgggattttgctgtgtttcccagactggtctctaactcctgggctcaagcgatccacctgccctggcctcccaaagtgttgggattacagggcatgagccactgtgcccagcttctgtaatttctttcagccatgttttgtagttttcagggtatgagttgtgtacctccatggttaatgtattcctaagtactatttttctttttgatgctattgtcaatggaatcatttttcttttcttctttttgttttgagacagtgtctggctctgtcacctaggctggagtgcagtggcaccatctcagctcactgtacttccatctcccaggctcaagtaattctcctgcctcagcctcctgagtagccaagcttggctaattttttgtatttttttttttttttgtagagatggaggtctccctatgttgcccaggctggtcttgaacttttgggctcaagcaatcctctcgccttggccttccaaagtgctggggttacaggcgtgagccactgtggccagcttgtaattgttttcttaattttttttcagattttccattgttaatatatagaaatttaactttttaatcaagaaatacattttttttttagttttgatcctcaactgtaaccctgcttaatttgtttgttagctttgagagggttttggtgaattgtgtagaattttctacatataaattgatgtcatctgtggatggaaactgcctcctttcttcctatttgaatgtcttttatttctttttctttcctgattgctctggctaggacttccagtgctatgttgaacagaaatggtaaaagtaggcatccttccctcgctcctgatcttagggtgaaaactttgagctgcctgcatatatggtgttggctgcaggtttttctttctttctttttatttatttatttttaatttctatttcaataacttttgggatacaagtgtttttttgttacatggacaaattgttagtggtgaactgagattttagtgcacccctcacctaaataatgtacattgtaaccaatatgtagtgttttatccctggcttccctcccaacctccctcttctgagtctccagtgtccatgatatcactctgtatgcctttgtgttctcatagcttagctcccacttataagtgagaacataggatattggttttccactcctgagttacttcagttagaataatggcttccagatccatccaaattgctgcaaatgacattatgtaaatcctgttaatgtctgagtagtattccatggtgtatatataccacattttctttattttattttattgagatagggtctcactctgtcatccagcctggagtgcagcggtgcgatctcggctcactgcagcctccacctcctggtttcaagcgattctcctgcctcagcctcccgagtagctgggactacaggcaccagccaccaagccccactaatttttgttttttcagtacagacggggtttcaccactttggctgggctggtcctgacctcctgacctcaggtgatccacccgcctcagcctccctaagtgctgggattacaggcgtgagccacggtgcctggccttatacaccacgttttctttatccacttgtgagttgatgggcacttaggctggttccacatgtttgcaattgggaattgtgctgctgtgaacatatgtgtgcaagtgtcttcttcatataatgacttcttttcctttgggtagatacccagtagtgggattgctagattgaatgatagaactactttcagctctttaaggaatcaccatactgttttccacagtggttgaactaattgacattcctaccagcagtgtataagcatcctcttttccccacatccataccaacatctattattttttgatttttcaataatggcatccttgcaagagtaaggtggtatctcgttgtggttttaatttgtgtttccctcatgattagtgatgttgagcatttttacctatgttttttggccatttgtacatcttattttgagaatgtccattcatgtcccttacccactttttaatgggattatttgttttttcttgctgatttgtttgagttccttgtcaattctggatattcgcctttgtcaaatgtatgctttgtgaatattttctcccactctgtgggttgtctgtttactctgatgattatttctttctgtgtgcagaagctttttaattcaattaggtcccatttatttatttttgtttttgttgcatttgttttggggctgttagtcatgaattatttgcctaggttgatgtctagaagagtttttccaatgttgtcttctagaatttttatagtttcaggtcttagatttaaggctttgatccatctggagttgatttttgtataaggtgagagatgagcatccagtttcattcacctacatgtggtttgccagtttccccagcaccaattattaagtagggtgacctttttccaatttatgtttttgttttctttgtcaaagatcagttgtctgtacatttttggctttatttctgggttctctattctgttccattggtctatgtgcctactttcatacaagttccatgctgttttggtcactatagccttgtagtataatttgaagtttgcttcaaattagtatagtagtataattagtagtataatttgtttttgcttaggattgctttggctatttgggatcttttttggttacatataatttttttttttttttttttttgatggagtctcactctgttgcctaggctggagtacagtggagtgatctcggctcactgcaacctctgcctcccaggttcaagccatctcctggattccctgcctcagcctcccaagtaactgggattacaggcatgtgccacaatacctggctaattttttttgttgttgtttttgttttttgtatttttaatagagacggagttttgccattttagtcaggctggtctcaaactcctgacctcaagtgatccacccaccttggcctctcaaagtgctgggattacaggcttaagcaaccacacctggctagttccgtataaattttaggattgtttttcctaattctgtgaaaaatgatgttggcattttgaggggaattgccttgaagctgtagattgctttgggcagtattgtcatgttcacaatattgatttttactgtccatgagcatgggatgtgtttctgtttgtttgtgtagtctatgattttcttcagcggggttggctgcaggtttttcacaaatgccctttatccagttgccccaggtggcagtggctttatttaactttcaaggttttcaaagaccacccttcaattagccactgctctctcctgagacagttctgagttaggcaaaacgagttttttttttacccagacaggttaaaacagacaaacaattccttggggaaaaggtctgctccgctccctccagaactatccacccacctggggaacgccggccttcactgtcccaggcaggtttgtaggcaccaccacatgaaaacactaccaggctctcctagcaagtcaaggtcatcatttcctcaagttggcattcagtgggttgcggtgaccctttgactactttccagagagctaacaatgtcggtactaaccgtttgtgtctaattttttggagggcccttggagcttccttttgggttccaggctgcgttctggggtagaggacacagatcccaccactcgatggagcatcaaggtcaccttgggagacccacatgtagggcggaatgtgcatagtaccatccaccccagggtggctcagcacagtcctgccggcagaggcggggcccagggaaccacagctgtgctgagcatgtggtcagcaggccgaggagactttggagaccatggtgccgaaggaaggctactcagacaaagcgagacaggtcacgctgggaaagtcctcccagggaccttgcagtcctgggggtcctgttggcagaatgcccaaggccagagttcatctcacttctccacaaatctgcttccccgctgtctccctcattttataacggacaaccccagttctctgttgcttaggtcaaaaaccctgggcccctggctgccaccttaccctcctccctgtcctccccgcaatagtatgaatgcttgtgcccaccccccccccaattcctacattgaaatcctcacccacaggtgacggtgttagaaggtggggcctttgggaggtggtcaggtcatgaggataaagcctcatgagtgggatcagtgccactgaggctgaggtgggaggattgcttgaggccaggagttcaagaccagcctgggaaacatagcaagaccccatctctgcaaaaaataagttaacatatattagccaagcacagtgccttgtagtcctagctactcaggaagtgtcacttgagtccaggttgaggctacaatgagccatgatggcaccactgagctccagcttgggcaacagaatgagaccctgtctctaaaaaaatataaaaataaaaataaataggccaggcgtggtggctcacgcctgaaatcccagcactttgggaggcggaggcgggcagatcacttgaggtcaggagttcgagaccagcctggctaacatggtgaaaccctgcctctactaaaatacaaaaaaattagccaaggggggtggtgggcatctgtaatcccagctagtcgggaggctgaggcacgagaatcacttgaacctgggaggcggaggttttagtgagccgagatcgcttcactgtactccagcctgggcaacagagtgagactccatctcaaaaaaaaaaaaaggaaaaatataaataaataaacaaataataaataaataaaaaggaacctctcagtccttccaccatgcatatgctgacccagcgagaaaaagaggtctgacccagtgagaaagagaggtctatgaaccaggatgtgtcctcgccgggcactgaacctgccagtgccttgcccttggacttgtgctgtttatgagctgcctggctatggtgtttttttagagcagcccacacggactgagacactctctgtgtcttccagccccactggcctcttggctgcttctcaaacactgagcatgatgccccctccctcccacctttgcactttgcagtccctctgccaggaacaccctttctcctgtagtaattcccacaggccctctcaggagtgtcccccacgcttgctcctatcccccaaccctgcttcacagcctctggtcagccccatgagctgatgattctgtggaaggacagcatggccttgctcagcccctgcagccaaatgcgaaggaagaccacaagtcctttggaggggaggtgcctggccctggggggcctggcatgtgcactgaccaggagagctcctgagtgtgcagctgacactgcctccagggctggtggggcctggctgaggccatccatgggcaggagccctccagcatccagtggccatggccacgccccagccctcatcacgggcctgtgttcttcaggcgtggggaaggcaccgtggggcagagagtggggacccgagggtcaggctcagagtccgggcactggtcactgtgggtctgggatgaggaggacgtccctgaaggacaagtcagggtccctgtaggagaagaaactggagcttggggagcttggatggtggccttcctgtgatcttgagtgagaggcagctcacttcctggagcatcagcctcccatttataaagtggaagaatacttacagcttgtcagacctcacagagctgctggctggggtaatacaccacgcagctcccctggagatagctgccagggtgcacaggagtcaggtcccagggccgtgcagctcatcgagcgtgtccaagggtgtgtgtggcgtgtgatgcattgtgtgtatgtgagtgtgcacgtgtgtgggaatgtggtgtgatgtgtcatgtgtgcacatgcatgtggtgtgtggggtgtgtgcctgtgcatgtgtgtgcatgtgtatgtgtcaggtgtagtgaatgtgtatgtggtttggtggatacatgtgcctgtgcatgggtgtatgtggatgtgcctgtgccgtgtgcatgtggctgtggcatgcatgtgcatgcctatgtgtgcatgtgatgcagttgctgcccgctagggttcctgggctgtgctgtagccagtggtggcatggagggaggcatgggcaacatatacactgcaaaaggccaagagcaccagactgggccctgtgccatgtgcttgctggctccagagccaggatggggtgcttagggctgccactccccctctgagaaggaagcagcgattttaggaagaaagcaggaagcctgtcctgcttggagccataccaggtgatggaggaaggctgtgctgcatggggtcagaggggaacatgccattccctaaagccctgctaccctcgggaatctttaggatatttcattgccctccagaatgtcagggtgtctctcacttgtggaagcagggaggacatctcacttgccaaagcggggagggctcctgcccatggacggcatcagctcactgactcccaacctgggcatctgagcccagctggaggccaggaggaagctagcctcatgagtcacaccattcaggaacccttgggtctgtcctccaagctgagccttggggagcctgtgcatcactgtctggattggacgatgcccatggaaaggcacagatctgcacagatgggaatcccagccagcagattggctgggggcccagccagctgaatgcaaagccccaaagtcggtgaatagcactgggtcctaaacctgatggcaactccagctgcttcaaggaaaggcctatgaacgagtcctgctctggagtccccaaatctatggtctaggagcctggtcatataccagaacttccttcccttttatggctgagtaatattccattgtatggatagaccatattttgtttatccattcactcactgataggcatttgggttttttcaatttcttgactattataaataatgccttttgtgtgaatgtgtattttcagttctctctggcatatacctaggagcagaattgggtcacagaggaactccatgcttaactttttgaggaactgtcaaactattccagagtgtctgcaccattttacattcccatcagcaggatctgaggattctgatttctgcacatcttcatgagcacttgtgattttctgcttgttgtttttgttctagccatcctagtgggtgtgaagcaatgtctcactgaggttttcatttgcatttccctgatatctaaggatgttgagcatcttttcatgtgctcattggccatttgcctctcttccttggagtaatgttattccattcttccacccacattttaattgggttatttgtctttttgtcgttgagttgtaagagtgctttatatagtctgcatacaagtcccttatccaatacatgacttgcaaatattttcccccattctgtgggttgtcttttcacttgcttgatggtgtcctttgatacatgcaagattttaattttgacgaattccaagttatcagttttttatttggttccttggcttttgatgccatatctaagagacaattgcctaacccaagctcacaaagatctactcttcattaggttttttttaaataagagttttagcgttttagtgcttacatctcggtctttaattttcatcgacgatgtgaggcagggatccaatcacattcttttgcatgtggaaatccagttattccagcacaatctgttgcagactgttctttcccctttgaatagtcttggcaactttactgcaaatcagttagccctagatgtatgaatttatctctgtgctctttattctattccattgttccatatgtctgtctttatgccagtgccacactgttttgattattgtagttttgtagtgttttgaaattagaacatgtgagtcctcctgctcgtctttcttttcaaggttattttggctatttggagacaattacagttccatgtgagttttaggattagctcatcaatttctgcaaaaaaagcttagatttttagaaattgtgttgaatgtgtagatcggtttgggaaatattgttctactaatattatgtcttctggtccatgaacataggatatcttcctatttaggtctttaatttctttcatgacattttgtagttttcagcatacaaatcttgcacttattttgttaaatgtattccttaagtattttattatttttgatgctgttgtgaatgaaattgttttattaatctcattttttaattatttgtcactagtgtatagaaacacaaatgaggccaggtgcagtggcttatgcctgtaatcccagcactttgggaggccaagacagggagatcatttgaggtcaggggttcaagaacaccctggccaacatgacaaaaccctgtctctactaaaaatacaaaaattagccaggcatggtggcacatgcctgtagtcccagctactcaggaagctgaggaacaagaatcacttaagcccaggaggcggaggttgcaatgagctgagatcacaccactacactccagcctgggcaacagagtgagactctgtctcaaaaaaacacacacacatacgcacacacacatacacacacaaatgatttttaatatagatcttgtactctgtaaccttgctggagttgttgatcagttctaatgtattttttaatttgcagattcattagggctttctacgtataagatagttttatttcttccttccaatctggatgcagttttttcatttttcttccttaattgccctggccagagcctccagtgccatgatgaatagcagagttgagagtggacaaacagctttcagtctttcaccactggataggatgttagctgcaggtaggcccctcttgcttttaaacttagtagttctagatgtgagaaaaactttgttcacataaataaatagataaaaatgggagcacttagttaccatgcatctctcaattctttgaatttttttagagttatatatgccaaaaatcacatggtggcctatcatcaaaatgtgaaaaaatcctatcagcccatgactcagttaggtcctccttaaagtttgtggaaaacagggaattaaaggtgcctgattttcacaagtcccagtcattatcaatggctcccactcttgctttctgggagaaactccctagggtatggcacactccaggaagatccaggagtctcctggaacaagagctgggacccttgggggtctcccatgggtctggtgtgtgacagcatccctatagcatatgccacacaggtatacatgtggcgcaaatgtacacagtcggtcccctgggaaagcacagagatgcactctgccacacagcatatgcttagaaatgatgtattaagccagtgacctaaggacaatggtgcatgactcggggaatcccaggagggcttcccaggggaggtggcccctgggctgaatcttgaaggattttcttcctttaaaacacacacatatgcagtattttctaggcaccatttaagtgttcgacacaccatggccagttgaatcctcatgcccatctgttgaggccagcagtgcggtgaccctgttttacaaatgaggaagcagaatcactgtgacaaagcagagacatgaaccttggcagcctggctccaaagtccccaggcagaggggacagcccatgccaaggttggggctgacgtgggggtgagcagagccctcaggcaggcccagcagtgacagagcctagctggagcatacagtttaggaatcactggaggaaccccaagcccacagggagggcaggtgcagcccgggaggaagcagagaaggtaggactccagaggatacccggtccccatgtgtgcatccctccgggcagggcggggatggatctgagcggtcactgagaatttctcaatggggctcttggattaatgccgcaggctctccaggggcaagtgggcctcacagatgcccaggtcctgccctaaggtgccagcgttgggttggggcggggagcccccatttccggttgttttcctgctgctatgccggcctctctgcaaagggctgagctcctgctgtgcttctagcctcccctcccatcccacttacctcccctggaccctctccttctccgcttctctgatcctactacccccttctcctcccctttctgatagaggaacacagtctggaacccctcctacctcctcatggcttaaataggtttaagtaggaaaggggaagtcccggctcctccctcctgcctgccatggggactcagaaatgcttggagtcctggtggcctgggaggaaggagcccgccgggtgcctcagagagaggcctgctcaggaggccattgtggaggccctggctgcgctctccataatcatatgattggattagggtcagggcaaccctaatcatgtcaaaggtcaccccaggctttgtggcagtggccacagggtgcctgaccacccctgccaagatggccttgttgaacacagttaaaaaccctcagtcagctgtgaagagaggggcccagcctcttgtgtgtgtgtgcacatgtgagtgtacaccctagcgtgtgcattgtgaggggtgcatgtgtgtgcctatatgtgcacataagccatatatgtgcatgcctgtgtgtatgcatgtgcatgtgtgtgtgtgtgtgtgcatgagtgtgaacatatgaaggaagaagcttcatatcctcacacctcctgctttcatccccatctgccgtccacctggcctggggctggggactggggccaccagactgaggctgggagaaaccatcagtccttggaacatggggctctgtcacagaagctgagcctggtccctgaagagccctctcttctggggtccaaaaggagcaggacattcaacctgcctggggtagaaagcatttgaggaattttaagtgcatggagactgggcacaccgtgcagcttctctgtcccctgccgcaggacccaggcactgggagggctcacttccctgcagagctggagacacctcactcttgacccctggcaaggtaaagctggcaaggacacaggtacagagaaagggcagggacggctgcagtggatgcagcagcccagggcccagcagctggatctcaggcagcacgtggctctgcagagagcctggcctgctctaggccaggtggggcatgtgctccttagagaaggggacagaggccaggagcgggcgaggcctggagcctagggatgccacctgtgcccacatgctcggtgccctctaacatgggctgggcccaggagtccccccgggccctggcacctgccagataggtcggggggagtggagtggcatggggaggtatgcaatctcttgtgcttcccaagtaagtgtgcttcccacaactcccagtggacacttcccagagccctggggtttgcttcttcgtacccagtgtgggtggggcctgcagcagtggccctcccactcagccttcacacaccaccccctcttcaagcatttccagtccccaccccctgccctattctgtgaaccccagggtatccccactcaaagcacacggccagattcctggttggtgccccaggacccctccagccccaaagggtggggagagtaatgaaagggtcctgcgcaccacatgtcagtaagccttgttgggtgccccacaagtcccccttcatctctccaacgtcttccccaggcaggagacagcccagcctcctctcctccccgctgagcccccaggagcccctcgggggtggtccgccacctccctgtgtgtcccctgcctatgagggccggcacaggggtggggcctgcctgctaggacatggggacacacagggcagctctttagggaaccagcgtccccaaagccaggttgcgacccctgaccccccccatcggaaagtgttgccgtttaagatgcgttggggtggggggctcccctggctccagcggcctctctggtatatcattaactctccccagtgggaggggaaccccggccgactccccgccgcgtccggctgggagcacaatatcccagcgacggcgacaagattaagcacaaggggagagtgcaaatgcgcgggcggttcacacgcccttcgcggtgctgaattaaagcgtctgaatggggatttcccctcgcgccggacggcctggcgcgcggcgcatacttccaggttgctatgactggcctgcgctcgcctaatcaccgactagggggaaattcatataaaatatcgccggccattgtgggcctaactcggcgtgacagtggcgcacaaagccggattcaagcgccccagcgggtcagcacggcgcccggccgcgcgggccgcccggcggtgtcaggggccgtggccgcggtggggcgcgggccgcattccgctctcaggtggctccggggccttttgtgcaggccatgattaccaaatgccaccgcgacaccccctcccggccgcctggctcctcctggggccgcaggaatgagggaaggtgggcagcccccgaggggaggcgcccgggcgtcggctccggcgggctccggcggggaccggggcgcgggctgagtccccctgtgtgccccacagcaaagggtcttctccttcccctgtgttcaggcctcagtgggggaaaagggcccacgcgttggctgctctggaagcctgttgtggcctcccgatgggcacgagaaggactttgcttgtcctttttcaggggcgatggtccccagatgacatgacatttggggccacagtgacctgcaggcccctggccagtctggtcaggtggtcctagctgggatccaaggcacccccctcactcagccagccccttccagcagctgtggcgtgagcaggcaggagatgggggcagcaccaggagggagggacccaatgcattcggggtggccactgtccccacaactctatgggtcccaggtatgtggtgggggtgtggtaatcatacagggtgcagcgtgcacggggggctgtgttcgctgtgaccctccatcccccaggatgcctgaaggccagtccctggagtacagggagactgctcctcactggtgcatggaaagggctggcagatcaggcagggggaaggcctgtggggtggggcatttgccctgcagacctggggagagaagctggctgcagtagggtgcacttgggggacagagggcatttttttgtcacagtggaggtgagaacttcccggtggagattcagcagagtttttctcctgggcagtgggcaatgttgggagtctgggcccccagcacccggctggactggccaccatggagtcctgccctcggccagtgcatccctgccagagctgggggtgtccagccagacagtcagcattgccaggggaaagagacgaagccacaggtttccaggggctggggacagcattggagggccccaggaggcatggccaggtgagcatgggtcaacatcaagaagcagactgggcaaaggcggcatcccaagctcctaggaaaggaggtgtcagctgccccaggatggggccacagaggcagaaccatagcccccttcccagactaagcagcccagccaccagctgccagcagccagggccctgaatcccagagcctgtgaccaaggtacccacctccaggaagaggccaggccagagacccaatgaccactgtctactcatggggggatggccatcagcatatcagagacaccctcccaacccccttctcctggcaggctcctgttcagggtcttgtccagggtcccatagagcccttacaaagtcatggccaagctgtccatagccttctttctggtcacagcccagaggaggggtcagcacggaatggaatctgagcttgggagatctcatctcagttgatgcatcagaatcactggagaccctttaagatataggtgccccccaccccagttgaacttgggtccccagggcggccctgcagtgattcattggccccccagccatgaccattgttggaagcctccagtcctaattccctgatgggcttcccagaggggccagcctgggtgaagcccttcagactgagcactctgcctccccgaggagctggatttcattgtcctatggtcgcatttaacaacaatccccaccccctgacccagaactttccctccttcaagttgtttgtccctcagaaaagccactcaggagtcccctctggaccaacaggcatgtcccaggagcccaggagtcccaggctgtccctctcctctcgccctgtatcagcccccacagcctttccacagataggcatgtccccctcagccatgcagtgggggcccagccaggcaggtgggctccctgctcccttgaggctatggccatggaaacgccagccatgggaacacccattggagctgcaggagcccataatgatgagttcagggacctctcttgggacccctctgtctgggctctgcactcactgctgtgcagcctggggcccatggctgaccctctctgagccatcttcctgttggggccacttctctcattagttaatacaaggatcggcttggacctgcttttcccactgtcaccccctaacagggcagcctccatgctatgctgcctcagcagctaccttctgagcaaacacctgtccctgccgaaatgcttcttgggtcacctccccatggtaaggtcagctctgagaggacagaggctgcagccttctttgccacttaaaagacagtcactgcgtaataaatagtggcaactgagcaactttagtgaaatgtgaaagacaaggattttggaatgatttgggcaaatgttgttcaacgtttaagaatttggaaacatggccgggcgcagtggctcatgcctgtaatctcagcagtttgggaggccgagatgggcggatcacgaggtcaggagatcgagaccatcctggctaacacggtgaaaccctttctctactaaaaatacaaaaaaaaattacctgggcatggtggtgggcacctgtagtcccagctactcgggaggctgaggcaggagaatggcgtgaacctgggacgtggagcttgcagtgagccgagatcgcgccactgcactccagcctgggcgacagaacgagactctatctcaaaaaaaaaaaaaaaagaatttggaaacatatccttcctgtttgatgttcaaaggtccttttctgaagttatgatggtagatattttatatatatatatatatatatataatatctactacatatctatatctatctatctatctatctatctatctatcatctatctatcatctatctatatcttttcctgtctcaacaaaataaaagcacttggcagtcctctgttagtccccagatgctctctgatacttgaaaagcccattaaatccaaacctagaaacgaaggatttgttaagatccctctagtccaaaagttctgagatgcaagagacaaaggaaccatcaaagctcatctcatgattccctgcatctgacaactgcactgccctcagctgtgatggagccttgcctggcagctcttctgcctttccctaaatgcccacctcttaccacctagaactccctcaccttctccgactttatccatccatccatcatccattcatccatcatgcacgatccaccatccatcaattcatccatccatccatccaccatccaacatccatcaatctatccatctgtcaatctgccatccatcaatccatcatccatctatccatcaattcatccatccatccatccatccatccatccatccaccatccatcaattcatcatcatccatctatccaccatccctcaatccatcatctatccacccacccatccatctacccattattcatcaccctcccatcccaggcctgcctcagagctcatgttgtcaagccttgctatgtgtccttgtcctctctactgcctcccttgtgaactgtaagctcccaaaagcacatggtttagcacagtcccaggcaaaaaacctaacacacacaccaacaaagcctcccaccagagatagggaaggcttcccctggttcattctccttaccaaggcaaggactctcttctcctgaaagtgggtcatccaacctctgttttattatcaccaggacaggaactccttcaactttcagaaagcctaggttgttagaaattgtatcatattgagcagcagtccactttctggaggatttttttttcttttgatggagtctccctctgttgccaggctggagtgcagtggtgtgacctcggctcactgcaacctccgcctcccgggttcaagcgattctcccacctcagcctcttgagtagctggcactacaggtgcacgccaccatgccccgctgatttttgtatttttagtagagacggggtttcaccatgttggccaggatggtctcaatctcttgacctcgtcatctgcccacctcagcctcccaaagtgctgggattacagctgtgagccaccgcgcccagcctctggaggattttttttactgtggttattgagagtgggcaccttgcttcttattcatctcatattcctcattcagcccagtgcctggctcattagggactctcagatcctggatggatggatggatgatggatggatggtgggtggtggatagatggatgaatggatgatgggtggatgatggatgaatggtgatggatgaatggtgatggatggattagagatggacagatgatgggcaacagataggtgatgaatgtacagatgatgaaggggatgatggatggatgatggttgaatggtggatgggtgatgaattgatgatggatgcatgatgaatggataatgggtgaatggatggatgagtggtggtagatggtggatgatgggtaatggatggacaatggatggattgtggatggatggtggatgatggatgatagatgtatggataatgtatggatatggatgatgaatggatgaatggtggatgatggatgatagatggatgatggatagatgtggatgatggatggatggataatggatgatggatggatgtggatgacagatgatgggtgatgggtggatggatagatgggtggtggatggtggatgattgtacatgatggatagtagatatatggatgatggatggatggatggtgaatggatagatgaatttataagtggatacatggtaggtggtggtagaggatgtatgataggtaatggatagatggatggatggatggatggatggatgatgcacgatagatgaatggatagatggatagatgtggatgacggatggatgaatgaacgaaaggaaggaaagatagataattgatactttggatgaattcagtaaataactgctaaatgagaccacaacaagtttctgggaaagatggttttcccaggtggaagatacttcccttacagaacaattttgttatgcagtttcctttcttcttcctttctccaacaactgattgctgtgttagaataaaagtcttgggcctgaatggggcaggccttaggtggctcaaaaagttcagccaggctccttcccaggtgacttggccaaattggcagcatttgtgtctaagcaccctgcctcccagtagcctgtgtcccattccagtgggaactccgacagtccactctaatgaaggcattttcctgctgactgggatgatttcctggccttctgggatggctggcacttcccacgggcaagatgcctccgtttcacccccatagctgactctgttgtgtcaacaaaagcagaaacccctgacaaaggtgtttgtggtagagaacttggtttccgtggaggctggctgccagaactccagagcctggacgtaagtcctggcctcaggggagccctgagtcagctcctctgtaaacagaggtgactctgggcagtggttcatagcctgcatgcttcaaacacctgtggaaatctgatcaaagcaatggattctctctccagaaagatgcccgtgctcccagacataccccatcgtttgtgctattttgggagggtagtgaacctgctgcagattccctctagaaccttgggtggaatccaacccataggctcaaatctcctgccgctgtgcctgccacttggacattctggggggtcttccttctgcatggtttcaggacattttttaactttttatttattttattttattatttttagattagagatgaggtctcattctgcctcccaggctggagtacaatggtgtgaacacggctcactgcagccttgaagtcctgggctcaagcaatcctcctgcctcagcgtcccaagtagctaggactacagatgcacaccaccatgcccagctcatttatgtttgtttgttttttaagaaagggggtcttgctatgttgcccaggtttaactttttattttgaaataatttcagactttcataaacatcgcaggagtggcactgagagtcctgggtcccctcgtccaacccagtggtgcataactatgccaattgttcaaaactaaatgtgttctattcaccacactctggacgtcactcagctttccttcgtttttctatcaagatcccttttctgtcccagaaccccctcctgggtcccttgttacttttggtgatgccatgcctctggcttctccactcttccctgtccctcatgcccctgagacctctgaggagcacaattaggcattttgcagaacagccatcaatttgggttggtctgatgtctcccgacaattagatgcaggctgtgcattttgggtgagaatacctcaaaggctatatttggccttcatgcatcatccctggagccacaaggtattgtgtgtcccatttcaggcaaggttaactcagtccccagaataaggtggtgtctgccaggcttctcctgtgcacagttaaggtttttcccattgtgcttgataaacactgtgagcagttgcggaaccgcttagagaccttgtggcttcaactttaatgcaggctctctttgccagaacatagggtctcacgcttttctggcctgtggtcttgcagcctgcagcttctacttcagcctcggatgggggtgtctgtcctgggatctgagcctctctgcagagacttcttgtcttcagtcttcacgagtgaattgaaggcctgctccagggttttctcagcctggcagggagctccacctccacatgtgatggaagagaaaatcaaggttcagccagctggtgaccaaactgagcaagaatgagctcttttctgtccaagtggaagccctcagcaccacccgcccttgcccttgagtgtgtctggctattggggctgtttgcctgagttttgataagcagggatctcgaggcccttgttatgggcagggcatgagtgaggcacagagagccctagcctcaggctctggttctcctcttaccagaagctcaggagcaagagggaggggctggccttggagacagactcttgtagtagccaggccgtgaggtgggaaggcagactcagctggggtggggtattcagggtgtgggatgcccaggccatttgggagtgagaaggtccggccaggagggcaggtggagctgtgtgccatgcgtgagctccaggagcacccaggacactcctcaactctacctctcaagctgccctagaagggaagcagggcagatggcaggggaaggggcgctgactagggaggggacgacctgagtcctttaaagacaagaacaggcgctcaggcctggaggcttagagaggaagtgctctgcatccagccacacgtgtattcactcagaggcagtgggttcagcaaaggcccctccaggcctgtctgtgaactgatcagttgtgttagggaagtaacatggggtcaggggtgggggctttaagtttcttggagaggtgcggaggaggtggctgcctagctgctccctgggaaaggaaacagcggaggttgcatgatgggcctgggtgccttagaggggcaagggtgggtctgctctgggtaggctcagaccctgctcattccttgactcagcccacggctcctgcctttcattctggccccaggaaatatctatgggctgggccttgtgctccagattgcaaataaaaggtgagccaaacagtccctgcccctaggcagccgcggctagggagggagtcagtgggcaaatcttcctggttggggaggggcagccaggtgtagaggacacccgatccctggccgctcccctcagagcaggcaggggcacagcaggtccagcctgagccaaggaaggaaccggaaagagcccgaggggaggacaaagggctgagtgcggcctgaggccagggagtggcattgaggtcaggagaggagatagatccagagggggcctggcatggccaaactggcattgggcgaagacctcagcctgcagatagtgtgttgcgagggagaggtgtgcatgtgtgtgcatgcatgtgtttgcatgtgtgtggtgcacatgtggaggggtgtgtgtgtgtgtgcatctgtgtgcatgcatgtgtttgtgtgtggtgggttgtgaatgtatatgtgcatccgtgggaggtgtgcatgtgtgtggtgtgtatggtgtgcatgcatgcatatgtatgtgtgtgcatgtgtctgtgtgtgcattgcacgaggcgtgcatgtgggggttgtgtgtgcatgtatgtgtatggtattcatgtatgtgtatgtgttgtgtggtgtgtgtgtgtatttgtgtgtgtgcatgtgcatggggtggggtgtgtatatgtggggtatgtgcatgcatgtgtgtgcatgtgtatggtatgtgtggtatgcctgcatggtgtgcatgtgtgggggggatgtgcatgtatgtgagtgcatgtgtatgctgtgcttgcatgcatgtgtatatgtgttcatgtatgtagtggggtgtgcatgtgtgcttgtgtgtggtggggtgtgcatgtgtgtgcatgcgtgtgatgtgtgcatgtgtgtggtgtgcatgcctatatgtgtgtgtttgcatgtgtgtgtgcatgtgcatcaggtggggtgtgcatgtgtgtgtggtatgcatgtgtctgtgtgcgcacgcatgtgcgcatgtggctgtgcatgcatgtggtggaaggaggaagctggaggctggggcctcctaggggcctcttcatggcgaggtgggagatggacccacagataagaaccaggaggggcaaattggctgagaggccccagggccacctgggaaggccacagcagcctgggcggctggggctgtttcaggactggacagtctccagccagcaagcagagcccttcctgagctggtggtgggaagtggatacagaagaaatggacagttttcttctgggcttgtggctggatgcagtgggtgtccaggcctgacttggacagggccctagggagggacggggctgctgggacccgccatcagggggctgttggccaatccacagaaaagtcaaccaaagcaggcccgaggggctcagggggctttgtcaacagccagggggatgccagtgcaaagccatagcctcaaataccttccactttgtatgttcttgttatgggagcaacgtgcgttcttctgtgctggctgtgtgtggatgtgtgttgggccgtgtgggagcgtctgagtgtgtgcacactcactcgtgcctttctgtcccagctggcctgggctcaagggcatcacgagccccaggggctgctgtctcggtcctctcctaggcagcctgcaaccacatgcctgtgtccctgagttaggccattcttgcattgctataaagaaacacttgaggctggtaatttataagaaaagatgtttaattggctcagggttctgcaggctgcacaggaagtgtggctcttgcttctgcttctagggaggctaggaagcttccaatcatggcggaaggcaaagggggagcaggcatgtcatgtggcgagagcaggagcgggataaagagtgggggaagaggtgccacacacttttaaacaaccagatcttgcaagaactcactcataatctcgaggacagcaccaagccatgggacccaccccccatgacccagtcacctctaccaggccccaccccagccctggagatcacagttcaacatgagatctaggcagggttaaatatccagactacatcagccccatccacccgaggatgaaagctccctggatgtccaggtggcagaggaggtcacagccccctatgatgactctgttgtgaccctaaggggtccattgcaggcctctgccaaggaggagcaggggacactgtgggacgtagccctgtatccccgccttgtcccatgggaggaccctggctccaggagaacctcaggcctccttctatccccatagagagggcccatcggagctcccttctccctcctgctctcccagggcctcgaggggagagagaaggtcagagccaaggaaaggtggaggctcaggactctcccacaacagaagcagagacatggaggaacctgccccagggcacacctagcccccagaggccaagccgaggctcaggggctccaaagcccaggtgtcttcttgctaggtctgtaagatccctgcccagcagcaggtcaggctctttcctggttggctccctgctagttccccagctcagactgcaatgcttggcaaacagcaggcactctgttcctcacctgtgtcagagtgtgggtccaaagtgagtgcctgtctctttttattttgtttttttgagacaggttctcactctgttgcccaggctggagtgcagtggtgtaatcatacctcactgcagccttgaactcctgaactcaagtgatcttcctgcctcagcctcctgagtagctgggattataggcccccagccctgagtgtcttttatcaatggaagcagggcctggccaggcccaccccctctcctcatgcccttgcagaagtgtctgcatacacccacccccaagacacagctcattctttcaacctgtctggggaagcctggctggggtcctggcctctgcaaagcccacaccaccgctcattcccatccctctgatcctagcctccagagctttctcctaaattccagccctcccctaccacccttctgcacaagcaatgccacttccccaacttggcctctatttccccatttggggaagaaggaagctgtgtacaaggacccaggcagctccaatgtcagcagcggcagacaccctgcagccttccaagctggaggcaggggcatttggggcactggggctggccctggggaggcgggcactggaagtcactggtgttgagaagattccagaagaggcagctgtaccgctgagccatgcaagtgtcggtgcttggggtggaggaaggcaatggcaagtggcacagcagaggtgggcggtgtgtggggtggagccacactctggggtctgcaccccaggctatctgggcagcagaaggaattagctcttgtctggttttacctgccttcgttcagttgtatgattattttgagatcctttgtgctatttttcttgttattcctaaattaaatgctgttacagacttgccactgctttttaaccatccctgttaatggacattggggtacttccagtttgtggcttgtgtgaacatttgcttacaagtctttgcacagacacgggtttcctctggggcaaacctaacggctggtggacgtttacccttgaagacactgccaaagtgcctcccaaggggactgcacctttcccctccatccagctgtgaacaagggtcagggtctgatttctccacatccttgccaacacttgctactctttgactctttgattgcagccatccccgtaggtgtgaggcggccccttattgggttttttgatttgcacatccccaggatgggtgatgtcgaccatctttccaggtgcatgctggccttccttgtgccttttttttaaagacagggtcttgctctatcacccatgctggagtgtgactatagctcactgcagcctcaaactcctgggctctagcaatcctcccacctccgcttcctgaatagctgggactacatgcacacaccactgcaccttgctaattttaacatttttttgtagagatggggtcttgctacattgccaaggctggtctcaaactcctgggctcaagcaatcctcccacctctgcctcccaaagggctgggattacagatgtaagccaccttgccagctgtatgttttttaagacagggctggagtgcagtggtgctatcctggctcactgcagcctccacttcctgggctcaagtgatcctcccgcctcagcctcccaagtagttggggccacatccagttaatatttttagtttttgtagagatggggtcttgctatgttgaaaaggctgtcctggtctcaagcagtcctcctactgtgcctctcaaagtgctgggattacaggcatgagccactgtacttagccaaagttgcttgttaaaaagagcctggtaccaacctcccctctctcacttctgtcaccatgtaatttcttgcacacactggttcccctttacgccccctttcccttctgccacaagtggaaacagcctgaggcccttgccagaggcagttgctggagccatgcttctgtgtagcctgtagatccgtgaaccaagtaagcctctttgccttatacaccacccaacctcacgagttcctttataacaatgcaaatgggctaagacccctgacctgcccaaggcggtcctttgagctgagccctgttaaccctgcatctctcctctctctacagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggtaggttcgccgcccgcaagggtgcttgggaaaaaggagcctcctcagcagggtgtgtgccctggttccttggggcatatggcccggtgaggcaggatggtggccaggctgagggtcttctcgacccctgcctggggtgtgcgaagcttagcaccatccagctacaccacagcatccagtgcgctcctggggatggcgagcccacctgtggactggggtagccaagaaggagtgatgaggcaaaggcctggtcaacaggagccccggcagagcccagggagggagacagccaggcagccacagagacggggaggaattctgcaatgaggaaatgcaggcacacaaggtgacccgatgtcaaggacagctggcagtaatttagggggagggaggctgggagagcctcccaggcagcctggaggtgaaagacaacaagcgacttggtgggcagagcacagagtgtaatggaacaaagagcatcttgatctgcagaggccaacccaaaccaagccgtgtaaagcttcgtgagcctgtgtcttattctgtctgtgctgctacaacaaaataccttagactggataatttataaacaatgggagtttagtactcacagttctggagactgggaagtccaaggtcatggtactagcagataccttgtccggtgagggcctgctcctcatggatgatgccttctgtgtcctcacccagggtgtggatcgctctggggttacttttataagggcattgttttaggccattcttgcattgctacccgagactgggtaatttatgaagaaaagaggtttaattggctcatggatctgcaggctgcacaagcttggtaacagcatctgctcagcttcttgggaggcctcagggagattttacacatggcagaagtggagtggtagcaggcacgtcacatgggccagagcaggagcaaggaagacagagtgggggagaggtcgccacgcacagatcttgtgtgaactcactcattatcatgaggacagcacaagccattcatgagggatctgcccccataacccaaacacctcctaccaggtcccacgcccaacactggggattacacttcaacatgaaatttggagggaacacagatccaaaccgtatcaggcacgaatcccattcacgatgctccaccctcatgacttgacttgatcaccttctaaaggccctacctcttaatgctgtcaccttgagggtaaagatttctttctgggggggtggggacacagggtcttgctggatacagtggcaccatctcagctcactgcagcctccacgtcccgggttcaagcgattctcctgcctcagccttctgagtagctgggactataggcgcatgccaccacacctggctaatttttgtatttttagtggagatagggtttcaccatgttggccaggctggtcttgagcttttggcctcaagtgatccacccacctcggcctcccaaagtgctgtgattacaggtgtgagccaccatgcccagccgagggtaaagattttaacccatgaatttttgaggaacacaaacattcagaccacagcagcttgctagaaaggatgtggtcagaagatcagtggatggccaagggaggaaagatggctgatgggcagtgacgggcgtaaggaccaagtggcgtccacgggatttaacaacatgaagatggcagctgaccttggctgtagaatcaggggaccacagaggggtgacgagtgaacaggggatattcaccttttaacagtgaggaactagataactcagactaatcttcctgcagaagacaacttcagatgcaggatgaactataaaaagcaccctgttaaaagtgtggagtccccataattacccaattcatgatagatgaggcagtgcagtgccatgggagaaatgggcttttcaataaatggtgctcagtcaaccgggtggtgctatggtctgaatgtgtctcccaaaattcgtatgttgtaagcttgatctccagtgcaacagtctggagaggtgggacctaataagaggtgtttaggtgatgagggccttgccctcataaagggaccaatgctgctgtaaaagggcttgcagaagagggtctctctctctctctctttctattactttcctgccatatgaggacatgatgttcctcccttctggaggacatggcattcattcagggtgccctcttggaagcagataaaccaagccctaacctgtcagcaccttgatcttagatttcccagcctcccaaaccatgaaagaatacatttatgaattactcagtctcaggtgttacgttgtagcaatacagcattgactaagacagatagcaacatggaaaaaaaataaccctggcttgctacctcacaccatctgtaaaaatcaattacaaatcccagtgggacaggtaaaacaataaaacttttacaagaaaatatagaatatctttgtgaccttagagtaggcaaaggtgtcttaaacagtccaaaaaagcactcacattgaaagagaagtggaataacatagactatattcaaattaagaactttcatccataaaaagacaccactatgggactgaaaaggcaacccatagaggacacattcacatacatacatccacactcacatatgcagcaaatgtagagaagctacagtaggaaaagaactctgcagactaagaaaaaaaagatagacaaaccaatgggaaaattggccaaaaaattaaaagccatgttatgaaagaaaatatagaaattccactacctatacaaaaggtgctcaatgttatgagtcatcaagaaaatgctgtgagaacctatgtcctggaaagagagaggaggatgggggtgtctgagacactggtgttctggggcaggtaatttgtaaaattttgtatattttgcacttatgacacatatatatttttgtatgtctattatacttccataaaatgatttttaagtgtcaaataactgaccatctagtgaggaattagcagcccctgatccaagagaagatcccaagtctggtacctggggtagcttttgtctaggggccatttgctgacctggaagagactacagaggttgcactgcatttccagcagactcacagagctaaggggcccaccaagggtgccatctctggtaaatccttcctcagtgtaggctgtgaccctgaagagcaaagccaagccagaagtagtcttgtcctgttcacatgggcagactagaaatctctcaaaacctgaacttggattaaggtaatcccaaattgctggtactcccatacacctggaaaaagcagacaaaatcctctttggagaaggatgatatccctcctctaagcctataaatgtttctataataattttttagaaaacacaatgttggctgggcgtggtggctcacacctataatcccagcactttgggaggccgaggtgggcggatcgtgaggtcaggagattgaaaccatcctggctaacatggtgaaacccggtctctactaaaaaataacaaaaaaaattagccaggcgtggtggcaggtgcctgtagtcccagctacttgggaggccgaggcaggagaatggcgtgaacccaggaggcggagcttgcagtgagccaagatcgcaccactgcactccagcctgggcgacagagtgagactctgtctcaaaaaaaaaaaaaaaaaaagaaaacacaatgtccagcacacaatcaaagataatctatcacatgatctgatgacacagtgagttaaaccagaaaaaaaaaaaaaaacacaagtacacagggaattcagacaatggaattattagacacagactttgaggggaaaaatgcttacttaggttcacaaagctaaaacacaagtgtgaacattgcatcaggaaactagaaactataaaaattatataataggctgggcacggtggctcgcacctgtgatcccagcactttgggaggccgaggcgagttcgagactagcctgaccaacatggagaattcccgtctctactaaaaatacaaaattagccgggcgtggtagtgcacgcctgtaatcccagctacttgggaggctgagccaggagaatcacttgaatccaggaggcggaggttgtggtgagctgagagtgcaccattacactccagcctgggcagttttttttttggaaactgggagttttttttggaaactccgtcccaaaaaaaaaaaaaaaaaaaaaatatatatatatatatatatatatatatatatatatatatacacacacacaatagatttggaaaataattacacagaaattgcagaactgaagaacaaataaggacttccagttaaagatgagaagctgaacacttccgtctgcactctcctggaacccactaaaataacaataaattaattttaaaataaatagatatgtagagataaatataaataaaatataaatagatacaggtagggacaggtaatagtagatatagatgatagatataaatggatataaatagtgcatagagattatacatagatatagatgctaatacagataggatggatggataaatagattagatagatggatgaatagatagagatggatactcatgagaatacagaaaataaagaggaaacaatggtaacaaaactttgaaagctaaaagcagatagatgaatactcaagcagactcaagaaaactgagtcttaagccagtagagaagaaatttgagaaccagtctaggaattcctagtgtctgatatcttgagaagttgagataaatatggggctgaaaacaggaagattggttgaaagatgactttcagggtactttatagcccactcactccactacccaactctttgtagccaggcagcagcctctcctttccctgttgctgaagcctggaggtttgttttctgcaaagcacaggtctctgatctgagggacgccaagcacatctcagagtgaaccttccaaagtgaaaattttctctctacatatggaagttcatgcctttctctctcctcctgatttcctaatgctagctgtgaaccctagttatcctccaggcaagaggatggaagattctgctctggggactctgaccaactcaaaagaggagacttcaagacagttacctgtggaaggtcccaataaagtgatgcagctagatcactctatagagaggaccaaagttgacaagtctctcccatgtacaggaacttccaataagatttttagtgtcccatttttaaatacgagcagacagccaaggatcatcagacctctgaggaaggactctaacaacaataatggcaaagtccaaaacaaacaaactcaaacaaaatttatgggaaagagacattgtaaagagagatgaaacttcgaaagatgatcattaatatccccaaaagataaaacactatatccatgaaattggaacaggatggtaattttaaacattcaggttacaaaagagctcttagaaattaaaaatatgataacagaagcaaaatcctcaaattgaaagatagttgagataccctcccacaagacagaaagaaaaaaaagacaaagagattaaaaataagagcaaggagaagatttggaggatctgtccaagaaagacaatgacaaacaaaaagaggaggcagtcagcaaagaaacaaggcaggaagcttcctcagaactgtggagcacaggttgcagaccaaacaggccactaagtgacgagaacaacagaagaaaaagatctacttcaagacacactgctgtgaagctcagagcctactgcacagaacagccctccaagctgccaaggagaatgtttgggcttcaggatcaggaatcaaaatagtaccagacttttcgggagcaataatgaaagctagaagaaaacagtaataatactttttgaactccaagatgtaaaaatgattttaagccaagaattcacttcccagcaaaactatcaattaaatgagatagtagaaaagattgtttttagacatggacatttcaaaaaatttacaaggccttttctgggaaaaaaaaatctgcaagaaaatgaaattgatagaatagctgatgtgtttggacatcttgaagagaatatgtagataagtaagggagaatttgaggctgaatcagttacaggtacattgataacaccaactacaaaaagtcatttaggaaaagaaaagtcatcataatatatgacacttaaagtagtcccaataccaccagcagtgaatattgatgtgaaattaagctagtttttagggcaggaggggttggtgcttgggaagtgtgcatcagtgtggtggagtaaggagagaaaactaactgccacccaccatggctagaggccaataaataatgcctaatgctgaaaaatcaagaggtgtcaagacaagtgtgttaacagagttgtagacattgcaaggggctgcatgtaggaccagaattcctgtttatctaaacaggtcttggaaactgttggactcttccaagtaagcacctatataactttgatccaatataaaactaaaacaaaagaggaaataaaatggatattagataaactagactgggcagggcgagggatatgttactctacagatgcccataggaaacagtcaatatcagagggaggagttcaagaaagagccagaaggggacgaggaggaggcaggattgggacccagagcccagttgaagccttagattagaactgtccaatagaaatagaatgggagccacaaatggctcatagattattataatttgtcccacaaatgacacaaagatcattataaattttctagtagccacatttaaagagtaaacaggtaaaacaagtttttttggttttgatttggtttggtttggtttgagacagactctcgccctgtagcccaggctggatggagtgcagtggcgcaatctccgctcactgctgcctccccctcctggctcaagcaattctgcctctgcctcccaagtagctgggatcacaggttcccgccaccacgcctaatttttgtatttttaatagacacgtggctttgcctcaagtgagccacccgccttggcctcccaaagtgctgggattacaggcatgagccaccatgcccggccagaaacaaattttaataccaaatttgatttaactcaggatagccaacatgctatcatttcaataatgtagtcagtattaaaattatgaatgagctgtttctcatccttttcttacactaagtcttgggaatccagcatgcagttggcacgtatagcatttctgaattcacactgccatgcctcatgggctcctgtctgtccagtggctgccacagtgcagtgccacctagactgttctgatgttcacatgccccttcacgctcacccctaccccttccccaaagaaagaagggaaaagaagctgagttctacactgcccataggggaaaccgttcgctcctcagcgaggtcctgcccggtcccccaacagccttatgtcccaacattgccttcctcttcctctgcagtccccatacagtgaccagcttcctgggccactctctttactcatgctcaggactcgtgcctttccacccagccgtatacacctctgggcagcgtgcctgagtcctcagggtcagaaggaacgcctatccccctgcatccctgcactctgactgctgtggctcttcgtgtatggcatcccacgctgcagctctgtccttcattcgctccaccctagacagtgtagaagtactcagctaggagacgggaagaggggagccccccaagccctgacctgggaaggcttgggtctggcaagggagcaggcaccagtatctgcaccataggaagggggtggccctggggccctgcctgggagtctgccccctctgcccgggggctttatggagcaggtaggctgcaggcgacatgtaatgctgtttcctcggggagacgcaccagggggccgccctgacgctggctcctgcgcgtgccccgcaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagccagtgtctcctctctggtggctgggctgctcctgaatgaggcggagctccaggatggggaggggctctgcgttggcttctccctggggacggggctcccctggacagaggcggggctacagattgggcggggcttctcttgggtgggacagggcttctcctgcgggggcgaggcccctcccagtaagggcgtggctctgggtgggcggggcactaggtaggcttctacctgcaggcggggctcctcctgaaggaggcggggctctaggatggggcacggctctggggtaggctgctccctgagggcggagcgcctccttaggagtggggttttatggtggatgaggcttcttcctggatggggcagagcttctcctgaccagggcaaggccccttccacgggggctgtggctctgggtgggcgtggcctgcataggctccttcctgtgggtggggcttctctgggaccaggctccaatggggcggggcttctctccgcgggtgggactcttccctgggaaccgccctcctgattaaggcgtggcttctgcaggaatcccggctccagagcaggaaattcagcccaccagccacctcatccccaaccccctgtaaggttccatccacccctgcgtcgagctgggaaggttccatgaagcgagtcgggtccccaacccgtgcccctgggatccgagggcccctctccaagcgcctggctttggaatgctccaggcgcgccgacgcctgtgccaccccttcctcagcctggggtttgaccacccacctgaccaggggccctacctggggaaagcctgaagggcctcccagcccccaaccccaagaccaagcttagtcctgggagaggacagggacttcgcagaggcaagcgaccgaggccctcccaaagaggcccgccctgcccgggctcccacaccgtcaggtactcctgccagggaactggcctgctgcgccccaggccccgcccgtctctgctctgctcagctgcgcccccttctttgcagctgcccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgcccctcagcctctgccactgtgaaccggctcccaccctcaaggtgcggggagaagaagcggccaggcggggcgccccaagagcccaaaagagggcacaccgccatcctctgcctcaaattctgcgtttttggttttaatgttatatctgatgctgctatatccactgtccaacggagttagacgaatagatgtgttgtgttttttttcccttttctttctatgaaagaaattgttttagtcatagcttgtgggtttcaaacaatgggaaaagtgaaaaaagagaaacaagccatcaaggctgtggtctgggctggatgtttggtggtgggtcagcacggtgttgaaagagtagagaagatgcccactcaggggctcagggcctgggtccgggggcagggggatgccccagggccgtgatgggcaggggacctccagagctggaattccatggggaaggaataaggatagccaagctgaggaaatgagggaacggccactggcaccaaggcctggagcagagtagagcctctgacagggagagagcagcaggcacctggaggccccaggtaggcagccctaaggtaagggggttggccgagcccccaacaagtcagtagagcagcaagacgcccaccacctcccctcccgcagagcctgtactcactcagctgataccttagcaccagctatggatgtgccccctctctaggtttggggacagtggcctggtggtataggatcagctggatcccagcaggaccttgggatgggactggccatcaggagttcctctgggatcctcacctcgtggggctgtgcacaggggtgccccctgtgcgagcccccatctcctttccccagccaaggaaggcagggagagcccctggaacaggtgagccatcctgccgacaggagccctcatgaggccttactaggggtgctgggtgtgcctctggaaacaggcagcaggagcccaagggctgtctcaaggccatgccttccccgtcccagccccaccaaggatctctgctccactctctgccctcccatgcctgtccagtccccatgcccatctctgggccctgactggatgctcagccagaccttcagggcagtgaatgccaagggaagaagctatggagatggggcagccaggagcagccagtgtacctgcctgcaggccgggcccaacacagccaccatactcaagccatgtgcacgccggcggggagccaggccttcatagaacaggaatggctggccatcccccagtgtgccccatggtaggaaggggggtcaaggcagccccaggagtggggtgggtgcaccagcgtcctaggcatggaggtcatgggaacacaatccccaggcctcaagagccagagaagggccagccccaggcaggagcataacccctccaggaacagtgtcccctgaccctgccacgcacctgctgtcctggaccctgagggcacaggcccagggcatgcagctaaggctgggcagaggggcctgagggactgctgacctccctccccacaccctcaccccaaggtgccctcacggctgcccagcaggacaccctctctaggccacactgggcctggccaccctctctgggcaccattttcaagctagagcccttgctcctgacctttgtgacgggtccactagaagcctggccttcccaaaccccccacctgcccctcactatccacttcctaggtccccctggtcctgtgcctcatccacctccctaaggctacagatccagcccggcccccaccagagccctgctcctccccaccccaggtcaggtctttccaccccactcactgcccagggcctcctcacagtgctggcatagtgaagcctcacagcacccacggagcaagagagcataccgccctctaccataccctgctggctgcacagggcttctgcccaggtctggctgctgcccaacccctgcctgcagcagccttgcagaacctcatgaagcagaggctcccacccgaggacagtcaaggaggccaggcccaggaggggatgagggctgaagtgtggctgctggggtggttgtagggagggagtgtttctccagagccaccagccatgggagcacagagctacccagggcctgtcagggccaagggagaagggacccggtccaggactctggaggtcaggcacccctctcctttgcctcccaaaactgtgcctcagcttccatgcacccccaaggtctggtgggcaccccaatatcactcccagccatggcctcattggctggggccgtgacacccatcccaggtgggtcacccactgctccagggcagccctgaccctccataggcagggccactggaattcccggggggcaccaagggcagctgtgctaccgtctacaaagagggagccagtgactaagggcataggacccctgtggtgcatcaccagtggggggaccccaagcccgctcaacccgccaggccttcctgagcaatagccataaagggtcagtccttgggggagggcagtgccccacaggagcccctggtcagccccagcccatgggcacagtgcctcttagtcgggacccaggtcacagccaccctaattagcacctactgggccccagtgccaggggcattgcagatgacagacactgacccagccgggaggcggctgggcaggcagagggcacgagatcatgggcatggctgccaggttgcagggacctgagcagtcagcataggccggggcaagagcccacacccagatccaggccagggccaactcggggctcaaagctgaggtaggccccagagagatccccagcacccaggctctatctccgctgctggggcccagagaggagatggtgctggcctgaggacacacagtctgctggagacccagggggccatctgggtggagagccgaaggtccccttgcaggccaggtgtgaaggaccactgtgaagatggtctcagctgtccccatccccactgtggccctagcacagacagagggtgaccccacaagaggttctggatgtgtttctgaggaatgggggtcggctggtctgcagcccctggggccataggacacaccccagtttataggcaatgggggctgggaggtgaaacgctcaactcaccctgtgtaggagcaaggcccactcctgcctgggcctcagtttcttttctatgtaaaaggcagtgagccaagggaggtcttccctcccacgggcctgctggcttgggctgctgcacctggtgcatggcctccctcacctgccaagggcaggcatcaccccgggagccccagcccccaacccccccggagcctgcaggcctccaagtcagtctcagaagccaccccccagggcgtttatagcccatcctgcccacccgccctgcagagggaggaaatgcgcctggtgggcctgttcgcaggtagttgagacaggacaggaataaccatataaaaggcccggaggtagtggggccccaccccaccagggctcccctgcccagccccctgcacatctcaccctccatgctttgaagtcctggaggggtgtggccagcccccaacttgggcactcctcctctctctgacactcccctcctgacacctactttcaggatcctggggcctcagtttcctcccttcaaggaggatcctggaggctgccagcctggcctccccaggacgctgggaccgcagcaggcaggtgcaaggccagctccaggtccccatgcccgacatggggtgggggtgaggccctacttactgactgcccagtgcccgtccccagtgctgagcctgggcttggtgtgccccggggccctgccagccctggcccttgcccctgctccatcatgggtcctctctggaccatgctgggtcggtgggggcctgagaggctcatcagtggagacggcccctcccctctcaaccgggttccacacccagcctaactcccctagtgtgggcctggcgtcaccatcctccagtgggtgggagaggagagggcagagggcaggacccctgaccaagctctgggcctgtcagctcccaggggcacagctgctgccccaggagttgacacagcccaaaagatgaccttggctcagggggtcctcggcctgtccaaggttggaatgtggtctgtcacggcctccagggaactccaggacacaggctgagcagccaggaatgaattcagggcttccccgcagtcccttgggctatcctcaagaaggaacattctagaagcttcttgttgggggaaggcgaggcctggggaaagatgcccctgaagaggaagagaagctgggacttgggggtcccacaccccagtccttggagggggtcctccaaggaccagggcattgcagagatgatgtcaggcccagcttgccgtccaggcctcaatacgcctgtttgtgtatggggtggagtgtctgagacgtcgtcagacatcagccactcctaagccctagcaaggctgccctggccacaggtcccccgataaggtgaccctgtaacttcattccctggagccttcctccagcctggccctccccgatgtttcagccggatggatacctccgccctttcccctgcagatagcctctcaccaggaattacaatcagggccatgcactcagagcctggcatcatcagagtgggggacccaggtccccgagcccagggcggggcttggtgggtggactgtccatcctgcactgaagcctggagtgacaagccatgagagaaagtccacggggagaaccagagggggactcctgggatgcggagccagcctctgccctctgccaggctctgtcctgagaccctgcccttccatctgtaggccctgccattcctgggctactggcagagagggtagaagacgttggagcaccctgggctgcgggcccaggtaaaacaagtacagaccctgagcctggactgagctgaggatgtgccccatcctggaatataagaagacacggccctgccctggggtctgggagacacagcctcaacctgggtcctgggggaagcagtcccaccctggggtccagctgtcgacctgggatgagccctagttccctctgccctacagtggcaccaccgccccccacaggccccaccccctcccctggacagctcagccctctttcccagtctcctcccctcatggatccccctttctgcctctgaacccctagggatggatgcctcaggacagggcactcaggtccctgtcggagtcttgcttggatctggagccctggatcccaggggcatgacctcctggagcaacttccaaggtctgggggactaggtcagtgttcctccctgcagaactggactgctgtcagtggctgccttcgggatcatctgggagggcttccaggaggaggtgagcatggggacacttcctagggctccaacatcctcctgtaattctgagattgcatccctgcagacgccaggaaaaaagtgggttcccatggcagccggggagccctcagaaggggccccactgaagcctgggagccaccacccgcctgcctggccaggatgggagctcagcagaaggtgctaattgctgtttagctccaagctgactccttgctctctttttgtctctctctctctctctcttttttttttttacttgagcctctagagcacacagtaaacagtcatttggctcttggggccctgcaaattggtgtttatggtgcgaagatgaggaggatttgtccacccaaacacaggctggctgggagggaggaagcaggggtgggacatcccatccaggcccagctcggggaagcctccttcagactgaggagctgtggtctcacaagcaggggactgtgattaacccaggagagcttctaggaagaggtgaggcatccgcggcaaaaagacctcctccaggggaagctgcaaaggctccaccataccctcaggtgcccatggggagccctgccctccagacccagctgggatcagagcttcttggctgggtcacagcctgggtctccttccaacagcacacctcacctgcccacccagcagccagctgcagaattacaaactggaatgccaaggcccggtctcctggcaggagcaggaaacacagaagtccaggcgcaggcatatgggctggatgtgtggctgggaaaagtggatttccccaggtatctccccctcgttcacgaacctgaggtgggcagactatgccccagagccagtgcccgggctcctgtcttcttctgctgcccaaactcaccccaccatggcagaaggccaagaggccagactggcattgccctctccccactccatccaaggtctggcatgaggcaccggccctgcagtgccactcctcaatggagcaggcagcctgcagcaccaacaccaaaggctggggaggacatgggatgctggacatgggaaccatcaggagtgtgcaggaggggcagtgttggcgggtagtgtagaccagaatgtacagggcatgtagaagaatggatagtgtagacagggtagtgcagaggaatagcacaggtgggatagtgtagggggatagtgtggggggataatgtagggggtatagtgtagagggatagtgtagggggatagtgtggggggataatgtagggggtatagtgtagagggatcgtgtagggggaatagcgtaggggggatagtgtagagggatagtgtaggggatagtgtatggggatagtgtaaggaggatagcatgggggatagtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggggtataatgtaggggtatagtgtaggtggataatattgggggacagtttagggggagagtgtagggtgacattgcaggggtgatagtgtagagggatagtgtagaaggatagagtacgggggatagtgtaggcaggagagtataggggcatagtgtaggggagatagtgtagggcaatagcgtagggtgatattgcccaggctatagtatagggggtgctgtagagggatagtgtaggggaggaaagtgtaggggggatggtgtagagcgatagtataggtgatagtataaagggatagtgtagtggggatagtgtaggggaacagtgcaggggggatactgtacagggatagtatgggggagagtgtaggtggatagtgaaggcggatagtgtggggcatagtgcaggtagatagtgtaggacaatagtgtaggtgatagtgtagagggatagtgtagtggggatagtggaagggaatagtgtaggtggatagtgaaggggaatagtgtggggcatagtgtagagggatagtgtaggggatagtgcaggggtcacagtgctgttggggtgccaaggcaccgtgctcagtgtccatgatggtttgtgtgctttgtgtctggagcatcacgtggggaccctgcagacacagagtcctggtcaccctccctgtttctgtgtcacttggcctgcctcaggtggagggtcagaggtcagtgtgttccccgttagtgtgggcactttcctgggctgtgcctaaccataggtggctctgctcaggccatcctggcccagtgctgcctaaaggtgtgcagctggccaccacccactctgaat

SEQ ID NO: 1071 - DNA, 1555 bp, Homo sapiens
cggcgatggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagctagtgtctcctctctggtggctgggctgctcctgaatgaggcggagctccaggatggggaggggctctgcgttggcttctccctggggacggggctcccctggacagaggcggggctacagattgggcggggcttctcttgggtgggacagggcttctcctgcgggggcgaggcccctcccagtaagggcgtggctctgggtgggcggggcactaggtaggcttctacctgcaggcggggctcctcctgaaggaggcggggctctaggatggggcacggctctggggtaggctgctccctgagggcg

SEQ ID NO: 1072 - DNA, 1059 bp, Homo sapiens
atggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtag

SEQ ID NO: 1073 - DNA, 21565 bp, Mus musculus
  misc_feature (1217)..(1236): "n" at positions 1217 thru 1236 can be any base
  misc_feature (3121)..(3140): "n" at positions 3121 thru 3140 can be any base
  misc_feature (5706)..(5725): "n" at positions 5706 thru 5725 can be any base
tctcacttcacctgggtcttcctcaggacaggggcctgcttggaagagctttgtgagtgaagtggctcatccagtgagaaagaagagacagccctgcctgggaacaccctaggagcgagcttagcagactgcagataagggttcctccaccctagagacaccctctgactgtgggagggacttaaggattttctgactgcactaatcttgtcctagtttgtgaactcggcaaggcacagtggaccaaactgaaaaagcaggtacaggaatgactaaggctgagttgagaaactcctcacggctaggaccagggcctgctaggatccacagatggatggttggccaactttcagtcatcctcatgagataacattctgtctgggaaggtcaaggggtttgtgagcaagaagtagtacaggttgtatcctgtctcagtcaatgttctattgctgtgaatagacaccatgcccactctttacaaaagaaagcacttaattggagcttgcttactgtgtcaggggtgttgtctattatcaccatagcgaggagcacggcaacacaggcaagcagacaggacgctggggaagtagcggagagtcctgcatctggacccacaggcaagcaggaagagagtgacactgggtctcgcttggacctttgatgcctcaaagctcacccctcagtgacacacttctttgaactgaaagaacctagtgggaaaacccccactcaatttctgttcagtgcacacccaagaatcacgaacagacgaccatcttgatgtaaaagcatgaggtagtttaatgacggagctccgggccgacacatatctcccacaggagacagaggtgtggaccacatggtggagccataatggcggagctccggttcaaaacgtatctcacacaggagacagtggtttcgaccatgaggcttggaagctaggggcttttatagaaaagggggtagggctgggggaggaattagcgaggttttacatgattggtctatttaaatatcaacagactgtcagaagggcgggagatagggaggcactaggccagtcaggacatgtaaggcctgggcatgtcctggcctgttctgctatgttctcagccccaggttttaaagctcacaaacaactctttgggctattttgacataaattacatgaattcacatgtctcaagttttatttcctttcagaacaaggctannnnnnnnnnnnnnnnnnnncctgtccttaccctgaagaccatcctgtccctgaagacatactgtcctggtccctgtaactccctggggggcagccgaagtaggtgtttctatacatgaagagaggacagaaagttctacataagacaacctcagcaaacttcaccctcactgaacacatgtctagaatcccaccaaggtgggacaggctcagtagtaacagaactccagcccataataaagccattggcacaagcctaagtcacaccatggatgtcactgtcagcccatgacaagggaccagaaagagtagcacaattgagttggagatgtggttcttagcatgtatgaagccgtaggtttgatccttagtacgcatagccctggtatggcggtgcacagcgccaatctgtactcagaagcagaggcaggaggtaggaggattagatgttcatccttagctactcagtaagttctagaccaccctgggctccatcagaccctggtttgtttgtttgtttgaatttcttgttaccattgctctggaagggtagatgtttcaaacccaagaagacagatgccggtggatggattctgaactgtttcccaacagcatccgaagggtggttatagaaacatattcagaaatagaaaacagtgggggtgggggcttccgcaggggcctgtggtgtacctgttcaagcggcactaggatctgaacatctagtcaggtcacaaggtctgtgaggtctggactgaggcagaggtcactggccacgcaagtaagatctgagtcctttgttacagaggctacagagagacaataggaagattcccacacatgacttggatggcctaggaatgaatgagtgaacaggaagtgctgagccaccagtggagtgggatcacagatttgtgaagagagacagcacctgtccctctcatgtggtgtcacaagtggactgactaaattaaggaattgaaggatagaccaagagttcagcacatgagatcaatctgtgtagaaactcctggaatcactgcctgggtcctgagatcactgccttaaggagggttctccttggggacgtggattccaatgtcagtcataactcctagaagcttatcactcactctcagattcctcttagttgcacagcattaagggagccagccagactcctctacacaatgcttcaaaggagactaggctttgtgcctgagtaatgacagagaccttagaactcttgagagctatatacatccataatcaattaaggtctcttctgatgtaacttgtcttccaggtccaaaggaggggcctgttctcatgaataatggctcctcactcactgagaccctgccatgagccacacgtggtgctagacacaagatgaagttctctgccctcaggtccttcatagtgacagcttgacaggaattcagatcattggagcagcccaagagcaagtatgaaaaagatattctaactacaaggaagacatctccatccttggctactggtcctgcccccaggtaagaccagggaggaaagagaaagctaaggcctcagatactgagcaacagcctggccattgcctgctggatggtttctgtcttgggaacaccccaaactgtggattcccagaccaccaaatgttaccattgttgtgttgagagagagagagagagagagagagagagagagagagagagagagaatatgatgtttggtggaagtgcagtcaggtgtgggtggaagatggtgcctctgagggcccatgctgagccatcccttccccatgagggtccagccatagatggtatagtatagtacagtatagtataatatagtatagaatagagtttattcagggcatggggagggggggttaagagggtagtnnnnnnnnnnnnnnnnnnnncttccctttccttgctgtggcgtaagctaattcctgcattacggctggtgaggcatctacacatgctttaatataatctttcaggggaacttgtcttatggattggtctgttcaggtcttggcacaaggtattcacgtattcccaagccaattgttttattaatatatcagtcccttccgaggggggaagcatcctagaaactgcctcttccaatctagccacaaaactctcgtaagattcatcatgcttttgtctaattcctgaagggactgtggatttagccccaggtggaggtaaactctgccagctagatacagctatctgactaattttctccaacactgcttttgaaattttcagttgtgctgctcgtttagcatagtctttttgcccaagaagcataggcactgtgggtttagttccatttctattttcctcatggaacttcctcatatccttacctactcgcttccaatattctaatgtcaagcttccctcctctagaaaccagggactgattttttgcacgaaattatgaaatttatccgaaacctttaggcttcttccagacaacatgtgcttaaacactgacagaaacaatcttttcccttttaacttttactgccccgtaataaaaaattactcgtctcttaacggatgtacagatcctctcatctgcagcacggtcacgacgagatcctatctttgcctgagaaaataaagaatagaaagaaaaaagaaagagaaaaaagactgatctgcccgggtgtccctgtttgaaggcaccaactgctgcagaccctctgggctaatgtttgtctgcgtgaaaagagtctctcgagcagatgggcaaagagtcagatggagtgacaaacagatacacacacacacaagagaggtgttggatctgaatgtaatgttccagtcgagcctcagacattttataatacagagtaacagaataaggcacgttgaagttttccaggtgcgagaggagtgacttcaaaaggaaccagataaatgtttactttagagattatcaccctgcttcagatcagccctgtgccaggcaagaaatttacacttcagtgttaatagcaccagggggttgttaactcttgacaggcttcaagaatgatgtagtgtcactgaccccgaaattctctaggccttgttaaattatatctagtctggagaatcctcattatcaggatagtatattcacttgctcttggcatggaatgtagcttgtggtaaaatttttatctcagtgaggatttttgtctcttcctgcagacaactgagttaatggctgtaatttattcttttattgtagtgcttaattagttactgaataggttaagctccttgctgctgtctggaattttggaacactgggaaaggctttagctatgtcagaatacaatcttaaaaggcatttacaataaggtaatactaaatagagagcacgtggatccatacactagactaactcgggaatgaaaaaattaattttatggtttatatagattagggagagagtgacagaccccaggaagggagtttccttgaaactctttgcttcatgaaccagcttcccagctttcgctttgtcaagctgactccaccagagtgccatggcaaacatgtggtcactcagatgcctgttgctgctgctaaataccttcttcaccataagggactcttatcccaccaggagccctgaccctcaaatacactcttccataatgctgttttccatcctggtgttttataactgcaacagaaaattaatgggatacatcctgtcttaaacaaaaggaaaaaaaataaagcaaaacaataacaaaagtcattcaaataaagcattttggaagcaaaactaggcaataaaactaaaactggaacaaagacttttttttttcaagacagggtttctctgtgtagccctggatgtcctggaactcactctgtagaccaagctggcctcgaactcagaaatcctcctgcctctgcctcccaagtgctgggattaaaggcatgcaccactactgcctgtcagaacaaagacttctaattacttcctattaagaacagaccagctgtttcaaaacggggcataggggacagtgttagatttggtcctgtgtcttctcacaagctgcttagtttctttacagcccttcccccttttcatatacaaggtctcttttcatcctagcttgacctggacactgaagatgaccttgaactcctgacctccttggctccacctcccaaatgcttagatgacaagcacgcactaccagtcctggtttatatggagctggggatgaacccagggtgtcttgcttgctaggcaagtactccagcaaaggagctgcatctctaggctctcaatagacttcttcaatctttctacttcatgatctctttcactcaaggtgcagttcttctttgcagaggaagatagtttattctggaaccatacaaaaatggcccaggatcacagatttaggttaccccaaatttctgtgttcccaatgtggcaacagtttgaggagnnnnnnnnnnnnnnnnnnnngataggagaggagaggagaggagaggagaggagaggagaaatagaggctggccataagcatgtggagagggggaagggaatgggaagagaaggggaatgagtgagaggacagaggggtagcaagagggctagagagagcagaagcgatggcaagaagccccttttatagtgagtcgggcataactggctgttgccaggtaactgtggggtggagcctagacaaaacactaacagccatgctgtagcctggacacctgaggacccacactgagtcttgctgtcagctcttgaggaatgagcaccaaaagcatgtgtgtccccaacccttatctgtatgggatgatcctgggcatggctggagctgaggagaactctgaaaacacacaacaacaagctgtttcttcgcatcactagcagcaaacacggactatgctcccagttcccctccaccaacagctagcttccagctacagggcaacttggcctcggccccaccctggccaacccacccaagcagcttcacaactttttctgtctcctccctacccccaatcctaggaccagcccctgtcaccaccatcaactccttagactgtgaggaagatcaggtgcaaagcccctatttccacatgtgagaccaagaatggaagtgtgactctcagaaaagcaggtggaggaaactcagcagcccacaatcccctgagtagggctgtgctggaggatgatgggggtgaggagggaagggaaggagaaggaacaaacaggactgccaggcaaagggagcctgatgccctgatctcccccagaagaatcacccagaagcaggacgtgggtcccagggttctgctagagggataacactcagcaggtggtcgttaatatttgttaggtgtggaagcacttcctgagcggtaggaatagaatactggaggacgcttaggtaaaagcagaagggttggagatttccttgtaaaaactggggcttcagcacttaagatgagaaccaaaaccggatgcctgggctggatcctctgttcatactcaaggagcggagtgtaggaggcagcccggcacctagaggaagtgggaagtgagaaacagatctgttcaaaccagtgctgcaatgacctccttcccgaggaatttctgtcctgccgcctcatccccaaaagagggatggcccagacgggctcagcccagagggacctgacaacctgaagggcgggtgatgaggcatccttggtccaggacttcctcagccttacagcagcagagattcccatgagcgtttcaggatgcagtctgtcccctcactccttccggaagcaagctaagcctgcgcacaggtcttagtatcggtgattgccagaagccctggcctttccaccctccctaggtctgtcctgaaaggtaaggtagacatgctacaccagaagccacgccagggctctgatgccacattgtgtgcggtggggcacttagggcggtctcagccaggcttctgggtaccaccggggaccgccgccgtgggcgcatagcttgggacccctgtcgtagtctcagaggagcagttgtgcagccaagccaagggcacagccggagttgccagaggccagcagccagggtcgttctccccaccagccagagacccgcccacagcccatgaaacgccccgcctgcagcccgcccccgccatctgtgctccgctccgcctgcttgggtgcattcagcctttggtgatcctccaggacctaaggtttcggtattatcttcggggcctcttcacccggaggtgagtctgctgagcccgacctcaggtgttcactcgtcacgcgagggcctggccacggcggggaagcactgggagagagcgggaggccttgaccgcagcgtgtaggatctggggtcccggcgctctgctcccgggtgcagagtggttggagcatgcgaggccctctgcagcgtgctctgttcctaccatcaccccacccccaccccagtccttcctgcacgtttctggagaggcaaaggcccctgctgagccttcactgggtacccctatctcgactccacttgtctgcttgggatctccaaagggggatacaccctcgtaaactagagcaggaggctggggggtgggggtaggggtagggtctgaccagttagattgaggctggaccctccccagagtgaggagcgggaagctctttgtcttatccaggattttgcatatcaatgctgaggttctggtgattaagtagggtccctggctagcgggggtaacctgaacaaccttcctccgctggccgctagccaatagacacctggcttccgcggatgagccctttgagtttgtggaggtgttcctcaggtccccagggccctgccccgttgcctgcagatgtgtggacagacaaaacattggactcgttttccaaccacttcaccccttccttcgctagtcctccggtggacgatgggatgcctcattgacttgtttgtggctgtgcatgccagagcttcctagcagacagctcagggctccatcgttcctaaatcccactgtgtaacgaaaaaaaaaaaaacaaaaacaacaacaacaacaacaacaaaaacaaaaccagaaatgaggacaggcccagctgggcttggcactgaacttggccacctggagctttggctacccactacaagatgtcagcaagtctcaggatagaagaggcctaaggccagtcctggaagataccaaaacttcacctcctctataccccgttcctctaggagaactgtaagccacctttgtctctgggacgcccctctcccactcaacagatggcaccagtcatcttcctcctcaagaggccagtggtattcaaaataggatattgaaaccaagcaagctggtcctctcctctaccctatgccaaagacttctgcccaaagggcccagaaaagtcccatagccatctggctggctagtgtgctgactgctacaggtgtcagtgtccccagcgagcaggtagtggagtggaggtgtcttcttgtggaaatgggtcctgagcctctaccttgtacagaaaggaattagtgaagcccagaggcctccagcccgtgtctctgccacaagagagagggggtgggggtggggctgtatttggttcccagggctcagggaaggttttcggttcatgcatgctcatttatctgaccactgtcttaaccccaggacaaccacttaactgtccacttccatatcagagttcttggttcccctttacttcgtctatggagcccctgagtttgggaaggggtattaactgaaaggtaccattagatgaacttggagaaagatttgtaggtgccacgggagatttcaggtaaaagctcttttaataattggctacaatagcagcaggaggaggccaggaattctgaggtagagatttgattagcagcacgtggagcaaaggagacttctgactcctacaggtttcagaaagtggggagaggctctcagatgaatggcttggactgtgaggtaagtgttaatgaaaggaaataaaactgtaattcatgtaatgtatgttaaatagccccaagagttgtttctgagctttgaaacctggggctgagaacatagcagaacagaccaggacatgcccgggcaagcccatcgcctccctagctcccacccctctgacctaagttaaatgttacaggctgctgatgtttaaatggaccaatcatgtgaaaccgcgccaattcctcccccagccccactccttttctataaaaccccctagcttccaagcctcgtggtcgaatccactgtctcctgttgtgtgagatacgtttcgacccggagctccgccattaaaaaacctcttgttgttacatcaaggtgttgtgttctattcgcgattcttgggtgcacgccgaatcgggagctgagtgggggtttccccactgagttctttcattagtgtagcacgagactagcttaaggctgtacaaattgtccgtctgattggtgcatggggccaggtagacactagataagcaattgggccttaactcgagttgtcttaatggctacccccagggcagcagggagtcaatactgctctcctgtctggggcctgaatgctgaaaccatctacaaaggggacataaggcatattggggaggtgtagagtgggccaggcccagggtctgctggtatctatgccaggatcctgagtggtggtggcgtagcctgtcttttaaccaactgcctctctcacagtaggcttctttggcttgcgaaccttcagcagatgtctgccacttccaacatgagagtcttcctgcctgtgctgttggcagcccttctgggcatggagcaaggtatggagctctgagataaccctgcagcctggtcctcctcctgatctctcattctttctcctgagtagatgcccagggctcctcctgagccagccctcctaggaacgtctggccttcccacctcctactctctagccaactgacctagttcccctgatgctgtgctggcccagctacacctttgtcacctcgtgttgactttagccactccagtaccaaagtctgaagtcagttgtcattggctggcttttttccctgacccagggctgagcatgctgttgcttcttgtcagtgggttggggatcaagggccccactggaaagtcaccttaccctggaaggcttccccaggcaataggcaggtgtcacctacagcattgtcccttttgcagttcattccctgatgtgcttctcatgtaccgatcagaagaacaatataaactgcctgtggccagtttcatgccaggagaaagaccattactgtatcacgttatctgccgctgcgggctttggtgagtagctgcctgtttccctagccagggccagggacctgcggggctttccccatttcctgctaccctgtctgtctgtcccctcatcctcactttccatgcagggaatgtcaaccttggctacaccctgaacaagggctgctccccgatctgccccagtgaaaatgtcaatctcaatctcggtgtggcgtccgtgaacagctactgctgccaaagctccttctgcaacttcagcgcagctggcctcggacttcgtgccagtatcccactactgggccttggactcctgcttagcttgttggctctgctgcagctgagcccctgaccatcccccatgtgttctccatatccccccagctcaggaaaagcccagctccttttaggtcccaggggaccctaggaaccttcagctcctcctgggtgtgtctagttccccctccacactctctcaacgtcagggctaagtaccaaactcacccatacctgctctgttgaagtggtactggctacccttgcttccagagccaatcctataacctcccttggggaaccagcgaaggggtgaagatctccttggagtctcaagagtaccagagtcagcgccgaatcttgtggacacactgacaaggatgtctaatccaaatagatgtatatctgtgtgctcagtgtatccctgtgtgaatgaagccacttggattctggggtgggcaaagaagacctgaaaagattctacagcagaaggcctgtgtcgccaccaaaacccctccccctggtatcattgtacccaccttgtactctgttcaggaggctgcccatggaggactgccacccctccagatgaaggctcccactacccgatgcagttgagtcccatcctgccctctctgcccacactggcttcctgctgctattctagtgcctcaaataaaccgttcacaccctttcctgctatgtcctggttgtccttaacccgtcttccccctccggtccaaagggacctggggatcctgcaggcccacagccctgcttaagcgattctgaaagaccaaccccgatacagtgatacattcctatgatgccatcatagcagaagcagaggtctctgggaggccagcctggtgcatagcaaatcccaggaatctaggcccatttagtgagacaggcctgagagaaaagagagagagcaaaggcagagagaacttgaaagtgtgctgtctcaggctgaaagctgagaagtacagctacccataaaggcaggcccatcaggctggtcacacattcccaagctttgtctgccccagagacttcagaggcctgctgttgccacttgtccttcataaactaccctgtagtctaagccatgggagtctggcccaggcaagtgatacttgtccaccctataactggctttgctttgctttctggtattttaagacggtctcgctatgttaagactagctgccccaaacccagagcaatcctctttgagtgctggaattaaaggcatgcaccaccacacctggcccttagacttttttgtttctgaggcaggatctcacttgaacgttaggtactggcattacaggcagatgctactacacctggcttcctggggttcagtgctgtgagtattatggacactgatggagaagctcctgagtctgggtgcctaaggaagctatttctcagctgttcctaagcttctgggctgttgggtgataccataatgggataagatccacacagatcctggctgtggtgatatccgtgtctgaggaatactgcccagtgggggtcagacacagggacaacacaggggctcagggtgaatttctaaaatctatgtaggcattggctttgtgccatgattctcaagaccagggttcccatgacgtatagcctgagggtacaagaaggaattagcctcataccaggtagctcagctacctgaaaaggacaaactttggggaaatgtcaccgggacagcacctgagactcagaaagtatgctttgttcctagaatattgaaaggccaaatggagaaaggtgggagccaaatcttctgcaaggagcttgggctgcctcagtgtagacagtatccactgtggtgttcaggacagatctgagtaaggtttctagagactggcttgtctgtggtcccagcagatctaaccaccaaaagcagtatgagggaagacacctgggttagactcccgggacatgggaaccagaagggcaccaggcagtgacagggacacgtaacaagctctggttttctccctatcttgatttagcttccatattgtgatggagtggtgtcacaaggctcaagagttgaggccacacgtgatctgggatcctctgctctagtctggagggcgtgatggtttcaaggctaaaaactgggacagtgagtggtctgctctgattcctctcaggagaagaatgggcagaaggggcttgagttccaggaatgacctgaggagaagggagggtgaggattggaaagaggagggagaactggaagcaggggagggaggggccaggggccaagtttcacttcccaaaagcagaatcgaaagtatcccagagttaagtttcaatttcatgaagcttggaggcaggaagggtgtggaaagagggaggaagggtgaatggggagggaagggtgcacactgcacctctaagaaggctgtccaggtttggagccaccagcttcactcataccagattcaaatgctagatctgatcccacatgatccaatatgtctctgatttgttctgggcccattctacctccagaccctggccagctttcctattattgctgctagttagtgatcagtgaccagtgaccagggcttccccagtctgatcctgctagcctgccccaaccagcaagtgcttagctacctcccttctgtcccaagggctccagtgacagactagagattgaggactgcaacctcaggtggacgcctctccacctgagcatcatccaaccaactgagtatcctcaggcaagatcaaagcaaaagatgagagaaatttccctactagggctccctctaataaacagagcatatgcaggaaaagcctactctgtaccaaagtataaaaggcaggggcgatgtaaaggtctcgtaaaggggtctatacttcatggtggatgctttgggggctctgtccccagctcagtagcccactctcattcctgggagtctgttgcttgtctaaactctatctttaattctaaccatctggttccaatcttttgttctgagacataggagtctagagtgcactaatgcaagaggtgttttgtttgtttgtttgtttgtttgtttgtttactactttaaaaaattgaatcttatttttttattttaataaactttattatttaaaaaagcgtgcagatcaggggctggaaagatggctcagcagttaagagcactggctgctctcccagaggacccaggttccatgtcctgcacccacatggtggctcacaactgtctgtaatgccagtttacagggatacccatcctcttctatcctctaggggcactgcatgcatgtgatacacagacagacagacaggtagacagacagacagacaggcaaaccacttagacacataaaattaaaatctttttttttaaagctttcaaacaaaaccacgatacatcaaacattaaccagacccaaagcctagacgacgtaatgaacttacatgcagttagaactggcatttgaaatggaagccgtgaagctcagcattaaatttacacttccagtaccaaacattctatgcattgttagttagggttaccgttgctgtgatgaaacaccatcaccaaaagcaatatggggaagagagggcttatttgacttatacttccacatcatagtgcatcactgaaggaagtcaggcgaggcaggaacctggaggcaggagctgatgcagaggccatggaggagtgctgcttactggcttgcccctcatggcttgttcagcctgcttgctttcttcctcctcctcctcctcctcctcctcctcctcctcctcctcctcgtccttttttttttgagacagggtttctctgtatagccctggctgtcctggaactcactctgtagaccaggctggcctcgaactcagaaatctgcctgcctctgcctcccaagtgctgggattaaaggtgtgcaccatcactgcccggctcaatatgctttcttaaaggacccacgaccgactgcctgcccagggatggccccacctgcaatggcctgggccttcccccgtcaatcagcaagaaaatgctcttcggggcttgcctacagcgtgaagaacgtaggaaggcattttcttaattgaggtttcctcttcatggatgatttagcctgtgtcacgttgacgtaagactatccagcccacaccctgacccacttttctttaactccttcctccccttgcccatgatctcttattttggagacctgcaggtgctcaagcttgctttccctgacgctgtggctgtttctctgaccactatgcctaactttaaaggtgttaaaattgcagcgctgggtgtggtggtgcacgcctttaatcccagcacttgggaggcagaggcaggcagatttctgagttcgaggccagcctggcctacagagtgagttccaggacagccagggctatacagagtaaacccctgtctcagaaaaaaaaaaaaaaagattgcagcaagtgcctggacaagcagagtttggccacccagccgcagaaaagagccaatgcaaccacattggcaagagagactaagatccagtggccagacctcattaaactcatccttagggccttaacatgggggtaaggtttaaacaggagactgatagcaagggtgaggcagtccagccaaggtgtgccccccccccaccgcggtctcagttctcaagtctacagtgtctcacaagttataaatctttctccaggggacatgttcttcctcctgtttccccagcctttggctcttccagcaggaagtatctgaggaaattccagtttctggggatcctttatttcagtaatctgctagcccgagagaggaacgcagataaatttctcccagggaggcaggttccaaaggactgatttgccagtccagtcaagtcttccccttgatccttaactaaattaagttgtccttgcgatcttcttgctttccttctcagtctggtccaccccctatacacacctgccccagtgatgaactctaagggtccttagcctgcttcatcaggcctcatggccacagcacctcagcttccagaggccctaggtccctctccctctctttccattctgacaagccctttcctgcaacacgtttcatgtcaactggagcaccccaggcagctttgaggcctcaggtgactggctgactggcacacagtcccattaggaaaggctgcctgattgctggagggcctctcggcatactcagaactccgaggaccacggctatagcccagacctctggagaaatttagaagatggaatgctggtctgtgtaccggggcatagccagtggggaatccttagcccagctggcaggagtgattggtcttacagggcatgaccagaatgaccaaagtgctatagctctccaaggggaagccagagtaagacaggctgcccctgaggtggtggcaggtggcaagaagcagagggcagctaggagcccaagtcggggccactgagcaggaagtggctgtggtcacgcgcatgcataccgtacaccacttgttggggatctggggatctaggtccagcaaagaaagcttcaggaggaaaaactcttccatgaagtgttacagctcaataaagcaggcaccctcagtcaatctttggtgaaaatcactcaggcactttattccttgtggactaggaccttataaacattttgggatggggtgagtaagtgcttcctattggcttggtttgggattctctatctgcatggggaaggacttcaggtgttgactgtacatgcctgattttcatggtcctcctagtggggtgtctcagtcacgtgctccaggacaggaatctggttgggagctagtttgaactcctgccattctcaatgatgaattttatggaagttctgaacttgctacaaccttaccagctcttctatctggtggcatggcccactgcccccacaactcctccttttcctttttataaaggagaggtatcattggagtgactgtctcctgtgttggggacagtttggtattgaaccaaaacctgattggtagttatttttgcaatgctactaatctgctgctttagaaattggatgagacagggtgccaagagaagcaaggctccaagctcatacagggccaaggaggagcagaagccaagctaccaaggggttagagagccatggggcaggggtgttgggagcacagcatgcccagcgatccccctggagctctttgggcatttgcacatcttgttctaccagcccagattcactgacatagaagcaacattcctcttctagcaaaacacaagtccctccctgttcagcaggtagtaagcccaaggccctccagttttggagaacaactcctgccaaggaggttgtctggcattgaagggactcaagcgtgtctgcagtggaggccattgcctggtcaagtttggtctggaagtcgatggccagatgctgtgtttggaccagggctgctctaccagctcctgtcatgcctaatgagacaaggaaacccagtgcagcaagcagagggatgaagatatctctctctctctctctctctctctctctctctctctctctctctctctctcttcctcccatctgcaaggcaagttcttcaggttcatagagataaatctgggaaacaattattataggagttgcaggagccttgaaaaggggtggggcggggggcagtgttaatgcaggagcctgtagtgctttgcaccagagaagtgcagggggttgatgtatgttgatttggtgatggtgttgtaacaggcacatataagatggggtttttgaggagggtcctacaaggcaaaagggggaagaaatgccccacctttaggttgaagagaggaatatcctgtgctttccttgtgggtaagggtctatgggttttatgggaacagctgctaatagcagtcaggagagagaagcacagaaaaaagaggagtttttgggaggagttggggtgggtcattaaaggaaggaggtcagctgtatattggatttactgtagccaggaatgggtagcttggagttccttctgagactgattttcccattgaagaatattaacatgcataaagattgatttggaggtgggaggggggagttcacgagagacatgtaagttggctatggggtatttggcatagccattatggtagagtttacccatgactcctgttcgacaacattcatcccacagatggctgatggaaagctgaaaatgagttttaggttggtgagcatggtgccactgtggctggttggtttccactctgcagctccaatacctcctggagacattcacctgtgtttcagtaaggaaagcagaggaaagggctgtgtatagtggagatgccatctgggtgtagggagatctcagtcctggtccaacatgcttcaagtgggcaattctgggaccctatgatttttgagtgtgtatctgttgtaggtctccctagagaagaatctttgatggtaagtgttgggaaggctagagagaggctggacattagcggagttagtatgaagaatgacaaaggagaggtgtccccttcctccaggcttgagtaggctaaatagaccttaagtgcttgccacagttggaccttaaagacccaggtggaatcttccatctagcccatttgcaatttcttacaggaacagactgcccgctgagcttactttgcaacttaatctagctgaaacaaaggatggggtctgtggattttccctatataaacacagagctgaatattaaattttgagccttgatcagaaactttgtcttggcttcatccttctcttgcaccctatcctttatcatttctagcctccctttcaagtagacccagttctccatggctgaaggacagctacagagaagggaggttgtgtaaggcacatgcctgggcagcagtcaccaggtcatgaatgtctttccaggagatcttgttcttttgggcatggcatctcctctgcctcctcctccacctcctctgtccttgatctgccagtaagaggcaggctatcttcttggttggtgtttgacatttctggcaggaacccagataggaataggctgatactgtgggaaaacacaaacgaaatccttctcagttgtaaggagtctggtcctttccaaatcccatccaaaggatcatgacatcgtactaagatgggggtgggggtgggggtaggggtggttaaattttggtgtgtgccaatggagggaaataggagaatgcttagagtttttgtagatgttaaatatgcttggtgtagtcataactattgttaattgtacatgggggtaggtggttggcttttgttttagaagttgagcttttaggatttgatgtattctttctactatcccttggccctgagggttgtggggaatccccgtatggtgggcagtttcccattgtgtgcagaaagttttgaactgagaaccagtgaagacagggccattattagtttcttttatctgttgaggaatgccctctgaagctaagttcaccaagagctgacaaaaaaaggctctgtcaaaatcaaagacaccccaaattttcctctatcaccccatcctatcagttctgatcaagaagtagggtcgccctggaggagagctccaagatgaagtttctgacagctttattttaccaaagtccagtctcccaacccaacctccatcccagagaacagggtgttaaagaagggacttccttgacattccttggcacttctgaaggactgcccctcttgtgaaccctgtcctctaaccccaagtctctgaagactgttgatgaaaagggaacgctgttgtgcggatagatgtggtgtaggaaaacagctatggagactccaactcctgggcaggtttgcccggatgtctaagtagggaggacagaggctccagtgggggccaggagttccagccagaactcagcacctgactgtgaggtggggcctgacccctctatgtggaccagaagttctccctggggtaccttccaacctcccagcctctggccagctgtgctatttccagcccccagcctccaccctcagaggggagtggtctgggaatgtcacggagatgacatatacacttcatcccaggcctggacagaggccagagagccctaagaggctctattagagcccctgctcccttcacttccgaaggtccccatagtcctctccctcctctaaacttcaggaaatcgaaactcaaattctccgcctctccacctcttcccaaaagtcaggaaactgaaagctagctcccgaccacctctgccaatttactttctcttctctctcccaggtatcttacagcctgtctgaagcctgtggtgccctgcccatggtgagtcctaagtaggacccagaatctaagcaggaaagtggaatgggagttctgcccagtgaaagctccctttgaagtagctctggctccccaaacacacaagtcagactaaatcttccctggagcgctcaatgcccgtattacccccaagcgcccctggaaactcctatgggttggacgggaagggtcgggcatcctcctctcgcccccagggagggacagtgttgttagtgagtgtaatagctctcagcgtgtgcttgctatggggagattccattgacttgaaagttgaaatgcgctcttactgctttgacagcttctgccactaggggcgcgtgtggccaagcctggagcccgggtttgaaagcaccaccctcctgggatagggttagtcagcttcttccggcaagctgtgcctgccggtgaattaaaggggcaagggtggccacggtggcacatccagctcccgtgctaaccatcagcttaaagtcattagatgaaaatgagaacacagccacatgccacaattgagtgtcccctgccctagagcaaactcccttcagccctcacccatagggcctttccatctgctgggcagatgactaaggatcttggtctaataattccatcttccattgatgagtctgcggttccatcttatggcttgagtgttggaacatctctcgtggaggagaaatgcacgggcgctaggctatgttccttcctcacagctgccttccagggtgtcggggtaccaggctcctgggaccccaacacatcactcaggggaggtgaaatgcagtctaaaataggggtcccaacccatgtttctccaggtgagaaatggcaggggctaggacagtggctgtggttctcaaactcctgggcacccagatgccgccgagaacggcattgagaatggggttcccatacttctgtgtatcccaaggccgctgaggactgcaagcagttgggagaacaagggccgagggcctgtgatgagggcgtgtgggggctccaacttaactcaggtgagtgccaggagtgtgcaggggccttctacccgagacttaggtgcagctctgtatgatgaaggcttccccccatagtggtccttgatgaaggagacagcccttgcttgtccaaactgtttattcatggcacatgaagactcatgtgatttactcagggtgaaccagagattaaataccttttgcagaaagggacgcttaggaagaatgctcattggctaaacac

SEQ ID NO: 1074 - DNA, 1072 bp, Mus musculus
cttcacccggagtaggcttctttggcttgcgaaccttcagcagatgtctgccacttccaacatgagagtcttcctgcctgtgctgttggcagcccttctgggcatggagcaagttcattccctgatgtgcttctcatgtaccgatcagaagaacaatataaactgcctgtggccagtttcatgccaggagaaagaccattactgtatcacgttatctgccgctgcgggctttgggaatgtcaaccttggctacaccctgaacaagggctgctccccgatctgccccagtgaaaatgtcaatctcaatctcggtgtggcgtccgtgaacagctactgctgccaaagctccttctgcaacttcagcgcagctggcctcggacttcgtgccagtatcccactactgggccttggactcctgcttagcttgttggctctgctgcagctgagcccctgaccatcccccatgtgttctccatatccccccagctcaggaaaagcccagctccttttaggtcccaggggaccctaggaaccttcagctcctcctgggtgtgtctagttccccctccacactctctcaacgtcagggctaagtaccaaactcacccatacctgctctgttgaagtggtactggctacccttgcttccagagccaatcctataacctcccttggggaaccagcgaaggggtgaagatctccttggagtctcaagagtaccagagtcagcgccgaatcttgtggacacactgacaaggatgtctaatccaaatagatgtatatctgtgtgctcagtgtatccctgtgtgaatgaagccacttggattctggggtgggcaaagaagacctgaaaagattctacagcagaaggcctgtgtcgccaccaaaacccctccccctggtatcattgtacccaccttgtactctgttcaggaggctgcccatggaggactgccacccctccagatgaaggctcccactacccgatgcagttgagtcccatcctgccctctctgcccacactggcttcctgctgctattctagtgcctcaaataaaccgttcacaccctt

SEQ ID NO: 1075 - DNA, 411 bp, Mus musculus
atgtctgccacttccaacatgagagtcttcctgcctgtgctgttggcagcccttctgggcatggagcaagttcattccctgatgtgcttctcatgtaccgatcagaagaacaatataaactgcctgtggccagtttcatgccaggagaaagaccattactgtatcacgttatctgccgctgcgggctttgggaatgtcaaccttggctacaccctgaacaagggctgctccccgatctgccccagtgaaaatgtcaatctcaatctcggtgtggcgtccgtgaacagctactgctgccaaagctccttctgcaacttcagcgcagctggcctcggacttcgtgccagtatcccactactgggccttggactcctgcttagcttgttggctctgctgcagctgagcccctga

SEQ ID NO: 1076 - DNA, 21526 bp, Homo sapiens
  misc_feature (1)..(1993): "n" at positions 1 thru 1993 can be any base
  misc_feature (5327)..(7874): "n" at positions 5327 thru 7874 can be any base
  misc_feature (15923)..(16250): "n" at positions 15923 thru 16250 can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaaaacccccatctctacaaaaatacagaaattagccaggcgtggtggtagtgcatgcctgtaatcccagctactcaggaggctgaggcaggagaatcgcttgaacccgggaggcagaggttgcggtgagttgagattgcgccactgcactccagcctagataacagagtggggctccatctcaaaaaaaacacacacacacacacacaaatcaactgttcctctggcccccactttcacctgcaacctggagagcagtggacactgatcacagcctcacaagaatatgaccctcccttttttcctttcctccttcccctgcggccacttctttctttaactattgaagccccaaaaccctctttggaaaaggagtgggctgcacaccctactgtgttttctgcctctttttcccgggcatggcttcaaccttggcaaagtgaacctctgaactggttgagacctgtctcagtcactctgtgggaggggcctcccctgaggttggggaagatgtcccaagaggagggacaagcagcaactcagggaggcctggagccaacttcggtttcagggttgagccagggtcaaggtggcagtggaagttacaggaagagcctaaggccccagtggtgggagcagatgctgaaatccccgggagcactttggactgtgccctgggagaggcgggaaccaagcctgagagcagagtactggcagctgcacgttagaatgtgaagcctggacacagggaggtcaggcagcgagctcacctcacggcagcccagccagagagtcagcctgctctccccgcactgagccaaggctgggagacagcctacctcccaccagagccagcaggcaggtcccagcccagcctgccccgtcccgccccagcctgccctgtcctgccatctgcactccccgtcaggcctcctggccagccccacagtccctgccttccaagagacacaggcagcggcagcaggggctggatgggggaggccaagaatcagaggcgctcccccacaggacccctgaatcgtggccagagaaaggtcagggcaggatgaggcctgtggccacgggcagatctcaggtggctgacccgtcctaggagcacacagggcagctgtggctccttccctcttgaacccagaaaacagggcagagctcatcggtggcctcatctgccagccccagcagtaaggccaccggctcattcttcatggggcagcagcatctggctttctggctccagacaccgcctgctgggccaggccttcaaccaggtccctcctgacagcaggcacgcctgagtccagacccgagacagagccgggaggcagcctgcagcaaacgtgccccaaactccacaggcgcctaacccagtcctgccaagggaaagtgctcaaggctctgccctctcgctggaggcccactgctcactctcacccgtgggacttctccccacaggccccagcagcctcctcccgtcatctgagacgctaccaggacaaaagtcttccacaactagggccaaaggcctcttagtcatggaagtctccctgaacctattctggttcggaggttgcctggtttaaaattttaaaaattaaaaaaacaaaagcctccgcatgacagcaggcccgtcccagtcttatgatctctctgctctggtgtgggaggaggagggagtgccgtgtgaggaggagggagtgccgtgtgaggaggaggagggagtcctgtgtgaggaggagggagtgccgtgtgaggaggagggagtcccgtgtgaggaggagggagtcccgtgtgaggaggagggagtgctgtgtgaggaggaggagggagtcctgtgtgaggaggagggagtcccatgtgaggaggagggagtcctgtgtgaggaggaaggagtcccgtgtgaggaggaggagggagtcctgtgtgaggaggagggagtgctgtgtgaggaggagggagtcctgtgtgaggaggaaggagtcccatgtgaggaggaggagggagtcctgtgtgaggaggagggagtgccgtgtgaggaggaggagggagtcctgtgtgagggggagggagtcctgtgtgaggggggagggagtcctgtgtgaggaggaggagggagtgctgtgtgagaaggagtgctgctacgtaagaaggaggtagatgtgtggggggagagttggcattcggcccggtcaggactccatggcccttgttacagttgtgggtagaaatggaatctctgtgacatctcctgctcccctttcgcctgccccaaggcaggtctccagtactccctctcctttctgatcatgggcccaaagaggctcattcagagaggatcagtcccatgccctgggggcaggaatgctgagcacatagaggtttacctggaggggccacgtgggcggcatggaagctccccaccccttccgggagacggcgccctgtgcctctcgcgtgtatccatttataattaactgcaaatgtgtttccctgagttccctgagccactcttgcaaatcaattgaacgcaaaaccgggaggggctgcagtattgctgggaaagagggtcctgatccagaccccaagagcaggttcttggatgttgtgcaggaagtaatttggggtgagccacagagcacagtgagagaagcaggtttatttgaaatggctccgttccagagtggggcgtgctcagaaagcaggaggaggagggcctgtcctctgttagtgcctctgcttacaagaaactgtaaggagctacaattacacctggaatgggcagatgcacccactaaggataggggctgtgggtgccatcagtgcccgttcatcctccaacctcaggctgctcattgaaattatctctgagtaaagtggcctgcactcttgggttatctggacagtctgcgggcttgctgggagatgccccatatggccacaaatattctgtaattataattggtgtccagcttgagacatggctatttttagaccataagcattaaccttataggtgccttgtgagtgcctcctactcacttcaagatggagtcactctggtcatgtttcattaaaccagaggcctggtgagcaagcgttcctctaacagtgggaacctcaacgtcgggccagtcggtaagaagttccagaggctggccctcgcagctcatgtgtgtgcatatgtgtgtgtgtgtgtgtgtgtgtgtgtgtaggtgtctggatctgacgctatctgcaggtaccggaatggtgttggaggacactcggctggtgtccgctgcagaactgatggcttgctcggtggcggggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaggggcaggagaggggctggggctgccggtgggttggtccccagagagctgagcttctcctcccatcccccgcaggcctccccgaatgtttccaaagatctggggcgggaccgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcggtgaggtccaaggagcccagcctccctgagtggaccgccgggcccctccccgttccgggacacaggagagctcccgccccttgctggctgggcagcccctagatacctggctcccaggggccagcttccctgagcctggggatgagccatgagcctgcagcctggccccagggcggccccccacggcctgccggctggctccctccggctccatggcccacccggccttcctaattgccttcggctcccaccggtgccttagctcagcctggtggcccagcgggttgggtgccacccagtgagcaggtggcggcaccagctggacctgtttgtggccctgtatgctaggacttcctcagagacagctcagggaccccccccacctaccagaacctcacttagggggtggggggaaaaggaattggagatccttcctcctcgggctactccctggaggcggggataggccccagccggacttggcactgtttttggccacctggggctcccactcccaaccccaggatgtcagcccaggtctcactgtcctggcctgctgctctccccttagggcctctgcgggcccctctccagatctgttctctgaggcatcctccttacccccagtgcccagcactagctccccaggcccgggatgtccctcccactcctctgcccacggctgtccctgacagaaggcagcagcctccccctccaacaccatgcactcacaaaacagagaatcacgaccccagctgggtgtgttccagattctttctccagcagtgcagagggtcctgtgcagaggccgaggagcagtacagcgacccatctggccctttcctgctggtgggaccagtggcacgcagccttgtctctcggagcccatttcccagccacagaatggggagtagcagatactgagtggggtgctttcctcggaactgagtaacatcaggaatggggagtgctttccccctcagccatgccccacctggccccaggtctccatgtgaggggagctgcctgggctcaaaacactgagccatcccaaggaaaattctagatacagattagctaatatacactgacagatacacatatagatgtgtatatagatttctcttttttttgagacagggtctcactctgttgcccaggctgcagtgcagtggcatgatcatagttcacttcagtcttgaactccctggctcaagagatcctcccacctcagcctcccaagtagctgaccacaggcacgtaccacgcccggctaatttttgtattttttgtagaaacaggaggtctcactgtgttgcccagggtggtctcaaacccctggcctcatatgatcctcctgccttggcctcacatagcatggagattacaggcgtgagcccctgtacccagccccagactagctaatattatgactgatcaccattccccattccccattcccccaccccaggaccactggcagaggccactcactctgccttcttttctgtggttctgagaaggctgctgagtttcctcctcttgcctgtgcagccccctcctgccaggtttcaggagggagatagcctagagcatgtctgcactgagtgaggagtgggtcaggagagaagcagggaagtccttgtgtgctggcaggtcccttcccctctgctgtctgtgtcctcatctgcaaagtgggggtgcatggtcttggggaggagtgaggcaccacccggccccctaaccagtgtgtctctccagagcaggacaggctgctttggtttgtgacctccaggcaggacggccatcctctccagaatgaagatcttcttgccagtgctgctggctgcccttctgggtgtggagcgaggtgaggtgcccttggggaccccagacctttgtccagctgtgccctgctccactccctctccacccctctcccctgagcagacgctccaggggtccttccaggccgctcccagcagagggctcacccggcctggccacactgtctcactgtgtgtttgagtgtcgcttgacctgctcgacggccagggtggggtgtcactgtctttgctctgccttcagcccagggcctggtatacagtaatttctcagtaaatgtccactggggtcaggcctgggagggacactggaggcttccctgagacaggtgtgtcctccttccgcagccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctagcccgggccggggctcagcagaggccattgctgtctgtctgcagccgtctgtctctcccctgacagcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagcttcctgctctgagtgtggctgccccttgcggggagaggcagagcaccccaggtttggagggtcctggggtcttctgtggtatggcccaggggggtggtgggggaggaggagtcatccccctgagccacagccagctgcttgcctgacctcagagggagcccctccccagtgctctgccctttcttctgccccaggttcagcaggtcaagtgagttcctcctccacacagcggaaggaggatgttggggggcatggaggaaagaaagcgggtgcaagaaggagcacgctcaggctggggcagcacccagggccgtaggacttgggaatggagggtgtctgtctggacccgctggtgcagagggcacaaaagctgggctggggcaggacagacgggccggagtgtagtgagtggcctgtgggaggggcagggggctcccacgcagaagctctgggcagcagccctgacccatccgtgcctggactgcagcgctgcccgcttccccctggcaaacaggtggcagcctcctgacagaggaagccggcccaggccgccgtgtctgcagttgggtgctgtgcgctgcccagagggctctttgggctggagagagaaaacaagaacagacacccagtggaggtgtgtttgttcatttctccgggacagtgggagggagccggccagggtctcagccacttagggcccgaccctgaattttcccggctggccagaaactgtggtgtgtgtgtgtcaggatcccaggggcaccgtccagcaggaggggccggtggtcaacgtggaggcccgagattcccacccctggcagctgatgtgaatagccgggtcctcccaggtccctgaggtcaaggcaggtcaaagacctgtgtcctcctcctgggtccctgagctagtgattcctgtctgaaacacatgaatcattactgccacccatgaggggcccattgtaaccgagcgagagggcctggaagaggtcagcgggaggaggggcctgatcggtggatcagctatccctgtgcaaggacccggagcccatcagagcagcctgcagagactgagcttgagattccgtcgggagtttggattcgctgagtgggtcgctctagcattgagaaatgcaagcagagaacagagggtggaaaccagatggtccaggagcctgggcactgtagccaggaggacagagatcccggtgtgcagtgcgttcactgcattgttcactcggaatcgcaggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaagctaacttgcgcttccatctctggcatctcctccacttcccaggtgagctgactggttactgagcctcacaaccacactgagacgggggcgcggtcatcccctcgtttccccaggggagacaggctcagagtggaagccgcttgtcctcctaggatctgggactcggggcccagctctccctctgctctgggtttagggctgaggtcagaggcagccctgacctcctgctggtggtgggtagggtagtcccgccgggttcctgctgccccgccctcgggaggctggaggccccccaaggacaggtggtttccaggagcagcgggagggagcccgggttgtgtcctgggcctggagcagagaggggaggagcccagcgcctgagtttcaatttcctgaagcctgggggagggagaggaagagagcctcgtttcgtttcggggctctggacctgagcctcccgcccagggcccaccgcaccccgctaggacctgggatttcccagtctccacaccggcccggaactgggccccctcctctccgcagcccatccagccccacttccccgcttccccgcttcccagcatctgcccgcggatgagcctctggaggatgggcggcccgtcccggcgctgcccctcacccaccccccaccgctcaacccctgtggggacttcctgcagtgaggcccaggcaggacgctgcgctgcctcccccatccacagcctctgcccccttgacacccccgccctctgcggtgccttgcaggagtcgccagcctgtgggcccgggaccatttcacacgctgtccacagtcgtggaaacccggcagccacagcaggcctgggcccacggtgcctccacccctccgtcagcccccagcaagtcttcctgggggtccccagccctgagtgcgagaccctccaggctgcttctggacctcggggctggggctgagcccgatcctggctggaaatgagtgcagggccgggctgcctgggggaaggccctccagtctctgagccccaccctggggaatttgctgggacaccttgaaggccgcaggccagaccccaggggttaataagggaacaaagtccttgggcgaacacctgcatttactatctgagccagcaggcagctaggatgctgggtgagggggtctctgggctgctgggcggccaggcgggggcatcggggcaggagctgagggctgcactgggcaaccaccctgagctcctgtttacccaccaggggcagtgccagggcgggctgggctcacagcagagcccagaggaaggggctcaggctgagcaggagctccctgacagcctggcaccagaggccacgccgcactgtggccgccttgttacggaggctattttcacagcaggtcatgtccagcttctcaatcttcgagtcaatcagtctatcctcaatttctgtggggtaagaccctccagggaccacaggatgggtgaggttcataatctgggcacagagtggggccacagcccttgctagtgtagctgagcttctgccctgtgggcaagagaggagggtgtctggcacaggaggccccacccgaccccctcggacccgccccaggaccgcccccttcagggaaccttgaagccagtggggacgcggaggcgagcagaagagaacgggcggcggccccaggccccacaccaagtctgcagtccattagatggaggtccctgagctctgtccccagatctaagcttccaccaggccagggggctcaaggcagagcccctgggatgctgccagagagtgccctgcccacccctcacctgcctacagacgctgggtcccacccaggactcaccatcgatagtgccagtgaccacagaggaggggcagctttgagcctgcatgggataggagacggggtgacacaggctggggtccaggacaccgtagcactggaagcactcaaggccctggcctgggatggggcggggagggtgcaggtcagggtcgcaggctgaagggtgggttccagtccctctcaccagcaccggcagcaggcctgggcagcacacaggtaggctcaggtgcccttggctactcagaattgtgggcagggtcctgctggcatctggagcccccagcatcaagagggtcttactcccaccttcaggcctccttcccatcccccaccctcagccagcagcagcatggggctagtgaccttcatggtcttgggtatgggtgcattgagggcacatgtggcacagaggctctgagcctgggaagagctaggggaggccttgcacccccgagcctgggaacctctgccccacttctggtttgtgatgaggaacccggattgtttgtgtaaagtgcacacagctgatggcctcatcccatcatctcacagaatgggaattgaggggtagaaacccttccttcctgacctggctgctctggaaggcagacatgaccttgagcaagacccctctcaccccaccccttctctgcctggggcctcccagagctcagggtgtgagcagaacagatccggagggaggaggggctgcggtgaggagaggaggggctgcggtgaggagaggagggagaggttgtcccctggggtgggaggacgccttaggagaagttctgactcaatagagaggagggtcctggactagggccttgagtttcagtttcagtttcctggtgcatcacagtgttggtgtctgaagcaggagagaaaagcagccgtgagacctcaggtcacacccaggaccaggcccttcccgctcaggatgagggtctctggctgagcccaccactggcaggcccccgtgcagacagagcctgggaggggccagcagggcaacaagctctgacactgagaccccaagccaggcaccccttgttttctgtgcagggagcagaggcccctgtaacggggtgggacgacatgggggctcccttggggcaggggaggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacacccgaatttgttcttcacggagaatcagaagacacaggaaatgggccaggggtgactgactgcagactccaccccccctccccaaccaggtgctgggcagaaggaagagagggctgcctgggctgtggggacagagcccttgatgaagacagataaaggcagcagacctgcataaggatgggtcgcctctccggtgggtggtcccttccgaaaagcagaatccactctgtgccctcaggggtctctgcttggagagtccatggcatctgagaggatgggccaggtgaggtgggggtggctcctgagagcagggaggacaagggcggagctggaggcgtcaggcccagaagacccccccagtgacttggggcagctgtgggcaaggcttggacccaagaggcctgaccaccccgcctggcagcacaccagagcacaggccagacctgaaggggcagcgccaggggggcccatggtccacgggtcactctgctggccctgcggccacactgctcaggtcccagggcctgatgatggctgagccagacatcataacaccaagcaatggagaagttagaatattgctagggatactgacttgtatttttgaatcttaaaatatatgttttaatctgacatctataagcagtgcatgttacatgccagtcagagcatgagcatccccaagaggtgtgcactctgtgtatctatggataatgaaagcacggctttcacacagcaagttatcctcacttcctgtgatcaactctgatatcttctactttatttgaaagagtattgattgtgtcccactcgactgattttacaccctctatgtacatggtccccagtttatgggcagggcggttattttgtgttttattttgtttttgagacggagtcttgctctgtcgcccagtctggagtgcagtggcgtgatctcggctcactgcaacctccgcctcccgggttccagcgattctcccgagtagctgggattacaggcgcccgccaccatgcccggctaatttttttatttttagtagagatggggtttcaccatgttaggctggtctcgaactcctgacttcaagtgatttgcctgcctcagcttcccaaagtgctgggattacaggcatgagccaccacacctggcctgttatgttttttgagatagggtctccctctgtcacccaggctagagtgcagtggtacaatcacagcacattgcagcctcaacctccctcccaacctcaacctgcaggggaggggagggagaggaagggaggctcatctcagggctctgaacctgagcctcccaccagggatttcccagtctccacactggcctggaactgggcgccctcctctctgcagccccatccagcccccacttcccagcatctgcccacggatgagcctccggaggatgggcagcaagtcctggcactgcccctcacccgccccccaccactcagcccctgtggggacctcaggaggtaaggcccaggcaggaccctgtgccacctcccccatccacagcctctgcccccttgacgcccttgttacagaggctcttttcacagcaggtcatgtccagcttctcagtcttcaatcaatcagtccattctcagtttctatggggtaagaccctccagggaccacaggatgggtgaggttcataatctggacacacagggagggccacagcccttgctagtgtagctgaacttctgccctgtgggtgaaagaggagggtgtctggcacaggaagccccacccgacccccttggtcccaccccaggaccgcccccttcagggaaccttgaagccagtggggacacagagacaatcaggagacaagcagaaaagaacaggccgcgccgagtctgcagtccttccaggctcaagcgatcctcctgcctcatcttccaagtagctgggaccacaggcacctgccactacccccagctatttaaaaaaaaaaaatttatagagatgggatctcactatgttgcccaggctgatcttgaactcttgggctcaagtgatccccttgcctcagcctcccaaaatgctggaattgtaagcgtgggcctctgcacccggcctggtccgcaatttaaaaacgcacagccaccattccctctccagaaagcacccagatgcctttgggagaaccagcctcctccatggaggaaagcttgggatctgccttcccacctggggaggagagggatctgtggaaaatccttctgacggacttcccctcagtgcctgatccatactcaatagtagaaaaagtaagaaatatacaaagatagcagatacacggagacagttccccaaatagctgagcgaatagcgcagaagcaatattgaagacctaatagctgagacatttccagaactgataaagtgcatccagccacagatcaagcagcccagaaaattccaggcagcatcaacaaataaatagccccacatgcacccgtgaaaatgcagaagaccaaacaaaaaagtcctgtcaacagccagagaaaaagatcagccaccaggggtcggtagtgagaaggacaactgtggaagccaggagagacgacagccctgagttccacaggcaatggaagaaagactgtcagacagaaaggttgtccccaatatacttgcactaaaagaaaatctttttttaattaattaattaatttatttattttagacaggatctcactttggagtgcagtggcgggaacacagcttattgtagccttgacccaggctcaagcgatcctcccacctctgtccccgaagtagctaggatgacaggtgtgcaccaccatgcccagctaatttttgtattttcatagaggcggggtttctccctgttgccccagctggtcttgaactcccttgatcaaggaatgctgggactacaggtgtgagccacagcaccggccaagaaggtcttttaaaaagtcttttcgggcacggtggctcatgcctgtaattccagcactttgggaggccaaggcgggtggatcacaaggtcaggagttcaagaccagccttgccaagacggtgaaaccccgtctctactaaaattagctgagtgtggtggtgggcacctgtaatcccggctactcgggaggctgaggtagggaattgcttgaacccggaggcagaagttgcagtgagccaagatcacgccactgcactccagcctggcgacagagacagactctgtctcaaacaaaaaaaagaaaaagaaaagaaaagtgatctttaggctagacatggtgcatggtggctctcacctgtaatcccagcactttgggaggcctaggcagaaggatcgcttgagtccaggagttccagaccagcctgaccaacatggagaaacctgtctctactaaaaatacaaaaaaattagccgggcgtggtggcgcatgcgggtagccccagctactcaggacgctgaggcaggagaatcgcttgaacccaggaggcagaggttgtggtgagctgagattgtgccattgcgctccagcctgggcaacaagagcaaaactccatctcaaaaaaaaaaaaaaaagtgatctttaggccgggcacagtggcttgtgcctgtaatcccagcactttgggaggctgaggtgggtgaatcacttaaggtcaggagttgaagaccagcctggccaacatggtgaaaccccatctttaccaaaaatacaaaaattagccgggtgtggtggcacgcacctgtgatcccagctacttgggaggctgaagcaggagaaccacttgaacccaggaggcggaggttgcagcgagccaagatctcgccactgcacgccagcctgggcaacagagcgagactacatctcagaaaaaaaaacagtgatctttagccagaaggaaaatggtcccattcagaatcagagatacctcaagtgatgaagcacagattcgtagaaatgtggtgagtctaaatgaacatcaattctattaaaaaagataaaatagtggccggcgcggtggcttacgcctgtaatcccagcactttgggaggccgaggggggcggatcacctgaggtcaggagttcaagaccagcctgaccaacatggtgaaactccatctctactaaaaatacaaaaaaaattagcaaggtgtggtggcacatgcctgtaatcccagctactagggaggctgagatgggagaatcacttgaacccagaaggcctctcacgccattgcattccagcctgggcgacagagcaagactccgtctcaaaaaaaaaaaaaaagttctgtcttgtgggagatttaagtttttgtggtgaaattaaaattcataccataaatacaaacctggaaaggagtgaatacaatgaggcgaacccactgggcggttacacagtggcccacagctgtagtccccactactcagaaggctgaggcaggaggacggctggagcccaggagttcaagacccacatgggcaacatagtgagatggagcagggacccctcctaggtgcctgccaggctctcccaagcttggaaatcaaggaacactcttgaatcccttcaagggaaattccagtcaccttgccagccttgaaaggtaagtgagcagcctgccaggaaggcgacgggagcacgggtctcccaagcaggccacagccacaggtggtttgcttccctatagaaactaaagcataacatacattctcaagtctttcagaaacccccacccggtggaaaatgccgactgctatcacagagacccagataagggggaactgaggactgaactctggccgtgttctctgtcatgaatttcttcttgaggggcctggagggagtcacagctgtgagccactaatgtgtgcccccatgcacacagcacccttggcataactaactccatcttagagactccattgtatatcttacagggcacttggccaacaaaggtaagatgttttgcttaataaacaagttaaaaataaagcctgcatccaaacagatgaggacgcaagcaagcgcactcttcagatgtcacttctcacgggaggcctctgtgattgcagaaggaaaggccccagcagaactcaccatctgccgcctgaggctccaccacctcgaagacatccttgcaagatccacagactggcccagaccaggaggtttctgtcttcttcttgtgtcttcttcactctcctggactggttcgtgaaccctttctcctatctctgtttcctctggatgtt

SEQ ID NO: 1077 - DNA, 1145 bp, Homo sapiens
gctccggccagccgcggtccagagcgcgcgaggttcggggagctccgccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgcccaagtgggccagctgccctcacttctggggtggatgatgtgaccttccttgggggactgcggaagggacgagggttccctggagtcttacggtccaacatcagaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgcccaaatccagccagtcctgccccagcccacccccacattggagccctcctgctgctttggtgcctcaaataaatacagatgtcccc

SEQ ID NO: 1078 - DNA, 396 bp, Homo sapiens
atgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctga

SEQ ID NO: 1079 - DNA, 96593 bp, Mus musculus
  misc_feature (10187)..(10887): "n" at positons 10187 thru 10887 can be any base
  misc_feature (12842)..(12911): "n" at positions 12842 thru 12911 can be any base
  misc_feature (22034)..(22053): "n" at positions 22034 thru 22053 can be any base
  misc_feature (24129)..(24148): "n" at positions 24129 thru 24148 can be any base
  misc_feature (44031)..(44050): "n" at positions 44031 thru 44050 can be any base
  misc_feature (85698)..(85752): "n" at positions 85698 thru 85752 can be any base
tggagctctgatgctgagggcccgcatgaaggccagctaggtataaaaatgcatctgaagtcccagacggttggaggcagagacggggaaaccacgagacaagcttgctacctagactagccaaactggcaagctccagcttcaagatcttgcctcagtaacttaagtgaaggatagaagacaaggagacctgtaaccccctaacctccacacaaatgcacacagctacaacaatacatgtttgggcccgaaaaatgagatgcaggtacctgtggttgtcaagactcagtgacattttgtgctgacttggagtcaagagtttccctctgttctggtgaactgagcacctgggttcaggccatctaacacctacctttctcaatgggatgacgtcaggcctcacaagatacccctgaaagcgcaaccatttgtctgccttccgcaggaacagtaagttattcagattccaggctctaatggtccctaggaatgagaaagttccctgaacctagtgccttctggagggagtgtgaaatctgtatgtatacaggagtggcctttggatttgatgtaggatgtactttgccaccctgattcagcctaatcaacttcttgtgtctcagctttcctaggtttttctattagtaaaaaaccagagatcatctctgaactacccaccattgcactttgagcgtcctcaaagacccccctttggtggtgctgtggtttcttctgttgtctggggtgataaacagcaaggtgaccctcccctctccactagcctgcaacagaaccacactgtagctgcctcctcaattcccagtgtgcatggaggacacctgctcatgatttgtaagagtctgagccctactctggggctagtgttagacatgttgctagtctcttgtaaaaacataagagatgtctctggagtgtggaagtctgtaggaatcccaaggtgagaggctgaggctcttgctctaggtaacaggaaaggtagacaagagagcagaaaagacatgttcccctaaggactgagctggtgggctaaggaagtacagaagctgaagggtaaactgaggaatgtgggcgatgcatgtttgcaacaggcaaccagcatcactggtgcatgggggagggggactgctaagagcactgtttgagtctgagcagcagtgacatgccatctatggggcattctctatcttccccctggaccctgactcccccagagaaggtggacacctcagtgagaacaaaaagaggccagaaaaagggcaagaaagtcagcagtgtcctgcttcaactctgctgttagcctcccagatggtgacaggcctgatacaaaggagaatagaagccatagctttgactgttctcctcaaaatgatgcttaaattgttgaaatgatatttcgggggcacctaaaagaggctgaaagggtggtggaaatggtaccatgcacttagagctagaaaagaagtaacatcgggagaagaaggcgaataaaattgttttgttgcctgtttggagccctgcatacccttggctactgcagagttggggctcttcactcaagggtccgccccgccccgccccgccccgccctgctagcatgtcctctttcctggaggcctgttcagtctccagattggtgtatctacttctctactcaaatacttctctttctgctgctctggggctaaacccccattcagccctttcacatcaaaaatgccaaggaagtggctcagaaattgtgcatgccatccaacatgtctgtttgccagcactgacctcccccagtcctcaccactggaaaacttcccagtgggcaatggggcttctgaagatgctaacaaagaggaccgactgggactgtgctctgcgggcagggtgcattggctcaaatcctagagagtctgtgtgggtcagctttgctcagagacagcatgagaagaacagtaacaaatgctgacgttagctatgaagtgttgtcgcgtctagtggagcatgtagcatctacctgcagaggccggctcgaggagctttgtcagtattttacggccagcacactgcctgtgctttgtagagagagaagaaactcagcaaagaattccccttgtgcctgaatccttgactcttagccctcattgcccttccattcccagctttgtttcatgagggactttgggtcggctctttagcacccttccccccagttacgttttatttgcttgcatgtgtgtgcctggaggccgaagaggcgttggatcccctagaactggagttacagaccatcatgagtcgtcatgtgggagctgggaattgaacctcagtcctctggaagagcagccggtggctcttaaccactgagccgtctctccagcctcagccagttcttcgtgaagttatactctctcttggctgagacttgagaagattttgaaagtatcatttaaccaactaccattctaatgtattctcggggcactaaggagaggagggggcaccggaactttctctgagcagagccacgtgggtccacatttccttgactcctggaggtgcccatgcggatctgtactagccaggttagtgacaggaacactgggaggccctagcagtatcttaagagtgcgggactccattagaccatgtcctgaaggtcccatggctgctgggttggcaggggctgcctggcctgaggtactctagcctggcacttaactactgaataactgatgggtggctctgggatgctggatgagtggatagggctgcccagacaaatgaagaaatgtcctggcacagagtccatgaaccaagtgcagagttgctcaacggttccaccctttcgtggctgttgttttatcagtgaaaagtgacaagaagagtggactggaggaggggtgaacgcaccatcataattcaaaaggaagggagcctcgggacacctgaagtcactctggccaaagggcatatgctgccttatgctcccgcagccgggcctttaaccgcttcctccaggagctaaacttctttgaaagtattttaaacagatgagctggagccttcgggataaaaaaaaaaaaatgtccacatattttaccagttttgtcatggccttgtttggttctgaagtaaaatcttaaaagctctctgagtctttcatcaacttccccatgtccagctttgctaagaagaaaactgctgcctggacttagaggaagagcgaataactaattcaccaacgtattaagatgggatgaatgggggcaccagatcatcactgatgaaagcaacttgcctcccagccagtctaggggaaatgattcttcctcattagtgcacagatatacgaacatgacctacatttaactactaaaaaagcacaaacacatctcctgacttatcaaagaaacaccagtaacctggggggcccagggcgtcagccaacccatttgagcccagcagccaggagccaggagccagtggctctctgtgaattccaggccagccaggcctacagaatgagaccctgtctcagaagtaaaataaaacagaggctggagaaatggctaagccattaagagcgtttgttcttgcaaaggacctgagcttggttcgcagtacactaatggaggctagctaacaactatctatagatttagttccaggggacccaatgccctcttctgacctcttctgggtgccaggtactcgtgtggtgcgcacatacacacatacatgcaagcaagcaaaacatccactagacacataaaaaatatttaaatgaaagtaaatattaaaatataataaaattaaaaacttcggaccaaaagatagctcttacaagtcagttagaggctagtaataggatgtattagtattcagaaataggatggaactgaccagctctagaaatagtttctagcatcaggatgtattcatttcattaacagaaacggcaattttcacacatcgcaccttgaatgagctgacttgtggtttgaaacaaatgaatgggcttaaaactagctaagaagtcagaaaagacagggcagtgaatgactgctcatcagaatagagaagaggtggggagagataggttttaaagacattcattaataatatggggaaggaagtgaactgcaagatcgtgtctgctgcaatattgttcccgttaccaaacacagtgaggagaggaactctagacgaatttaaaacccagcgcacaaagccatagacaaaatgagatggaaaagcagtcttgcagcttggatgcagaccttagtctgtaaaactcgattcctgaatgctttatattaaggaacaaagactagtgaagatttctgcagcaccagttgaaaaaaatgtcattcctaaagtgctccttcagaaatgaagtaattagaagtgacttgggatgaaaaggaagaggagctggagggccttagtggaacaatgtgatcatttcaaactccactacaggaagatgtcctgggagggaaaattaatgttacttcaaataaaattgtttttatatgttttagtaacaaactagtaacagagttcatgaaaaacaagggaagttagaagaacctactgtaagcaacagtattttttcaaagaaaaaaacaaaacaaaacaaaaaaacaaaagaaaagctagctttggaagtctacctggaggatgtcacaaaagttttcaggtcagacggcttccatttggacgactatgataacaaattacaagtgagaaatttcagaaaagggaagcgccacgtctgcagagcagaggaagttaagacatcactcattcatgcgtgagcacactgaaattgttaaagaatatggagtgcaggagataaaacccctcgtcgaccacctctccctccatgggagggggtggggaggagagctatgcaaagctgcctctctccttgtgctaggagggtttcatataatagaagtgatcagtactatacaatgactcacgtgagagccactgcccaggagagaaaggagaggaaaatgaggcaaccctcggccagacttttttctcttctcttctcttctcttctcttctcttctcttctcttctcttctcttctcttctcattttcttcttcttcctttgtttctttgtttccttctctctttctttctttctttctttctttcttcctttctttctttctttctttcttggagacaggatagctgtggctggaatggaagttgatatatagaccaggctggccttgaactcacagatattggcttgcaactgcctcctaaatgctggaattaaaagcatgtgtctccatgcctggtttaggaagccattcttaacaagttgttggggaaagtggctcaaagtgactgaggtaggaaaggttcgacacaggctgggtccaatctaagccccgaacacctggcggaggaatgtgaacttcattcattagtcatctgtagctggcttcctgacctgcactgctcgattgcttggtgactgatacaatgaatgaagccattcataaggtttttattgttgttgttgttgttcttgttgttgttggcttggtttgttttccacaaaccaaataagcttcctgggttttgctttagattaagattcattggtgcagaacaggaatgaacgaggtgggagacttatcacatgcgttcatgtcaagagcttgatgtggcatttactgaactaatcctactagatacgtcacagacatgttctcaacacttacttaatactattgataatccttcagagaaggaagacccagtgtaacatttcagttctgcatcagagaagcacatgcagatgtttaaagccataggttagctctgttcttagatgctagtcagaagcctccttttgcagtggccagaggtggatgcagagattcacaacgggccagagagctgagaatctgggactgagaaatgctcagccctagatgagacatccaaccacttctgaggtccagaggacttcaaggagggatggggcaggaaggaggatggggaggagagctatgcaaagctgccttctggacttgacacggcctttgtgctcatgaactccaagcagctgtgcttacctacacacgattaaccgggtcaacattccagccccgctgtgggaggggctcgtgagcaccttcccctctctgaggagctgtgtaggtagttaatgaatggctgctggggtaaggggaatcattttcttgaggggtgcaaccactgttcagttgctccaataaataagccttgatccacagccctaattagagtctatggcatgattgggcacttgtgcaaaaacacacacacagagtcacagacaattctctctctctacacacacacacacacacacacacacacacacacacacacacacacacacacacaaggatgaggacttttggggggggaaagaaggatctcagtaggagtgggagaggaataagggggtgaataggatcaaaatatagtgtgtgtgtgtatgtgtgtgtgtgtgcatgtggtcgtcagagaatacattttaagaaaatatgtttaaagactaatttattaggtatcttatgtatgtgggtactttgtctgcatgtatatatctaaacatcagagagggcatcagatcctatcatagatggttatgagcaaccatgtgggtgctggaagttgaactcgggaagagcagccagtttaaccacagagccacctctccaaccccaagtgggggaaaaagtccttttacaaagcttgaatatcactcctaaacatcacagctgtaaaaggataggataaggtttcgtataggatctacaaagccttgtctttgaaaaaaattgtattgtggacactcttcagatgaagtcttgtttttatttttaaagaattgccatgacagaatggaaaggagaagagagagagagaaaaaaagaagtttcatcagagggatgtgacaaccagagacactgtgaagagaaggtctagggaaatcagtctccagatgaaggagagtagaggagggaaaggccaaccgaaactaaggattatgaaaaggtcacaagtaaaccagatacttgatatgataatttaaaaattgaattaaataaaaggagtttgatggaggtaccctgtgaaagtagataaaacttgcgcagagaagctaaaggtcatcaaatgcaaaccctgtgctgggagtggaccatttctgttgttggtcccacaggcccaccaggcttccaagcaatataagcaatcaccactgtggttggtagcccaccagaactagacttgtgaagccgaagatacatgtgctgaagagaccacagggcatacagacatcaaggtgaggcagagaaggcgcttcctcccagctagctaacccctcatcatgccagaaggtgctattcaggctgctggtagagaactgtcatcagtaatcttactcagctggggtccctacttcctacatcactgacctgccaggcaaagggcacctactgacacactagtgggaagtctgctatgggggtgaccaaccacttcctgactgcaactccttcagaggaaattcacatctggtactataaacctgttaaaaagcctatggctggggaagtcacagccccagtagggcaggtacagatgttgttctgctaaacagatgtgatgtgtgcaccaagttgctttccaataattgtgcttgtgcataggaattcgtgaggatgtcatgtttgcttcgagaagtccaccccctcatgggcagtattaaacgcagagattcataactagtcactgagaataaaaaactggatgctcagccttaaataagacctgtatatcaccccccctcggaggaacgttgaggaaaagatgggagaaagagtgtaagagtcagaggatagagtggagtgtggtggaattttcttggcatgacatgacatggctgtcacattttttgtacaaagatatttctatttgtatgtgtatgagtgtttacttgcatgtatgtataccataatgagtgcttagtgtccctgaaggtcagaaggagtaggatcccctggaactagagttacagagcattgtgagttgccacttgggtgctgggaactcttctctaagtgctctaaacccttcagccatctcttcagccattctacctgacagcagctgtggttgtctgtactatacaagatccgtgcaatactgggagccaacatcctgtggtagggtgcaggaggatttacaaggatttttgacagttgatggttgccggaagagacattttcttcagtagtacagccactgttaagtttcctgtgctcctgtaattaatctctcgtctatgcttctggaaacaactctcataaactcattgaactaaaaaaaaaaaaaaaagtcttgctggtgtgatgactcagtgattaaaggttcttaataccaaaccagatggccgggttaatccctaggaaacccacggtgaaaggagaaccacctcccaacagccatccactgaccttccaggggattggaggggaagaaagccagctgggaggagaggaagggggtgcaggggatgtggacggcgatgaagagggtattgaatactatgcatacattaaacatgtgtatgaaaacggtatcacaccatgactgtgtataagtaagacataccaataaagcattaaacgttttaaaatagaaaaagccagtctctggcctgtggtgtgtgagctctgatttggaaagaaagggaaataccatttggagtttctgtttgaaacaacaaaatgcctggaaggagaggtaagctcactttctccaaggctgtatggtacaggacaaggggcaccctcatgcatcaccagctggactggaagtattgctcggtagcctaagacatccagcaagcttaggtcactccgtctgcctgactggccttggcacaagtggcttctgggcttgcttgtcgtctgttcactcttcccaggcaggctctccttgactctgtttccacaacttgcttcttctctctgtgtgcccttccaggttgaggtgctcatggtcttggcgccttctgccccgtctttttgccctagggccattcctatatgtctgaaaacattccttgactggctgactctagcacctggcaaagaacaaccctgctctattaaatcagtttcttccttcttagggcagcgcagttaaacctcaggaccaggaaatcatccctctcctcacataccagggtgttatccacacagtttactcactgtaaatagttcccttaagatagtggcaacaactagttgaagatttacaaacttcccagggccaatctactttctaaaaagcctgcttctgggagtgggaaagaggtcaccgttccgattctgaaatgcaaaactggtgataaactcaaaatttctctgggtctcagacaggactggacggagtctgtggtccttttcttgacccaactttttgcagagcaatgttcccagagcaaaggttgagtatgtggtttgtcccccacgtgccgcactgcgggagcatctagacaccgctggaagagtctctaatacatctcttgacgtttgccaaaatgccaaactttttcctggaacctggagtcattctgactggggacttttcttttccttgagcatctggggacctagaggtccgttcgtgggggacgtccaattctcagggttctggggatcacagcagggccagggttttcctccttgtgggggtttcagagcgcctctcgcgacttgcccagggaggcaaggcgaggcggatgcagggcgggcacggcgcgaggggcggggcgagtcagcccgaggccgaggcggggctacagcgaggctcgatccggcctaggcctcgctccggctccgccttgcccggctacgcaggcggtagggctggggtaggggccgggcggcaccatggcggcggcagcgcctgctgcggcggcttctcccgaggcgccggccgtctcgggcagcgcagacccggagacgggagacgaggacagtcgtgaggtccgagtgctgcagagcctgcgcggcaggatctgtaagcggggccggggctgaggggacccccggggcggcgcggagggtgggcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcgagcggggcgccccgggagctcgggcaggacacttgtgcccgccccaccttgccgcggcggggacttgaatcgagagccggcgtgactgacggtgacttggggcaggatgtagtggcttcctgtgagcaggtctcaaaactcagtcatccagtccgcgctcaacccacttgattctctcccgtgcatttgtgagagccgcaccgatgagtgtagactcttactcagagacgggccagttcgtttgtcattgctatccttcctctttaaaacgaccctttgatattagatcgacttcccccagcttattgagatggtcccttttcactgtatgactggcgaatcagtagagtttattgttactttagttgaaaaccttttttaattcagattattttatccccagaatgaaatcggtctcctaaataatgcctggctataagagatattttatatgttgaaaattcaattgtgttagaatggctgatactgctctttctttggcagagtataaactttaattcttaaatctcgatgcttcttttggattctcccacttgagtttttgatgttactcccctttcaaggatttggaattttattaaaaccccaggagcaagcatgttaaatgttacttttcaattccctgacgtcatcctgggactcccaattcagacacttttaagtattaaaacttgggaaattacaccagagcagtgggtgttttgtgcgtcttaagttcccagtattttaagttactttcttagggtgtaaacttttcacaaattagctttcttacagttaatatttgcatgtatgtaatgtttgggaaaagccaaatacactagaattttcttcccctactaattaggtttttcaaatttttactactttatatttttctgtgacttgatgctagacactgttgaagccttgcgaatctataaaagcagattgtgttgtgggaagacagtgtgctctgttggagttgagatttagggttgggctgtttttaggagtaagttaccttctgctttgacctgatgcatagcaaaggttctgtgaacagtgtggtaaaaatatcactccaagtgaaattcgggtctgcagattaaaacacacacacacacacacacacacaagcacacaaaacttggtttctgtggcttaggcaatctcactcccagaaattgaccattaatttcctgggaatatttttattttaaccctagttaaactaaaccacttgtttctaccctagacagtttatttattttttattgctcatcttatagctcaggtcatgttgtgactgtttcacaaggatacatactgaaatcaagaacacccctcccatttcttgcccttcttttagctggtatgatcaaggttggttgccctccggatccttgtaaggaaatgcccttctgtgtttcctgaaactgacacgtgggctttgtaaggtgatgagaagtggcggaaacattagcaggtgctgaagtcacagaaatgggatgatggcagtttgacaatgaagaatctaagcagtttgcgagtgttgaagtcaccagtcctttctaccacactgagaaaccttggggagaacctggtagctccctgttagcctggagatgagctgttaagctcagaactgctctttgggagcctctcatctgatccacctgagaggaagcactcctgggtagtgtagtccgaatcatccttaagaagagcgagggtggcccgatgtttatattgtggaagttctagaggttagataatggtccacactttcttcagtgtttcatttctaacttatttgtgtcccatagatttcacaaggtataaatagtatcaagttgacagatcagaaaaccagcgggtgggggagatgggctcagttggtaaagtgcctgcttagcaagcaggatcaccagagcccaagtagaaannnnnnnnnnnnnnnnnnnnnnnnnnnnnnnnnnnnnnnnnnnnnnnnnnnnnnnnnnnnnnnnnnnnnnagagagagagagagagagagagatcaaaacaccagatgttggtctcaggcacccacacccatgggcatgcacatgcacacacagctagtgcacacagtcagtacattaacaagtacacacaccacacaaacacacacacacacacacacacacacacacacacacacacagagaccatcatatagctgttttcacacaaccagtttaaagaaatctattatcgcagacagtattttgtgttatagactgattagtgcccagtttcttagggcattttagtgtcctagatatcctgagggttttgaatgttcagcttccttacctgaattcacgacacaaagttgttagatatcttagaattttcatctgaacctttagtaaacaaaattaggagtatttttggtctgaactactttgatataagtagcatacctaaaggtagtttgtatgcaccccccctccattataccctatattcaggtgaaaaaaaagttttagatttatatgtgtgtgtgtgtgtttatgtctgtctgtctgtcttcaggcttgatatggcctcgtttttggttacccccttttctaattaagtcaactgtaaacattttgaaaggctctacactaccttacacagggcttttctctcagggataccaggttataaaggcaccagcctgcgaagatttgtgggaagtgtttgatatattgttcagtgagatctgtgagacagtgatgtggcccaagaactactcacttaggattttgacattttcagaccaagaatgacttccggctgtttgacaaaggagatagattaagtacttaagcttaggaggcctggtgtagtcagtaccttcagccccagccccctaaaaaaaaatctgggtcagccatgggccatctcttaggaaggagttaagtaggagataagccttatctgatgctcttgtccagcctgcactaacgtttcctggtgtagacagcaaattggaagcagaaagcccgtgttctgcttcatactgtgttaggtaatattcctgtgacttcaggcagctgtttactcttgagcttgtggttgtttttatctttctcatctttagagtggactagtgctttgtcaccagacacttggctcacgttgtttcctctgcctgagattgtgtccccccctccccttatttatgtcagagagccacatatccttccaatgcaatccaagtctcctctgaccagatttgcccttgtttctagccatatggctttgatgcctaaaaaaagaaaaacgtaattcatgaccattttcttcttataaaaatcatttgtatatgtcccctgttatgttaattttagaattcattcttgtttttaatatttgttgctgctggtggtgtgtgtgtctcagtctcactagatcagggcaggcctttagaaaataccctatctctcagtgttatagatactttcagagcactgtgtatctggataagaaagaatttccatatctctggacagattagcagggttagctttagtaaaggaaagcttcctgagtctctctggaagttctttattctttttcttgaaaagttgtaatgtctgctaatcttaggtttgaactgaggccaaacttgcctccttaggaaaaggattacattttttctaaatgctggcttattaattagaatattaattgtttcctgactgtgtccattagttttgttactaattggtccccagagcttggaaaagaaaatattaaactcatactttacctagaattgtttttatttgacatgacaggtttaaatgttttggtactaagatgtaaatcaagatgttttattgactacccaagggttgagaggaagagatttaaaagggattattcatgctaataattcattattatcagatgtttgaaatgagatgatgaatacttagtagaggaatttaaaagggtttactcatgctaataattcattattgtcagatgtttgaaatgagatgatgagttctttaggacggaagaagaatccatctttgagatggatagaaacagaggaaaaagggacctttgtaaaagttcacagagcattcagctaatcatttgctctgtgcaggacaggaataaacctcagggagttcatagagtttttgtaactgagaactctttgaatagccctggactgactgggaagtaatgtagctagaataaaaccaccatttttatcctttaattataaaccctaatcctatttccttgttaacgtgctttgtgaaattatttgataatatcagattctgtgctttacctactgatatatttatacccttttataccctagtaacagttttgttgtatagtcatgtgttattgttaaattaggaacattttgtgtatgttaaatttttatgacatctagttttgtgtaatgtttgttttttgattttttttgttttgtttttcgagacagggtttctctgtgtagccctggctgtcctggaactcactctgtagaccaggctggcctcaaactcagaactcgcctgcctctgcctcccaagtgctgggattaaaggcgtgcgccaccacgcccagctttgtgtgatgttttaatcatcaaaaatctctagctagattggcttcattctctttgtgtgtgtgtgtgtgtgtgtgtgtgtgtgtgtgtgtgcgcgcgcgcaggtacatatgcatgtgtgtatatgtagatgccagaggatgatctcagacattgtcctcaggaaacactgtccacctctcttatggcttggagccctactaattagtctagactggctggccagcaaactccatggatccctctgtctctaccatctctgtgctgggttacatgcaggacccttcacacccagcatttttgcctagtttccagggattaaactcaggtcctcaggtttgaggcaaccaaacatgacttactgactgatctctccccctagccccaaaatggcccattataaggttatatcaaatatgagccaggtggtgctgacataggcctttaatcccagcacttgggaggcagagacaggcagatatctgagttcaaggccagcctggtctacaaaccaagttctagtacagctagggttacacagagaaacagagtctccattgccacccccaccaaaggaaagaagaaaacatttttattattgagtgtggtttctttttcttttttttcttttattgggtattttcttttcttttttttaaaaagatttatttattatttatatgagtacactacagctgtcttcagtacatttcagaaaagtgcatcggatcccattacagatggttgtgagccaccatgtggttgctgggaattgaactcaggaactctggaagagcagtcagtgctcttaaccactgagccatctctccagcccaagccttctctccagcccgggtattttctttatttacatttcaattgttaccctgttcctcccccaaatgttatcatcccccctccctctgcttctatgagggtgttcccccacccaccactcctgtctccccaccctcgaattcccctgcactggggcatcaagccttcacaggaccaagggcctctcctcccactgaagacagagaaggccatcctctgctacatatgtaactgaagccataggtcctccatgtgtactccttggttggtagtttagtccctgggagctgggggggggggggatattgttcttcctatggagttgcaaaccccttcagttctctcagtcctttctctaactcctccattggggaccccatgctcagtccaatggttggctgtatttgtcaggctctggcagagcctctcaggagcctgccatatcaggctcctgtcagcatgcctcttggcttccacaatagtgtctgggtttggtgactgtatatgggatggatccccaggtggggcagtctctggatggcctttccttcagtctctgctccacactttgtctcagtatttgctcccgtgagtattttcttcccttctaagaaagatgaagcacccacactttggtcttccttcttcttgagcttcatgtggtctgtgaattgtatcttgggtattctgagcttttgggctaatatccacttatcagtgagtgcatagcatgtgtgttcttttgtgattgggttaacttacttaggatgatattttctagtcccatccatttgcctacgaatttcatgaagtcatggtttttagctgagtaatactccattgtgtaaatgtaccacattttctgtatccattcctctgttctttccagcttctggctattataaataaggctgctatgaacatagaggatcatgtgtccttgttatacactggagcatcttctgggtatatgcccaggagtagtagagccgagtcctcaggtaatactatgtccaattttgtgaggaaccaccagactgatttccagagtggttgtaccagcttacaatcccactaacaatggagaagtgttcctcacatatgtacagctttcctctttctccacatccacaccagcagctgctgtcacctgagtttctgatcttagccattctaactggtgtaaggtgaaatctcagggttgttttgatttgcatttccctgatgactaaggatgttgaatatttctttagctgccattttagccattcgatattctcagttgagaattctttatttagctctgttccccattttctaatagggttatttggttctctggagtctcacttcttgagttctttgtatatattggatattagccctccatgggatgtagggttggtaaagatcttttcccaatctgttggttgccatttagttctgttgactgtatcctttgccttacagaagcttcacaattttatgaggtcccatttgtcgattcttgatcttagagcataagccattggtgttctgttcaggaaattttcccctgtgcccatgtgagatctcagaagaagatggaaagatctttcatgctcatggattggcaggattaatatagtataaatggccatcttgctgaaagcaagctacagattcaacgaaatccccatcaaaattccaactcaattcttcatagagttggaaagagcaatttgcaagttcatttggattaacaggacagtgaaaactattctcaacagtaaaagaactgggggaataaccatctctgacttcaaactgtattacagagcaatagtgataaaaactgtatggtactggtgtacagagacaagcaggaagatcaaatgaataaaattgaagacccagaaatgaacccacacacctatggttacttgatctttgacaaaggagctaaaacaatctagtgcaaaaaagacagcattttcaacaaatggtgctgtctcaactggaggtcatcatgcaaaagaatgcaaattgatccattcatatctccttgtacaaagctgaagtccaagtggatcaaggacctccacataaaaccagatacactgaaactaatagaagagaaagtggggaagagcctcgaacacttgagtgtggtttcttatagtgctattaatgatagactaaccgtgcatattgaggagcccctactttacctcaaaaatgaggacttgggtgtgtctttcagaagatacccctcaaattatttaatagttgctttacgaagtgcaccatttgtcttaagataatacatcagagccctttgctttagacttgagtttgtttaatatacttgttttgtatttaatgcagtacttttaagaaattcgcctaagatttattaaggttgtttgaatcctaaacattttccagtgggcagtagttaattcagtagttgtatatgatacatagttgagtatctgatagggtatatcaacccctggtgctgagaaataggtctaagctgtgagtgggatgagaaagtctttactcagcgttttactctgaaatttatactaagcagtagcgttcattcattctctgcttagagagttagaaagctttagaactggaaggaaaagaacactgttgttctgttcatgtgtacgtgaagactagaggacccaagtggcacacgttaatcacttgttggacactagtgcactgttttttctagagtgctgttgatttattactatggatgttgaaaatgcactagatttaagctatgaagactgctttacctccccgatggtttttagagcggtgcagttgaggtttgtacccatgctcatctgctcctgctaagaacttagtgaggtgattaggaccagcaatgccgtgagctctgtggagataatctggatgtttactgtttgtgtcaaatcccaccttaactttttgcagtccatcagtgtctcttgaatacttaaaaacgtttgatatccagactctaaataaaatcatcattttgagggtctaccagcttagtttgtatctttttagaggtagtttaagcataaacaaataattgcttgtgtattgtagcttttccacttcagagaaatagaagcaaaatatgcagtgttctgcatctttttaaatataacttaaagatgtttttatatcctcacttaaaaataatatagtatgtataatacctcatctcacatcatctagatgtattgcattttaggtaaccagtcacctgttgattgcaatttaagttgtctcttgtctttgcaataacaaacattgccaccataaatagccctgtttatcatgtatatgtgtaaggtgtgtgtgtgagtgtggatgtgtgctactagggagaaaattcagggtcttatttgcactctaccatcaagccaagctgtaggccatgtgtgtgtgtgtctgtgtgtgtgtctgtgtgtgtgtgtgtgtctgtatgtgtgtctgtgtgtgtgtgtgtatgtttttggaagcagagtttctctgtgtagttctaactgccctaaaactcactctgtagacctggctggctggccttgaactcagagatccacctgtctctgcctcccacgggctgagattaccattgcctggctgctacatgttattttaaatgtgagctcttgctatgcagcccatgttgaccctgaatttgggataatattcttgactcttgcactggctgagtgtgctgggattacagctgtgcaccaccatgtctgggcttcatacagatttttaaattaaagaggttaatagaaaaatgaatgcaaagacactccacagaagaaaataaattatctagtaaatatatgaaaatgctggtgaaattgaccagaaatgaatcagagaaataaaagtataaatacctcaacacttaaaaaaatggaaaccttgtatatttcagtattgaatgaatgcttaaggaaacagatactgttcgtactttcattgtgattttacgtttataaaaccatgttagagcatttggtagtatctaataaaaacctagatgtatttttcttatgcttttacttttgccatctcatcctgcagacacaaagatattttgtgttgaccttgtttgttttttaaaaaggcacattgaagttctagtaacaggaaactggttaaagtggtttgttcataaatatattctatagcagttaaacagaataaactacatctatattatgatgaccccaaggtgtattattgagtgaaaaaaagcaaattgttagagtagtatgtatgtttattatctgtcatccatctatccgtctgtccatctatccctttattctgtctctatgatgcccaaggatcaagcctgggacatcacaaatgctaattaaattttctatcactgagctacaagccagccccttaatgtatgcttttaaactcttggaacagtgggtttttcccccctataaattagataaattttatttaaaaatgtctagaaagatgtatattgattttttccccaatgatgggcaacaggaattagtcttctgtaatgacttgattttcaatagggagtatagtatgtatttgagatgttatttcaattttctatttgtacaaatgaatttgatagtgtcagatattgtgagactcaatttaacttttgattgaatactatatccaaaatcagacttagtaacattttaagcatacattgaaatgaataatatcaaattttctgttttcaatttctacttactagtttgtatataaatgtatgtaattgtgtgggaaggtgtgtgtgtgtgtatgtgtgtgcatgtatagtggactacttgtaggagttgattctcttcttccagctccaccaggtcatcagcattaacagcaagtgcctgcacctgctgagttatctcaccagccctccttttatgtcttttgggcaattttaacgatgcctatttaatcatgaatgtgtgagtgcaggtgcctatgggagctaggggagttagaggtggttcggaccaccctgtatggatgcctggaactgaactcaggtcttcttcaagagaaacatgtgttagccccataattttattttgaggttaaagaaaatgaaactcagaaaaattcaatggattcctatgtactttgcctgtttgaccagttgcttatgctaagaagattgacttttcgaaaagttaatacttttcaaaggagtgttatataaaggtcctgaataattttgaacctgtgtatttggacagtcttatttatataaaaattgctcagtatataaggggaatgaagcagtgtttactgaatatttgctgctttcccgatattgggctaggatactttgcttcatttcgttacaggattgctgttctttaagaaggagcagcagagaggctctttagcaacaccagatttcagcaggcttgttgacaaggctcatgtccgttccctacaccaggttttctgtcttgtagtgtactggcatgaattcatttttgttgtcaagacatggtgatttctctaaattaacagtggcctaatgaatagagattaaagctagattgttgtcaaacacagtaaaaatgagtccagggatttgtaaaactattctttggttttcctaaccctgcttttgttggtttttctcttctannnnnnnnnnnnnnnnnnnncccctccctccctccctcggtccctctctcccttccccttcctttcttcctttctttctctacttcccttgttttttgacatgaaatctctctcactatgtagttctggctggcctcaaaccctcagcctagtgagagtgctagagctcaggtgtgtgccactgatctctctgttctttaatgcactttcttgcttttgagtggtccccctaatatgtacacaccttttataaatgggagttgggtatgtgtatcttctttgataagagttccattatcaaagataacactcacatcccatgtaaggcctgtctacatgccccgagactctcccagcatcagcttttagctttttgcttggcatttcaggctctttaggttgccttatgagccttgctaagtatcatggagctgtagggaccaatggcctagctcagcagagattacaccataatctctgattgctttctcaccatgcacaggggcctttagggacctttagggacctgctcgaagctgacaccagaagtgagcaaggcagaccacaggaagatcttcctgcacttggtaacatacgtctataacctatggacatttcctggcaataccttgtgaaactagccttttcacgtacagtagtttcctaacttcttgttctagactaagcttcagtcagaggtgagtagcatgatcacaatatagataactggaacagttattatgcattatctttgatctgaacgtggtggcttgaataagggaattttatatagatgctaacttttaagaacctctagcccagcaagagtactagttcttgttttgatttgctaagtacttactttgttttagatattgtgccaagtgctttaccacagttaatgttcacaacagtcctaagtattacctcctttacacaggaagttgaaactaaggacataacagattctaaagtacaaagcttatattgaaactcagatgtctgtcttaaaatgcactcatttaacttgctgtattgtcagtactacttgttttagaattccctggtgcagaagttgaaattaaaattaggagaacattttgaagactttactatatattatcatatcatacctagggttgtctgatgtatagttaggtagcattttaattttatctaagcttatcaacctgagtccgtattttcaaatattttaaagttttttaaagatttatttttttatcgtcagtgtatgaaagctttgtctgcatgtccgtgtttacatgtgtacctcatagcctcaaggaacaccatatcccctagacttggagttaggggttattgtgagccatcatccggctgttaggaaccaaacttagttctctgcagtagcaacaagtactttaaactgctgagccatctctcttgctcccacagtatatttttaagtatgtatgatccttctttgttttttgttgttagtgtgaatatatggtgacgtttacatactgtcatagctctcactatgtaaaagctaaaagcttctgtttaggttgacatctctgaggacatcatgttttgtgtcacttgagccagtttataccagattctatgaattctctctctgtagtttctcttcagttttttctttcatctctttccttttcattacctcagtctaagttagaactctgtagccttccattttaggttctctgttggcctccatcctgtatcctcctgttctcccttaatccccctgccttagtttgtgatattcactgctgccttgaagatgcttcttgttcccacctccattaccaaagatgacatcacatcccatgtaaggcctgtccgtgtggtaggccttctattggaacattgatcttctggtgttaatttctgtatttttttttttttttttttttttttttttacagttggatgatcttttttttttttttttttcttgtacaaagaaaatttatttctctatgttaacatttttcttaaaatgcctaggcttacttttcttttttttttttttttttttcccccattttttattaggtatttagctcatttacatttccaannnnnnnnnnnnnnnnnnnnctttcccctgtaccggggcacacaaagtctgcgtgtccaatgggcctctctttccagtgatggccgcctaggccatcttttgatacatatgcagctagagtcaagagctcaggggtactggttagttcataatgttgttctacctatagggttgaagatccctttagctccttgggtactttctctagctcctccattgggagccctgtgatccatccattagctgactgtgagcatccacttctgtgtaatttctgtattttgaaaaaaaaatgcaccattgaaagattttaagtaaaataacatgacattctttaaaaatctgctatgtgtaacatattaacttattaagtaagtggtagctttttattatggtttggcttgactttttcctgctccaaatagtctttattattattattattattattattattattattattattattactttgttcaggaccctgacctattatgatttcctctgaggcttgatccctttaggatctatgtttggtccttttcttctttgttttaaaggtatgctttgaagtagggctgggtttaccaagtctctttcagacaaggatagtctcagaactactattttcgaaaatctttaagaatagagtggaaagatagataatcatgctattggcttttgactatgatttattcattgatgctcttgctgctgcagatttactttataaaaaggaacagaattgcttacctaatagggttgttgtacaaatcaaaggagacatttgagaaaatccttagttgtgggtcatccagatatttaagagatagtgtatccagtactatgctcacctagcacattcttaaacaacaataaaacccactgataagtatatatacagaatcttccctaaaacatctacataaacacgtgtacacacacaggtgtacaaaccacacttatcaaagtaagtgtgagcagctttgatgtaagtattctagtgccaggtacaatttatatggtagactaggaagatggctcagttggtaaaatgtttgctgcaaaatcatgagaatcttagtttgattcctgcaactcacataaaaaaaaaaaaaacccaaatatgatgagatgcacttgtaattctctcttgggggagatgggacaggaggactcctgggacttgtgggttagttaatctaggcaaacttgttagctccaggttcagtgggaggctctgttccctaaaaatttacatgataggctctaaacagaagcatgcccgcatggagttactgtataatctacacagagaggacaagcatcaagacaaataacgtcggggctggagtggaggctaagcagttttatgagcatatatactcctcttagaggggatgtgagtttaaaattctcttagagaggatgtgagtttttaaattaatttaatataaaaactgataatagctgagaatggtgataacccagcacttgggaagaagaggtaggagggggaagagtgcagggttatctctgtctgtccaaggccaacgtggaagctctgtctcaacaaaaaagggaaaaattgtgtgtgtgtgtgtgtgtgtgtgtgtgtgatgaagaaaagctatatcttattggtcagctaaaactgctgtcatataatgtgaaggtgttttggccaacttacactgcatctatgaaagaagaaatatctaatgaagagtttattttgttcatctctgaaaatttgtggtttcataaaagggacaatgggtgccccgtggatttcttcttttttgtttgtttgtttgttttggttttggggttttttgtttgtttgtttgtttggtttggtttttcgagacagggtttctctgtatacccctggctgtcctggaactcactctgtagaccaccaggctggcctcgaactcagagatccacctgcctctgcctcccaagtgctaggattaaaggcgtgagccactacgcccggcggatttcttcttaatacatacgaaacctgtaactggtactgcttgctaccagaaactaccaaaactcagtgtccttctgttttccagttttctagtgaatgactctgattagtggaacttaaattagtagaacttagaaacataaacatagcggcaagataggttaggagaatttctagctttagagtctccataataccagaaagcacacaagtaatgctgtaccgctaactcaccatatcttgtatgagtataaagttgattcttcttaagaatagaactcagtatgcagactggagttgccttgaactcagagatccattcacaaaacttcctgagtgctaggattaaaggtgtgtgccaccatgcatggagagtctttttattttataatggcatgttttaaaaatacctaacagtggccttcctctgatgaattaaatagtctattccaagtttcctcccatttaaatatgctctgtagataaaagcctaaatgaggggtaaaacaaagaccgtttagcaggagctgccaaacagagggtgggttagtgctaagatactagagagtggccacatactctggtattgacaggcagtaattcgattcggaagtgcttagtgttactagtgttcgtaaaggttctaggcaaaggaaggtctgaagctaattgtagaaggctagggtatgagtgaaagaggagggttagaggatgggtgattttgactcagtcatgtgagttatagcctaaacttgcctggaagtggtaggaccatctgtgggaaaatgcaggcttcaaatgtgcttcactttgtactttatgtacttgatggtggagggtgcgctggcaacaccttcttctgcttagagatgcagagaggcggcagtgctttcgttcgaaccatcgcctagggtgctttatcagtgagcagtaatctctactgtagtttggaattacagtttaaaactcctcataactgataaacattactgtgattattttggagaactgggtttgatgggatgaattttcaaaacagcttatttgaatgtcaaccagtggtaaatagtgaaaaaaaaaaaaaaacatcaggaaaactacttttataaaaagtggtgctgggtgcatttcttacactatctgagacttggcctttgattattttaagtaaatatctggcaattcagtttcattaaattctacagacaaagtaacccttgtttctctcttgtggggtgggactggtagattatttacacattatgccccattattttctaaccagtgcttagcatgaataaaacagggacacgtcctagggtaatgatttaattttctaaactctcttttacatatggagcgtatttattgtagtcatatgtgtatgtatgtatatatatatatatatatatatatgtatgtatgtatgtatgtatgtaactaggtggtgtattatggactctataaactttggttttaaaacaaatccattgtgttattcagaggcaaaggaaattctgaagaagtttgacagcagtgaaaatagaattgttaagcaaggtcctatgtagggagagaggagggacaggggagagaacctcaaactcacagggatcctcctgcctctgactccagtggctggtatcacaggcatgaccaccattccagccagttcattttgtttttgaaatgtggtttctctctccctgtttgttttgttttgttgttttgttttcccttaagatagtttctctgaatagctttggttgtcttggaactcactctgtagaccagcctggcctcagtctcacagagatctacctgtctttgtctcctgagtgctgggattaaaggcatgtaccactactacctggctgcaggttttatcttgttgacgccagagcttctgggtgggtctcctgtgtcacctcccatcgtcttactgtagaaacactggaaacattatgtgcactccagcttccagctagtcaggattgcacacaaatgttcccacccacttaggcttcttactggccccttcctcactgtcttagatttgtacattggtatgggatttcagtatacacatcaagtagacacttgggtgtcgtccttttggtacacaaatagctcatgagaccttcaaagcttgacttgctgggttctttattccttcaacaaacatatcaccagagttttcctgttttagatcttgggcattagcaagttctcagaccttgtacaggagctgcagaaacccttaacagaagttcagcccattacaaattctctcaaggaaaccaaacctaagactaattagggaaaaggtcaagtgtcatttgaggtcaggactgaatgataagaatgtcccagccgtgtaaagagtagagagatccgggaagaaataaacttgataataaacttgacatggctgatgaatggagaaaagtgaaccaagggaagaacaaaagaaggagtcagaagggatacttagggtcatgcagagtgtgatttagagattagactttattctcagacaagtgggatgagctgagaagtgactgagttcaatcttatgagaagatcatgcttggtctggattatggctcagcaatagagcattcgtctactctgcattcatgcagacggcttgggtctgatccccagcatgggaaaggagagaaaagatcacatctcctggtgaagaacaggttggtgaagagtagcagaaacagaagatactgccatgctcctctgcagtgatcctgtttgggtgattctagtgaaggggagacgtagctgggttttagatgttgtctttttgaagatcttctggatgtgctaatgagctggattgtgtgagggagaggcaggaagacgataagtgagaaggaagtggtggtagaccaagggaagagcttatagaagaggaaataagattggttttggggacttgctaaatatgagatacctgccagatatctagtggtatgaatgagggaaggtcaggcctgcaaacacagaactgggagctcctagcattaacagtgtgtactgcagtagtttatagaaaaaggaagggatggtctagaacagagccctgaggcagttacagcatttcgatgaggagatgagtggaagacataggagaaaggccagaaaccgtgtgctgtggaatccaggaacagggagcttgttacatgtccactctgttagatgctgcaaaggtgtggatgtagtaagaatacattggacatgggtgagccaacatcctttgacattggtggccttgactaagcagtttcattgtcactttggaaccggaagctgattagagaggatcacagcgtgaatgggaagtgagcaagtgaggggcagtacttagaagaaattctcctttgacagaggagtctggaagtggaggtgtggcacgggagagaagccggaccgaggataacggtctgctgcttttgtttgtcttaattgtggagtgttgtttatatgctgctgagagcaaacggtagaagggaaattaatgctgactcaggagagattcattgcaggaaaattcttgagatggttctggtgagacaggagggagagaaactgccctttcatagaggaaggatgcagtgatgtgtctatacatagctcctctggtctttttacttttaaacacttaggttttttcttgtaataaaaaatactcatttttatagacttctcaggaaagttcaccaccttttagctcatcccccagtcttcactagtctcctttagaccccctgacctctctgagcacaagttgctttttttccctgtactccatattatgccttcttccagactgaattcatttataagctttgggtgatgtaaataaaaaatttaacatcaatttaaacttttgtgtcaacagatgaagcaaaaaatttattgccatatcttggacccaacaaaatgcgcgattgtttctgcactataaatttggaccaggaagaagtttatcgcacccaggttgttgaaaagtctttaaggttggtagaaaaattagaaattattcatttgatgtatattcatggttttatgtattttccagatttttatcaacaaattgagtttcttgatattgaagctaatattttttatttaaaggttttgtattctattatgaatttattttttagatttatagaatgtaagcatttaaagaggccttgaatgtcagtaagctgcactgacaacattgatctccttagcagtagttctgggaagtggtcatggggcatctacttcataatggttcagtcaccaagaagttcacacctcctaagtaggctgcttggtctttgaactcttctgactcagaaagtgcttatgtttaattggttagtgattattaaagtgacatccagtcacgtgcccagcgcttgctcagttctgggttctgttcactcatgtctctaagagtgaccccagtgaagtgcttgctctctcatgtggcctttcattgccttaggaagtagtttttcttagttgtcctagctctgtcccttagatttctggggaacaattttagtccatcttttatgtgacagcattaaatgtttgaaaacaactattataagcgttcaatgtgctctctaggctaaatagtgcctatttgtttgagctttcctcaaagcacatcatttttacttctccagagaacatattagctcaaagttcacacaagttgaagctagagaggtcgatggctttcttggtaaagtacttgctgcacaaataggaggtcaagtgttacatccccagtacctatgtaagaaagccaggtacagtggctcccatatagttcccagtgctggggacatggagggaggagggtcccaggaacctgctggccagccagtgtagacaaaccgtttaacaagagtcctgtctcaaagaataaggtagaaaatgattgagaaaggtgatggatgttaacctctgggctacacaaacacaccctttctccgcatctgcatagatacaagttacttactaatggattatcagggaataagctcttggattgtttttatctgtgaaagtgtaattattctttgaaagtactgcatacagcaaattctttgcctcctctgccttgtagcagtgtttgtgtttgtaattttgatatagaactgtgctaaaaccaggtgtcatgatacaggctttaaatcccagcatttgtgaggcagagctggtcaggtctctgctgaggttgaggccagactggttcacatagcaagtcccaggccagtcgggctacataaggagagtctatctttaaaaaaaaaaagaaccgaaccaaaccaaaccaaaccaccaccaaactgctgaaagaaagtcttcagagacaaagcatggaggattctgggacttgttgggacaagcatggtgaatgaaacagttgtcgaactgtattttatcccattggattctggaggatgctatggtaccttgttaccctctcccacacacttgcctgtgttttcctgtgacatttgcctgtgtctctttcctgttctttctttgtcttttctcctctgcccttccttcccttttcctttcctcttctctatgcggggtctagccttgtagcccaggttggcattgaactcttactcctacttcagcctcacatattggtggtgtaggcaggcccctctgcatagctctttgtcattgggttcttacaattttgatctcttcataagaaaactatatagaactaaaagtaacccttgtagtggctccgtcagtgggtgaaggaaccagctgtcaagcttgaaacttgaggtcagtacccagagcccacatggtggaaagagaggaccaactcccacaggttgctctctgacttcacatgagcgccctcctcaaaaaatgagaatagtacataattaaaaacaaaacaaacaactaaaggtgccttagtagcccaaaaatattgagagtaatgaatttcaaagattttgtcacaagccttatgcccatatttagaatcttaattatttttcacacttgtgcattcagagtcacagatggcctttttctttgtttatgaatgatgaaatgtcacgggaaggctgcatgatgtgtcatataatgaaggaaggtaaaagcacagctgggatttgagacctgaaaatatttaaatttcagtttgttacaattttatatcacaaggtaatcagtgattacaaaattcaatagtaattttgtaaattgagtccataaattgagtacttatagtttgtaatatctagccatatatgagaaaataacccttaacctttctgaacgtttgtatagtggaaaaatgatgaaaccagttttctttatttctttccacctttaaaaagaaaatcatttgaaagataatttcaagctagctgtgtcactgccttagatcgtaagggtatagctagctaaactagataattcttgcattctgaatgcctccaatcttactttctagaatagggcaaaaataatccttcttcaacttgattttattataacgttcttaatacttgtctaaattttgatcaaccattaaattggaagtatctacattgtaggtctttctaactttttccacctttggaattttttcttcagtttttataactctgaattataaaacaggaaatactttagaattgtaaaaagatttaagagattttgcttctaaatatctctaaatcagagcaagtgcttaataattaaggattttaaattttaagaagattcagatatttcataaaggaagatatacaagtatctccaagacacatggaaagagatccagttccatgagccaccaggaaaatacagtttaaaaccatttttgtcactattaggacataatctgtaatgatagaactttccccagttgactggctgtctgaagggtgattgcagagggtacagggaaatttctgggggataggtgataggttttatgtttaattctttctctgaaaattccatacgtaaatgttttgtttgtaactcgtacccactccgttaccctccctcatctgattcccatgcacactctctgaattccttctagcaagctctcctgctctcatgtgtttgtgggtatgtatgggacccactgagtttaattagggctgcttgcatacgggtaggtggagcatgatgcactggggcatgggcaacaaacaaatggctacaccactgaggaaaatgatttcccctttccagtagccactaacttccccagccatgataggtcagtcagtgaagtgcttgtcgtgaaagcattgagaacttcagtttggacagttagcactcatgtagagagccagacattagtggtgtaatcccagagctgaggtgtggagctaagaagatccttgggacttgctggccagtccatatagccacgtacatcagtggttcagctagaaaccctgtggtttggtttggtttggtttggttttttaaaataaggtaaagatagatgaaggaagatgcttaatatccacttctgatctctatactgatgcacacatgggagtatgcacacccacacacaggtcacacaggtgcacacacaggtgcacacaagtcaaatcactgagactgaaaaattagctcagtcttgttagacaagcatgaagacctgagtttggttcctcggcacacataaaactgtattgcagttgtttgaaatgagctgggcttatatgaacaggaaggtccctggaactaggtagccagcagtgtggccagacagggactttcagattcagggaaagaccctgtatcaaaaaattaggtgatgacactcaactaggtgattgacctctggcctttatactcaaaacagtcacacttgtacacatatgtatacatatacaaagaaatcatatcactgggctaagaatataactcagtaaaagagcactagtgttataaaagttaaaatgtatacagtatttagcttaatcagaatggggggagatgtaaaagaattttaatccagcatcatgcctgttctggcaagggatcacatccaaagccttctaggactctgtgatctggctggagtacaggctcacccttagcacacaactttaatcctaaacaacgaaggtaaagttaatttgtagaaggaagcagccgtgaggggcagacaaaatgacaagtcagagaaagatttgacagaatgagtcagtgatggcatatgctcagctctcacaacatgagaaagagaggtgacttaagagagcagcatagaggggtggggagaattttaccaaggtaggttgcagataaaagacagagaataagaaggagccagaagattagaacagattgccagagttagtttgaggccaagcagagcaattcagtcagatgctaagaggagccagtgtgaatcagtcagcttggagaggagtttggttcagaacagctgagttgaaccagccagccagagttgaaagagctgaacagatgagattattcaatagtaagcctctgaaacaacaactgtatctggcaaataaaagatacatttacatacttgcatagcatacacaagctccctggctcaaacctctggaacccacccccactgctcagctatctaaggtgctaacagtattctatattttgattgaggtagaagctacacaggtttgtaattttatcaaagaccaccagcctctatagatcagatttgatattatataattcaaaattaactccggaaagataataaaaatgcttaatggtctatttctaatataattaaatattttatatagcattattcattttagatattcagtattatacagctgttgccggttatatctttctaagataataatacgaatggctttgtcttgactctcattcatgtcagctttgggtgagcatggctaggcaggtactaactcttctgttcacaggaccttctgcaaagctgtatgtttagaattcatttggcacctaaagtctcctcagttcacctcgatttgtatagaatttgtttgaaattctcaagaattttagtttataatttcatggatgtttgttgaaagtaaaatttgaatgtgattttattattggtaccattttaatagtgataataaatatatattatttaatataatgagatttctcttttctctctagtccatatttcagtgaagaattttattttgagattccaagaactttccagtatttgtctttttatgtttatgataaaaatgttttacaaagagatcttcgtataggtaggtactattcataattatttataattacaacattagtattatgttcattctttctgtaagtctttgatatctgcttattaaagtaaaacccatcaggcatagacgttcacaccaagagactggcagaaggttgctgtctgtccgtccatctcaggctctctattgtgacatagagttgctgtccatctcaggctctctgagttacagagtcagacttcccatctagagaaaaagaaaaccaaacaaatatttttattaaaaagcaaatactaattttaagaaaaacgatttgtagttaaaaacaaacctatagggcataagcagataatttacttctgaaatgttatacccggggtctgggttgtcctttgggaagatgaagatgtcaggtgtatttcctgtgatctgaaacatatagtaggaaagactcgttcctgtgcggcttttaggccatgcttggttaaatagtcttaagttgaggcaaggtggaagttgagtcactgcttgtaactgcaccgatgtgatttttagaatgtgggcatgaattgctcaaaggaataagcatccacataaatattttaaaaccctcccttttaaggttgaggacttgtcttgttttcccttcatttctcagcttaaaattcaatttaaaagccctgaagtacatctttctagtgtcactttctacaattctaactgtcacacaaagattttttatctttgtattagatttcactcaaaatatttaaaagaaaacagattcataggtttaaagatttttgtgttttgaattttgtgtgttaatagactgattggattttcagtctcttgaggactattgctgcagttgccattctactacaaatctggttccgtactttaatgtttgttctttaaattatacatctgaaaagccaggcgtggtggcgcacgcctttaatcccagcccttgggaggcagagacaggtggatttctgaattcgaggccagcctagtctacagagtgagttccaggacagctagggctacacagagaaaccctgtctcaggtattgagttttaagttataaagagctaaacataaaactgtaatatgtttttaaaagtttaagtaacaactttattaaggtataagttatataccacaaaattttttgttttaaagtatattatatttaaaacttattttttaaagacttagagaagggatcattgtacatttacatattatacacatacacatgcacatatcagagcaaaacatacgaaaaatgataagatttttggaaatcctgggtaaagaaaatagttttatgtagtgttcttggcagctgttttttaaatttgaaattctttctcccccctcccctttttttgagacagggtctttctttacagccctggctgtcttagaatgcaccatgtagaccaggctggcctagtgctgggattatcaagataaaatatttgtaaaatttgaaatcacacagtatgacaattgtataatcaccacctgcttccagaaagaaaaaaaatacacacacatacacgcacatatgttgttctgtttgtttttctatcttccttttcacttgataatttaaagttgatacagcttcacataaaaatttatcatttctgttttcaactgttgaactaaaagtaaggttatgttgtaagacataacatacagtttgggatacttaaaaggaaagtatgtgtggagcagagactgggggaacaaccatgcagagactgccccacctggggacccatcccataaacaaccaccaaacccagacactattgcagatgccagcaagagcttgctgacaggagcctgatatagctgcctcctgagaggctctgccggtgcctggcaaatacagaggtggatgctcacagccatccattggacagagcacagggtctccaatgaaggagctagagaaaggacccaaggagctgaagggatttgaagccccataggaggaacaacaatatgaactaaccagtacccccagatctcccagggaataaaccaccaaccaaagaaaacacatggtaggactcataggtcccgctgcatatgtagcagaggatggcctagttggtcatcagtggaaggagaggcccttggtcctgtgaaggttcgttgccccagtataggggaatgccagggccaggaagcaggagtggggggttggtgagctgggggaggggggaaggatggggttttttggaggggaaaccaggaaaggggataacatttgaaatgtaaataaagaaaatatctaataaaaaaaatcaaaaaaaaaaaaaaagacataacctaccgttgggatacttaaaaggaaagtatttttaaaacaaggaaagacgtgaattactcttaaactaccctgtatctcctttgttggagcttttgtgcggtctttgaatggttagtcacatgcaaaacgatgcttcccagggcttgcattgaggaaggaagtgctttgccccagcacaccaagagcttcatctgaacattatttgcttcttctctcctttcatcctcctttgttcacggtatttcctctttccctgagacacaagcgctttagggagcagctttgatggctaaagcagtagagctagcttagtaatgtttgataaaatgatctttgaggtactttgcacatttgttagtaataggtaagatactgtttgtcctttcacttaattggagcatataacttcttattaaatgcaggtgttactgctcagaattaacagcacacacacttcatccacagtgcttcacaacctggaaaattatatagcattgccatttagattctgtttttatcctgaatattaatctgaggaagtgctaacacaccatagttacattaagtccagctgagtccttctactgccctgattcagaatgacccacaaaagggccttccagtgggcaagcagaaacaggacatttcttctttaaggtataagaaaaaacaaactttatagaaacaaattttttaattctgtaatctcagcactcagaagactaaagcaggaggattaccatgagtttaggtctatcttgggctaaatcgcaagtaccaggctagccagggctacatagcaacatccagtttcaaaaaaaggagtaacggtggatttttatatcagcacatacaaattaaaatattttctgtaaaatatataacaatgcttatgaaccataaggttatataaactatggtttctcatcactttatttattttctgtaggaaaagtagccatcaaaaaagaagacttgtgcagtcatagtggtaaagaaacttggttttcactgcagccgattgactcaaattcagaagttcaggtaagttaaataatcaggagattataacatgaaaaaccagtgaaaaccaactaattatactagtttatactgatagaacttgtaataccttattttacattctaataccaaacatagaccttaaagtaatagagagctggaaggaaatggcttttccatttggatttttttttattttatggatatataagtacagtgtaactgtcttcagacacacttgaagagagtgccaaatcccattacagatggttgtgagccaccatgtagttgctgagaattgaactcaggacctctggaagagcagtcagtgcttttaactgctgatccatctctccagccctcgagaaccaactctcatctctaacttccattcatgtgcacggcacctatatacatacatatatatacatgtatccatacaggaattaaccagaaaataataaattctcatttgaacgcatttactccatttgtaataaactagatttgtggagaaaaaaatgttccttatttaaaccatgcctgaatctgcaatgcatagccttcattcctacctcccctcctgtttacctccttttatttgaaggggtataattattcttgttaatctattctttttccccttgccacataaaaggccttgtataaattctatatgtgaacagaaatgtattgttgaagtttctaaaaagcttaagtctctatgacttaaaaattaattctaagggaatcaatctctctctctctctctctctctctctctcttatttcttttctttttttgtaaacttattaactatggtaatgattgtgtagccattcacaagggcataactccaggcaggattctttgtctcttaagcaggctataatttgctgctaagactcagaagtttaaaacaaagagacaaaaagcatacccacagatactttgcaaataaaatacgtctccatttcttcataaccttttatgcagtctctgtgattaaattctaaaaaaaaaaaaaaaaaaagtattgtgtgcaaaaatcccttcttaaatacagaatatagctaagtactttttctgttttatctactctaccccgttttaatcttctgtctgtccatttgaccatatgtatcattcagctctcaggaagagcattgttggtgccaagggagaagccatgtgaggaagtagaatgggctgatggtgttttcatatgttcagtttaatgaccttgagcttcatttctgtaaaaggagaataaaattcaccatgcttgactaatatggatcgagaatactttaaaacttgatttagggctgggttgtagctcagttggtagagtgtttggctcgcatgtacaaagtcctgagtgccatccgcagtaccacagaaactgaatgttgtccacgcacatttgtcacctcagcacctaggaagtgaaggccgccaggctgcataaaccctgtctttaaaacaaacaaacaaacaaaaacctgtttgcttctatacagatgtaaatttattaccactactcagtctggtggtgccctagttagggtttctgttgctgcagtgaaacaccatggccaaaagcaagttaaggaagaaagggtttagtcggcttacgcgtcagtttccaaaaaagtcaggacaggaactcaaacagggcaggaacctgaagacagaagccgattgcagaggccatggaggagtgctgcttactgacagcctgctttctcacagaacccaggttcacagacccagggatggcacaccctacccacaatgggctgggccttcccccatcaatcactaagaatcttacagccacagctggatcttatggaggcattttctttctttcttttttttaagatttatttattttatgtatgtgagtacactgtagctgtacagatggttgtgagccttcatgtggttgttgggaattgaattttaggatctctgctcactcagtccctgctcgctccggcccaaagatttatttattatacataagtacactgtagctgtcttcagacacaccagaagagggcatcagatctcattatagatagttgtgagccaccatgtggttgctgggatttgaactcaggaccttcggaagagcactcagtgctcttaaccactgagccatcttgccagcccccatggaggcattttctcagttgaagtttcctcttttcaaatagttctagcttgaagatagttgacttaaaactagccaacacgggtggctttctaatatagctttaccagattatccattttcagtttttgacacatgacttaatacattttccatctacgcccacatggtgtcagtcatttgagtatgctgctcatgtgtacttgaggttggcttcgatctcacagtgctctcttaatattgggattctaggcgtacaccactgcacccatctaatctgtcagtgatttgaacaagaggaaagagaagaagaggcttgtaagattttgatctgaaatggaattacttagaagattcattacagtttatttatttatttatttatttagtacgttcttaatgaccagcatacatttttctagatttaagaatttgattctgggggctggcgagatggctcaggtggtaagagcactgagtgcttttccgaaggtcctgagttcaaatcccagcaaccacatggtggctcacaaccacccgtgatgagatctgacgccctcttctggtatgtctgaagatagctacagtgtatatattaataatagtaaatctttgggctggagtgagcagggactgagtgagtagggttcaacgaggacctgaccagagcgagtagaggtcctaaaattcaattcccaacaatcacatgaaggcttacaaccatctgtacagtgacagtatactcacatacataaaataaataaatccttttaaaaaaagattttgattctgaaaatatagagctctatgtgttctttgtgtaaatcttggaggtgataccagaaactaatactagagcacaggctttatctgacagtgtatctataaagccattatgttttatatatagtattggcatttacatttttagtactgtttgcttccgtgcccattagtcattagcctttccagaacttttatcttaaatggtaattagtaagacttacccactacttaaaatagattttaaaagaaaaatgctgtaggaggtgggagggagggataatacttttcagggtaatatgctatcattgggaatattattatttagccacaaacaatctgaaaataccacactagccttgtgagtataaaagatttgaaaacagcttgaaactaatatagagcctactcaggttttgttgtttaccctgtataagttttataatatcttttaaagacatgcaaaaagaaaaatagatggcagcatagaaagcaatgagattacatttagccaggactcaatctaatgattacttttagtaattataaaatatgtaccaagtatagccgtgagtacttaatatacattatctcatttaaggcccatagtagcactatgaggtaggtatattaacctcattttgcagattatattaataggattaaaggacttagtcatagaagatgtgatcccattagagatctgcctaactcctagtcacagcactgtgctgtctttcagtgacgtgtactcttagttatagaaagaattcaacagattagaattgctcagggagcatcaaaatataagaacagaagcctacccaaattagtgggcaaaggggaatgcattagaaagtgtgtagggagctgtttgaagtcaaattacaggaacttcctcgggaatgtgagctacatagttcccagacatttgcacagatacttcgtggtaatggcagttaggttctgacagtagcacacaagatagaaattcacataagttaaaaatgatccttgaagtgactaagtcttcataacatggttgactgccacagagaacattagtttttatctggggctttgatgaacaaacgctgtgtagtgtcattcttagcagtagccccaactcggcagcaatgtactgtaaggcaggtgagacctgtgatccactggttgatttttttcatgtttgtggcttttcatttttcattttgaaaaaggaatagttatgttttcttctttcactctcttttaaataactatatacttgcaaaataaagagtgtagccgtgaattagttaaaccgctttggctcctagcaggttgcgctctcactgtacccgcccaagagctcagattcccaaataaaagacaaacacacacatgccagttaattttgatatgctttgactagctgaatggctggacacttctaaacctccccatggctagcaaacactcccctctgatatttctgagttaacatctttaaaaatctgtatttcatctctgctaccccagacccaagtggggaagtggccccagatacttatttgcctgcaggcctataagtttcatctttttgcttccccatccttgggtcccttgtccacacaagtctcgccccatctccctgtccaaccattggctgcacagcaattcttcattatcagtcaaagccagtagggggcaggaatcctcaggtatgaagaaagcatgacttttggaagccaaaataagaccaaacattagaaccaatttccaacaaaagagaaaaaagattctgggtgtgtgtgtgcaggtgcctgtgtatgtgtgagcttgtgtatttagagaaagaataaccttgggtgtcattcttaaagatacttcaactcggttttcagacagggtctctcagtgggacctagagatcactattgctaggctcgctggtcagcaagtcccagtgatctacctgtctctgcctccctaggacttccaagtacaacactacaaccatctttgttaaaaattatttctttttttttttgagattatactatagttatattatttcccctttcctctttccaagccctcccatatatccctcattgttgtttttcaaatttatgacttcttttttcattaaatgttgttagggatgtgtgtgtgtatgtcggtgtgtgtgtgggtatgggtgtgtgtgtgtgtgtgtgctcgcgtgtgcgtgcgcgtgcgtgcgcatgtgtgcatatattnnnnnnnnnnnnnnnnnnnncgtgcgcatgtgtgcatatattcttagcatgtactaccacctatttaatctgtataaggctgggctgactgtttggtgtcagatgcccaattggtgtagccttctgggtaagggcttcccccgcctgggctacctcaccccagcccacaaaggcgtgtctgttgtcatccttgttccgcttgtatttaggcagtcatttctgtgaaacttcatgggtgtaccttctgacattactgggagacataattccatagcaaactctctgatcctctggctctcacagtctctccacccctcactcccctttcacaatgatccttaggtgcaggagttgtattgttgatgaatctgttgggactgggttccacggctctgcattttgttggttgcggttttctgtaatgtttctagtcctttgtaaagagaagttcccttgatatgcaggatgaggatataagggcagatattcagaatgtattagatacccatctttatttatacacctgttttcctgggtggctggtgggagttactcatcttcaggcaggcatggcagacgctttagcaattgagctatctcctcacttaatgattcctaaagatgtcaaccattctttttatatgcctaatgagagtacatatctcttcctttgtttctttctgtgagtttactcttagtgcctcttgtaaaatgctatattcatctttaagtctctttgtccatataccttcctcatcctcaaagatctgactcaatttacagagagaagttagctaaatttttgtcactgtccactaaagtctaatgaggttggagacattgcagggcagttcattctggagtctgggttaggcccgtttgtttaggggattgagtggatgaaatgatcagcatctttatctcggagaggaagcagtttagttatctgccattaccactaattagtatttgtaactcaaatccgtaccgatttgttggtggaagatcacttatggaatgaggacctcggtgtaaaggaccacgtgtctgtggagatccaggaagtgacacgtgtaaatgtcggtcactccttgagtgaggagcttcactagtaactcccatttcataccacgcacttgattgttatcttagccttttactttatctcttgcttattggacttactgattattttcttcttagaagctcatggtagcaggatttaatgagtgcattttctacctttttggacagaattttaattaaaaaaatactttatgtgtatgtatgttttgcctgcatgtatgtctgcaccacatgtgtgcctagtgtctgtgaaagccaggtgttggacccttttaaactggggtttcagacagttatgaaatgccttgggggtgttggaaccaaggtcctctgcaaaagcaagcagtgctcttaagtgctgagccatgtcttcagctccttggcaggatttttagaatatttattgtctgtgtctgtgtctgtgcctgagtgtattaggggcagcacgtgtgtgcaaagcccacagaagtcaaaaactggcatccgatcccctggggggcaggagtcggatgtggttgagagtccacgctgggttctgggagtcaaatctgagtcttctacaagagcagtgcttgctgtctgtcaactgctgagccatttcttcagccccttttctacctttttaataaaatacaaatctttttcttgactctgttttttgccattttcccctctgacatgaacccttttcttttgaaaccattgtagtgtgccttcagactcgcttcttgggacttgatgcccctaagcaaatgggcacgtcacttttatcagggctccactggctgcctgctgctctggttttgaagcgttctcttccttaggctccagtcctggttatgatcctggctgtcagtctgttccagttggtgtacattttctttattctcttccatacaagtgatgataatacagccatcctcttagctgtgagatgctgaaactcacaccttataagcattgttccattctttatttcctaggtacctcgataaaaaacatgctttgcataagactgttgattatgggtggggtctcacacaacatgtacaggcagcaaacccacatgttatgccagatgcaatgttagttatgtcctttcgatgcaattacttagtaagtcttatccaacaggataagcttgaccatctggatcatactgtaagttatcgatcggtatatactttttcttaatggcctttgttttactgttttgtttttttccgagacagagtttctctgtgtagtcctggctgtcctggaactcactctgtagaccaggctggcctcgaactcagaaatccgcctgcctctcgagtgctggaattaaagacgtgcaccaccactgttttaaatagccagttaagaagaaatcaagacattaaacacatgttcagttaagggatcataatataaaagcataattcattattattattatagattgattttaaaactttgtgaatttgtatatgggaagtaacagaaatgagccattctatttctttttagatttttttatttttttgaaaaaaggtctcactatatagtcttgattggcctggaactcactgtgcagacaaattcagatctgcttacttctacctcctcctgaatgctggaactaatgacatgtgtgggccactgtgccccactctttatctcattattaaattattatttaaggagaaaaaaatcttgccattaatataagagatattataaagtaaagttttgtctttcatctgacaagcagttgtgtctaaaattatttagaggcaatttctataactaaagctgtcttagctgctgtagcgatgcatgatgcatgcctgtagctccagccactccagaaactgaacagcttaggcagtgtagccagacctgaactcaaaacaaccagtgaaactctgtcgggagccataacgtcgtggtggtggtggtggtggtggtggtggtggtggtgttagttggtttatttgttcctcgcctcataagttttttaaaccaattgaaacatacagagttcttttttatttgtctctaaggtctgtgtgtttgtatgagtatctacatgtgtgcatgtgcaccgtatgcctatttggtactcttggaatccagaagaagcatcgggtgtccgggagctggagttacagacatttatgattggctgtgtggtgctggggtcctctgtgggagcagccagtgttcttaaccagagagcagtctcatgctgaaacagtctcagtcatttttatgaggaaattctcaatatttaaaatgttctatgatttaaagactatttagatgtgagaggattttatctttatgcattattttttgcctgtttttacaaacctgttttctgtgcattttttgataccaggagatagcagctgcactaaggttcctttttatcttttcagctgtctcactagtgctttggtatgctgtcttcttatttatccaactgatatgtttttaggagattttgaatctgtaacgtaatgtctttcacaggtcttagaaaatttaaagcaattctctctggattctcccgtctctgactttctgtactgggattccaggctccctgtactagaaccagactgttgtgtatgtgtcttatgtctcctaagcgctcccctcctctgtacttcatcatgaacattttctattgatgagcctttcactcctgtttattctcctttagctgtggctgatctgatgttagatatatctcatttcagttactttagtacttagctctaaagttatcatttaattcatttatagtttccagttatttgctagatttttcactttattttctgttagaataaaaacaaggcaaaataaacaaacaaacaaacaaacaaatgggtggtatatattttaagtttgaggctggcctggactaaatagcgagaccctatgttaaaagaaattaagataactattttaaactcccactccacttacagtcttctgttcttgtctctctctctctcacacacacacacacacacacacacacacgtaacactaaaaattactacatagtatagaccttcaaggtcagtatcaaaacgcagaggttgtaaatgctcaatgcaggaatagtgaaggaccgagtttgtaagatatatatgattttatcagtatttatacctaaatttttttttctggactatttttttagttccatatttatacctagattttttttctggactatttttttggttccatatttatacctagattattatttctggaatatttgtttctgtttagttccaactctacatgactgctcgttttctcattgacgccttttgttgtttgcgttagagcgtatctctctcattcagacctttgcactatgactcataactgtatattgctcattgtgtagtagtcatctagcctaaagttcacagctaatggtcctgagattcagtatcataagaaaagtcggcataaagtaataaaggtgattcagattatatctttaaatgaatgtctagaagggctctgaagagaagctgtaactagagtgcaaatatccctacccctgatactatcactcagtacaccaggccctagacatcacaccccaagatctccacttggcactgggaatttgtcttgtcagctatgtggaggtaaggcagcactaattgttaaccggtttaggattgctcatcgccagtaagcagaagagatacccaagctctggattacattgtccctaagctctttcttgaggaagctaatgccttgagttccttaaaacgtactaaattgcgctttcaattcatctcttaccagctgtgtgtaagagagaactctattttattccaattcttccatcagtgctttgaccgtatagtgtcactcttacagtctctctggctaggtcatgagcttctggtcagtagtgacggtgtcttacacagctgtttgctcctgtgtattcccataggacttcctaaaacatagcagattctaaatcaatcttcagtagttgacaaggtatattttaaaaaactgattcttactatttttaacttaatttcatagctttagaaattaatttattttatgttttcaaaaaatataagtgccttctttaaggaaatactgtggtcattgcagtatataaacatttattaagcaggtataaagttcctaaatttctacctgtcatatttcatataaatattagaatgttttctctcagaactttgctatatatgcgcatgcatgcacatacattggtgattattagccatttaacaaataaatctatgcagagatatgtaatagtggttagtgaataattatgtgtgccatttggatagaagtacattgtaatattttgttagcaaaataaaatagactgagtttgatattttctttttgtcctagggaaaggttcaccttgagttaagactgaatgagctgataacagagaatggaaccgtgtgccagcagcttgttgtacagtaagtatatcctttttattcatttatttgtttttgtcaaaaccacctagaaataattctgttttatactcttagactaatttcttattttaaatattttagaaacttcaaaataaagctctcatgcatcatttctttaccaaactgagaatccagcttattttttcatttaatccacttaagctatggcaagtcattaattactcaacaaagttttaatgaatgtgggttgagcaacaaatgtatgtaagcattaaggcatgaagggtcataggaaggagcctctggcttcctagctgcggagactcagaaagtgtttccaggggattcttctccgagcactcagtcactacgcagagcttcagggagccagggatcagggtgaggaggtcatacgacgtgatgctcaaactacgtgaccacctaagattgctagcacctttccctctaggaagctctcagtagtcagtccaactctgttgtgaggtcatgttctagcctagtcttctacttcttgcctctgtaaacgcttgctaccaagcgtttctcattctggaactttctgtgtctttgcctcagttgatatctgaatgtccctgaggttatgaggttcatatctacataccttaggaaggagttagagcagttgttactttcctattgctgctccacactataattcactctcctaatgatgaaaaccccaattccttgaagcattgcctttctgtgttgtgtgtactatatgatctgaggtgttcaacttctttctgcttttattagctatctcaactaataaataataaagagactaagcgatttttgctgtgtgtggatgacttaccaaaacagtatgcttaaggcattttttcctaaaagctttataatcatggtaacatttaatagattaataaagtaataaaaatttttttatttactaacagtttttgtcttactgattttcaaattccatttgcctattgaaaatagtccaaagccaggcattgtggtatgtgcctttaatcccagcactcaggaagcagaggaggtggctctctgtgacgttgaggcaaccagggctacatagagagttctaggacagccagggctacatagaaagtcctaggacagccagccagggctacagagagggttctgggacagccagtgctacagagagagttctaggacagccagggctacacagagaccctgtcttgacaacaagaaaaagacagtagaaatgagtgtgcagacttcgcccgcagactgagagcctgtagtggaattctttggataaggccctcctgctcctcccttccctgcttgggtttagtgacagtagtcagtcatttgaagtactagtagttggattagcttatttgcatacttgtttaggtttttctcttgggtgcttggcttagtttttatttatgtatattgtgtgcttgtgtgcgtgtatgccatacatgtataagtccttacagaggccagagatgttggatctcctgaagttggagtcataggctgttgggagctacctgatttgagtacttggaacttacctggggtcctctggaagggtatccagggcccttacctgctgagcatttctccagcttcctgttgttatattttaggatgtagaatattagcatgatttcaaaggaaaaattgtatcagaaggcattattcatcggtgtggttcagttccctcttcctcacactcagccctaggcaaccacagtctgatttctgtgtctgtttttactttttggttagactggtttgatatatttagtcttttgtgtctggcttcttttacttagtattctccctttcatactcatttacatcgttgcctatagtagtagagaatcttctttccagtgtttccagtgtctcctgagctaggcacacgggttctaccacccagacaaaccccagccccttattttttcccatgacttgacagataactcaacaatgtacatgctacttaaataagcccaattccatactcttgagtttcagggctagatttcagtttttctattttaatgttttaacttgaggttatggatttacaaagtacaaacaggtctttgtgctctttacttagtttcccccagtatttacatgttacatgactaaaggaaatttttattcctacactttgttgtgtatataccacttggttacatgtatgaatgtatgcaaccaccactacaatcaaggtacagtacatactgtcttctgaaggcttttattcatactacagctgatagtcatgctcctctctgccactctcccgactcttttcaaacctcttttctgtctccaagtctataacattgtcataacatggtgtgagagctggaactgtgactcactgctggaacacggaactcagtgcttccttacacgctgtgaggtcctgcgttcagtcttgagtaaacacacacaaacataggcacacagaagtaggagaaatagaacctaattgtgtatagcctttgagattgggttttgtgcaaatccatatgaattatgtgtactctcttgtagatagaccctatcattgtaaaaagtcgttctgtgggaaggcgttgctagagagatagctccatagttgaagagcacttgctgcatgtgcagaggacctggactacttccccagctcacaaccgtctttaattctaactaggggaacctaagaacatggtctgctctctgtaggcaccaagcaggcatgtggtaaacaggcatacatgcagacaaaacattctggggctagagagatgactttgtggttaaaaatatatacttctcttatagaggttccaagttcaggtcccagtgcctgtaaccgaatggctgacaactgcctgaaatgccgtaactcccatgcattaaacacttatatactcgtggatacatgacatccttccagtatacatcaataaataatagataaaaactatttgtaaagagccatgttctgttctgtgaattttttccatttatttttaatgtaattattgatagacttaactctgtcttgtttctgtatactgtcttctattttctgaacttacctgaacataagttaaaattatgtttggtttttcttggatattttctttacatttcaactgttttcccctttccaggtctccccttcggaaaccccctatgtcatttcccctccacctgcctctatgagggtgttcccccacccacccactcccattctcccaccctggcattcccctacactggggtatcgagcaccctcaggactgagggcctcttctcccactgatgtccaacaaggccatcctctgccaccatgagccagcaccatgggtcgttccatgtgtattctttggttggtggtccaatttccgcgagctcggggagtgggggggtctggcctgttgacactgttgctccctctatgaggctgcaaaccccctcagctccttcagtcccttcttcaactcctccatcagagacccccaagctcagtccaatggttgactgcaaacttcctcctctgtatttgtcaaactctggcaaagcctctcaggaggcagccatatcaggcttccatcagcaagcacttcctgacatccacaataatgtccaggtttggtggcagtatatgggatggttcctgggtgggacagtctctggatggccttttcttcagtccctgctccacactttgtctccatatttcctgttctatttatagtgtcttattacataggtcctttaaagtggttgtcttgggtatcagactatgtgtacataacatataacctcctgttgtcaacagttcaccagttacagatatcttgcctcctcttttaccttttccttgctcccatgtttaatatatttttgtattaaacattgagaattgtgctagtgttagaattctttgcatcaggcatttaacttaatccagaaaaaaggaaagcatagtattatttacacatttttctctgtccctgttcctttctttcttcctgaattaacattccttttgtcattctgtttaaatatcctccccgccccaatttcccatacttctagggtagatctagggtgacaaatactcctcattttccttctcagaatgttttgatttttctctatacacacacacaagctacaaccagttcctctctcaccagctaagctttgggcgtgggtgtgggtggtgatagcattagttgtttttcatttggttggttggtttttggtttgtgtgggttttttttgtttgtttgttttttgttcttctgctttttgctttttggttgaggagcaagtggacattagcttatgaaggtttgttctgttgggtgccctgtttcttgctctcctttggaggccgatttctgaaagacatttgtttaaagatacaggagttggggagtagtgtgtgcacaggattattcacaaatgtgtacagcatcaaagctgaccaatagatacttacatgacagaaaatttacatattctctcatactttagtaccgactggccgtgtgtggctgttgaagacatgaaataaggcatatgtgactgatattttgttaaattttaatgtaatagccaaatatggttagtggctgcaatattagtatagctccaatagaaagcagaaagcctggaatccttgttagcaatggctgatctagggctggcttaaggaaatatatgatgaagctagaataccttatgaaattagaatgtaaggaaatactccaaaaaataatggagagataaatgaatgagagacattgaaatcaatctgaataagtttcagaaggccaattgtgggacagcttcagatttgaggacagcctcaaaattagtattaataatggactaaagcttgaagaataaatattcatgaatcactactgatacaatacacacaatcgtgtagatacataggaagaaacagttacttttccttacagtataattctaattaatgaatttaggaagggtgatggagattgaatcagcactggcaaataccacagctgggttcaagcagagagacaagcactctatgctctcagttatatatggatgcacagaaagcctttatcaaggaagccggtacagagtagttgttcccagagcctcgggaagatgtaggggaaggattgggagaaggaggattgtttaatgggtacagagctatagcgtaggaggaataatttctaataatttatagcacagaataattatgagtgacaactggatatttcagcacagctagtagaattttgaacattccccaaagaaattatgtttagatgttagatatgctaatttctctaatctgatcattactgtgtgtgtgtgtgtgtgtatgtatacatatatgtgtgtgtgtgtgtgtgtgtattggtctgtgacactgtattcataggtatgtacaattacatgtcagaaataaaagcatatatgggggctggagagatggctcaattgttaaggacattgactctgctcttccagaagacctgggtccgaatcctagcacctacatggcagttcacaactacctgtgacttcaagatctgatgttctcacatagacatacatgtaggcaaaacattaatgcacataaaacaaaaaggtaaataattgaaaaataaaagcatataattaaaatataactgagatctggaaggatggcacagtggttaagatcacttgatactctttcaaaggacctaggttctgttctagcacctaaatggaaggtggctcatagcttcatttccaaggggatctgataccctcttctgatcttcactggtatcagacatgtaggtggtgtacatacatgtatgtaaacattcatagaaataaatagctaaagtataataaataggatgagaagtatctaagagtactaagtatgttagcctaagtatgattgcatttttgtatagtctcaaagaatctccctctgaagttatttcatagataactcttcacagtagcatatcaggtagtcttggtactatgtacagaaaagaacagcgagctatctaattgaacagtccccctccaataatagacatggcccccagtggagggatggggccacccatcttcaaaatttttgacccagaattgttcctgtctaaaggaaatttagggacaaaaatggaacagaaactgaaggaaaggtcatccattgtccatcccaatttgggatccttcccatgtgcacacaccaaacactgacactattgctgatgttgtgcttgtagacaggagcctagcacagctgtcctctgagaagctctatcagcagctgactgagacagatgcagatacttacaagccaacactggactgtcggagacacctttggaagagttagggaaaggattgaagggggctaaggggatggcaaccccataaggaagaccaacagtgtcaactaactgggacccctgcaactcccagagattaagccacaaaccaaagagtgtacataggctggtccgtgccccctcccccaatccacacagaggactaccttgtctggcttcagtgggaaagcctactcctctagagacttggtggccctttatctatttttaaatatataaaactatatttaagctgggacattcaccccaaataaaacctctttgggagtagaaactagacatgtgtctgatttatttaaatggtatttattttgataaaaatgggggggcatctgattccattctggtcaagagcaaatgtcagacgaacttagattaagtaatgtgaaagcagttatcacaaggtcagagactgggaggacatggcagctgaatgcagtgtagaatcccatactgcatcctggagttcagcaaaatttgagtggcatctgtagattaattagcgttagtagcattaaatgtcagtttcttgatttcagtagcttcaccttggttacacagaatgttaacattcaatgttagggtttatagaaactctgtatgttgttcttacaactgtttcaaagtctgcaattataactaagtgtgtttgttttgagtcctggtctcctatagccactgtactgtcacatagcactgccactgtcacacacctgaacttttacacattcagtttcaggtttgttcaactcctttccagagtcttagcagatatttgagtctacctgtgtttctttaatcagaccttacattttttccatttctagacctttgttttattatggaaaaatgtttattttgaaattttttaaatttagaaatagaaaacctcataggaaggaggaaagaaacaaaaaccacaaagcatccaggcagtgttttacttcatgaacatgtcaccccctctggctcactcgtcccatggtgagaaaggaaggactcagccacccacagcaatgttattaatcgggatatggatcagtttcacgaagaagccagtgaaccccatgatagcaaatcccatcgctgtggccatggcagtcttctggaaaattcttttctatcaagtttggtacatcttttagtcagccgcattgagtcttttacaaactcctgactgggctctacagactgcattatctgatccatgtgtgtgggatgacggtttgagagggtagaggcacgtagcctaggagagaattgagccctagacctttatttcttaaggctttctgtgtctatggtgtgtgaggtaaaaattttcagtgttcttgtctacaattactttttgtcgtttctgcttctcttttggtggtttttcttctcactgtaggccatgcttattcattgtttgagttggacatagaagtcactagctgctctgtgttgctgtaatgtacttgaattggtttttaggtatcagttaacttacttggaaacaattcattctgtttataatttggttttaagctttgtcagacagatgagaacagcatattatcatagagcttgcaagaggcccacccagccacagaagagaactggtagtttaagaataatgccattagtgggaaaatatgaaccccaaagtatttctttgggctgtactttttttggttagtttcagaaatttgtgaattttatttttgatgctcagtttagcagaaatgagtcttgttttcaattttctctttacttggcaatacatcatttgcagttcacccatgagtgagtcttggagagaaatagaggatgtttctcagtaggggtttgtgaaacaaaaacaaaacacttggcatttatgagcctctgtgagggagcaggaaatgagactcagactttaaaccaactaacttagtaataattactgaggaataaaccaactaacttagtaataattactgaggaactgtgagaatcgcatcattagagcgtgttctttgcttgctataaatacaaccatagtccgtacagtagattggatggccttgggtttgtagtgcagttcattttgtacagagtgatataggagctgctgttgagactcagcatgagagtctggagaactatgtgaggcttgccctatatttatgaatcagattttaagtaaaaccacaaccatttccttgtgtgtcattcatgctttagcagaggatatggtgccacagagctggcctggtttgtagtttctcatgtaaggctacaccactttcttttccgttttagaagccacagcagttttgatgtattatcaaaccacaaaatgtaccttgagcatttcccaggaagaactgtgctatgctggtctgagtaccgattgtccttgctgggtggttctttttgggaagtactcatgtaaataagtaatttggagtagttgatacattggaactacaaaaatggaaacagtgttacggtctttgaatatatagatttctattgaaagatagtgttttaggtttggtagtgcagctcagttgcagggcacttgccctgtgtatatgactgaagccagggactgttcccagtccacaagaaggaaacgagagggagagagagagggggtagatactatgttatgatgttagtgctaacatattaagatctgttttgttctaccttagcatcaaggcctgccatgggttgcctctcataaacggacaaagctgtgatccttatgcaacagtgtccctcgtgggcccctctaggtaatgcttactgaattgttactgcattttcaagtttaaagttggatttaagaattggaaatgtacagttcttagatcaagtgctgagtaactgacataaaataatgctttaaaagaattttttgtaagttctagagcacacttggtaaacaactgagttctgttatcacagaaagatactgggtgttatttcaaatctgctatgtgcttattaggctgtggtgaaagcttcaatcttatgccattgtaaaatgtactttaaagtatattcctgggccaggtatgggggatgcatgcctttaattgaagtatttgggaagcagaggcaggtggatctctgtgaatcaaggccaccttagactgtatagcaaactacaggccatccaggatctaaaacaaaacaaaaaaccaaaaaaaaaaaacaaatcatatacacctggctgcctttactcattaacattcttactttcaaatatcctcaattttctgtaagtaaaaaaatcacattttagtgattgtcaactcaaaatagcaaaacagtttccataccagtatctgggaagccgcttaggactgagaactgccttttctgttcatgtgtcggtgctttgtgaagagagctccaaactctagaagaactactgaggtcccaggccatggtgaagtgcagcatgatgttgagtaattggtctataatttatgaaaaaccagtaacactttgtggtatctatattagataacttcattgtagtttctttacaagactgactagtctggagtttgtgtgcaacttaaagctctttgaatcaagaaacaaaagcacaaaatttgttatcaccatgactcccctttatcacctaaagctgtagtctttgttttttcggtcatcaagtcttaaaaaaagtgtgtgtgtgtgtgtatcaaagcacctgataccatggagcttaaatactgatatgctattattacagattggttttaaatttaaaagcaaaaatgtatatggcattaaatgctgccaaaagacttttcacatcaatgttaaaaatgttcatcctcactggatattggaagcataatgataacccctgtacctgggcagcagacgtagaggctcacacattctggccagcctgcactactcacaaccatgtctcacagagaaatgagaagggaaaccagccagcctagaagagctgcttgtttggagtaaacctcttttgtagttctgtcattgaaccagactattgttactaagcagttactctaccagagagagattctcaactcaggaagttgttcttggtttctgtttaatgatttctatctcatgacaaattctttagtggagcttttaaagtaacatttcacaagaactatttttttaagatttatttatgtttattttataaacattggtgttcttcctgtgtgtgtgtgtgtgtgtgtgtgtgtgtgtgtgtgtgagagagagagagagagagagaaagagagagagagagagagagagagagagtgcatgccagatctcctggatgctgggaattgaaccaagatcctttagaagagcagccagtgctcttaaccactgagccatctctccaacccgaaactttttttttaatcacagttgattttgctattatactaccgttgcacagacattcccattggttgagtctagtcaaagacacaagactcccagtacatttctttataactgcctctgaaattgtccattcactgagaattagcaggctttgtttttttttaagtttctgtcctggctgcggccctcagaagtacactgggttcagagttacctttcatgcttctcaggtgttccagcatcagtaaaggcttggaggcttgggcctttcttctcaccactccttctggtagtgtaatcggatcagcttctcctagccgtggagacagtaacccaatcttgccatgtatagatatgtaaaacttgcatcctgtgtgtggatattcatcagattcaagtttgtgaggtttatatccttggcttttttcctttgcataatatgtaagttactgtcttctctcagttgtcctaaaatgtaggcagaggttaggcatcctagctgggaatagcttgttttataattgtgtactattaagttctacaaggtataactctactacattggaacaggaatgaccaaaagaagacaaaagtaaagaagaaaacaagcaatccacagttcaatgaagtcttctattttgaggtaatttcttgttttatataaatgttaatgtttgatatgtaattctagttgatttaatttcgtaaaccatagccatcaaaattgttttattaattaatgcagctaataatctctacccagagatgagtagagccataatgtcacacatgcagctctggttggtttggaagtggggagggctagagcccctaccacatagtcacattgtcacagctcccttgagagcctccccacactttccagtctacctgacacatagtgacttctgagcagactgttggaaatcctatagaaatttaaatattaccattcagaagatctgaaaccttttcccagctgatattaatgatcaattaaatgtaaaccctgccttccatatcctgtaaaagggtaattttataaggaagaacggtagcaaatctgccaaatatgagactactttgagagtttgaaacagtttacgattatgcctttttaccattaagttctctaaatctaatttactctgtagatgtagcttgttcatgcggatctccagctgccttgagtgaatcctaaccactggaccaccaagcttgcatcttcagctgctttgaaattgccccaaataaagtgctttggcattctttaaagtatttagtcttttttcatattaattgaagactatagaaaaactaaaaatcaaaatatctaaaaggttgtaataacagaacaagttgcaattgatattaagatgtgagaacaggttgtaaaagtgggtaattacatcttgaagtttttattttgtttttttcctctgttttggagagggcaccaaagtaccccaactcatgcctgattgttgttctttaataacaaggagcatgagctgaagaaaatgccaaaggtgacataggaaactgggggtggggtgggggacaagaaaaacctactgagtcaagaggcttcctttcctggctgaggacttggtgctgctttctacatttattaacagctcttatgtctaaccatgagaatgagaagaagatgacagttctaacagctcctgcccaaagtcactcactgcatatagttcacacctcaggtggcctggaattcgctccttaggaagaacctgtagccagagggtaactttctgaaagttgaggtcagaaatgcttgccttaccaatttacctctcaggccttaaactgtttattcatctagtcctttgttagattggttgtacagacaggcatgctcagtacaaccagagcaagacataagaaagcacacacaggtgcatatacacagctataatgtggagcaagacataagaaagcacacacaggtgcatatacacagctataatgtggagcaagacataagaaagcacacacaggtgcatatacacagctataatgtggagcaagacataagaaagcacacacaggtgcatatacacagctataatgtggagcaccctctctcgagctcagggttaaaacagtccaaagctagatttttgcgagaacagaaataatattacagagacagaacactttgggcacagagacagaaaaactgaaagttatacccagagaacatcaagtaaagatttaactaagtttagtaaagtaaccaaaaaagatgggataaactggtaagtgtccggcggtgctttagctttagccattaaactagaaagaaataaccaggatctgttagcagagcccagagaccttcaaagagctgagagcggggcagaagtcgagataactgatcgtgggagaaaagggagaaagaaatcaaaagcatccatggatctgtgtaaaattcctccaccaggcgtcagatgtggtacatgcctgtcatcccagtccttgagaggtgtaggcaggaagagcagtttcaaggccagtctcagaccaccttatctcagaaagcaaatcagatttgctaacaggacagttcatgactgaagcatggtaggtgataactatggatcacaatacaggatttggtacagagccaggagagccaacagtgaagagatgcagcagaggagaaacccagtcagctctggtgcttactaaccactccgcttcagacgtgctgatgaagtttgtactgtcgcttcctcatttttaaagtgaggggaataaatctagctctgcctgcctcaaagcaacagtctaatgagtccagagatgtgatagcactgagtaagccagacaacatggtgtggcgttaagttacatttagaacaaaataaaacaaccttggagaaccacctgtgcaattccaaggaggagtagagagcaagaggtagcaggctagcccacaggtaaaccgaatgcaaagaacttgtctgggactagggcgggggagggggagggaggaaaggagagaagaaagaagagagagagaggccaaggacactgacaatcttagactagaaagaagtgatcagacagctggacttagagtagaccaaacgcttataacacatgcttgttagttaatactgtggtgaaaggagcaggcttggggaggtaatcttagaaccatcacctcttcagaagtcctgagggtgggggaagtggatgctcagcttggtggcagttgaggaagttcctgcccagtggccttgatattttcagtaaaaactgtgagaaggaaatatgagtaggtgtgacccgtgcagacagagcgttgtaaccagggaaccagatgtggctctaagtagaactgacggtgtggaggcgaggaggcctctgatttttatgccggactttcttaccttctggtgcatatttggtacatttcccatgctttggaaattgcattcacacttgactctttatatttgtaattgaatattttgggaatggtcatttttgagctcatgaaggaaagatactttaaacagtctctactgaaatccttcgtttgtaggtaaccagatccagcagttacagcaggaagtcccagttccaggtggaggaggaggacattgagaagctggagatcaggtcagtgccgtcctgtggcgctggagaacggcttttctccatgcaaacctccatagagcccttcatagcaagctgatcgatgaacttagatgaacaggcatctaacttaatccacttagcctttcaaaatcggattcttctcagaaatatcaagtagttctcttgtgtgagcaaagacagcctaatttcacctagtctgttttcattttccctgatttaattgctccttcactacctggattatagtataatgaatggaagactgattatatttaatccaatttagaaataattgttttattcttcttaacatatctgctgactatcagacatttcagtgaggtaaggcgatacccgcacaggtgcatgtgtttggagtttgtggtatttcctaggccttcaatatctatgctgttttggaaaggaaacttttgcaaatgcatgtgtaggtgtggtgttaacagtgtgttttctaaaaggcatattaatcatgtgttcacattgttaggcaatatttttctaaatcaccgatctttatgtattaattaataacatattgatttatcatcaaagaaaaagtgtggtcttgttttgtttcctcaattcagtaaagtaacccttttgtcctaatgctacaaactaaaaacaaacaaacaaaaaaaaacaaccctagactttcaaacttagtttctccttttatactgtttagaatttggccaggaagctggcctaggtgggaaaggcacttgctgccaaacaagtcttcctgagttgtattccttggaccctcacaacggaaggaaagtgccaactcctgttaattgtctctgacctccactgtgcacagtggcatgcatccctcccccaaaactagttaataaggatgtaaattacaatttaaatcgtgatttttttttcataaaaattgctgtagtaatttgctttcaatgtctagataatgcattatatgacaatgctaatctaacatctcttttaaaagcatgtaaaaatatagtacaaatcaaaatcacttgaaactactcagtgtggtttgccaaaactaatgctaggttttcaattttcaggattgacttgtggaataatgaaaacctagtccaagatgttttcctgggagagattaaggttcctgtcaatgtgttaagaagtgattcctttcatcaagcctggtaagaagacagatactctaatgaaccaaatttaattctctttaataaagaatataaatatatgcttgctggaaataagtaaaaagttactgatattaatttggttatgaatttgttattagaggaaagataagtactttaatagttgtatcacttgatctgtgatactgagataaagaatttagttgtctaggaatatttttctgtttaagaataaaatcttggggctgtagaaatagctgaactctcttctcagtttggacggggtttcagatcctagcacctacctcagatctctcaaacaaagggctttaactttaggtctaaggaatccactggtctctttggtcttgatgggcacctgtacatggacacacacaaacacacacacactaaaaataaagtcttaaatctaagaaatgagaaacattaagacatcgaatgaaccgctcgttgatgcttgatcacatgtcatcatctgcagtttggatgcttttcggtcaaagaattgtgggtagaaagcagagggcttattgagaagacacagcagtcttctgtgtgaggcagtgtatgattttcagttatcacacatttacaaatgcagataacctcgatgtgttttctgagtgtggggtattgactataatgtcatttggccttttcatggctctaatagtgatactgaattaataacattaatgttaataaccttaatgttttgacattaaattcatacttatttcaatgtgaaactttttctctatagcccttaaaaactagtgttttctgtctcttcgtgtgtctgagcccatgtttcttcctagattgattggtatgtaggatcatgctttctcagttgttggtgcttgttgatgctgctatgtgagcatgtaggtatgcttacactcatgcgcacatagagaacagacttgacactggatatgttcaccagtcactctcagtttctgaagagaggacttcagaaccaggagctcactgattagctaggctgggtgggcagtgagctccagggactgcctgtcttttcctgccccgtgcaaggattgcagatgtgcacaccactaaacccagcttttacatgggtgctgggaacctaaactcggattctcatgctctgcagagcaagcactttatcagctgagccatttctctgacctctgtctcttccctttaaaggtcactttttaaaatgaaatgtaatatttgtgcctgcttattaagtgtaatagtcacttgtatatactgtgtaatgatcaaatcaggatagtcagcatttccatctctcaaataccatttccatgttggatgctggagaattagactgtgctgaaccgtgacatcagttgttacggaccatagtgaacctgttggattataaacagagctgctactcccacgctgcattgagagcccgttctaataataatacctttctctgatgatctcccctcctgcctctagcaacttacagtctttgtttttatgtggatcaactttagttttcacaaaggaataagaacttgtggcctttgtctttctgtgccttacttcacatgataaaatgacctccagttccagatgggttaccataagtgataggatttcactctttaatagcaaaccgtctgttgatgagtaaatgaatttaaataacgtggtctgtacacactgggatgttaacataagaaccgctctttagaactcagctgcctagaagaggagttggtgttgactgtttaggggttgggtttttgtttttgtttttgtttttattgttttagtttctgagacagaatctcactatttaaccttgactggcctagatcttactatgaggaccagactgtccttgaactcagagatccacctgtctttgccttctaagtgctgagatctaagctgtgcacactccagctgacctaggacttagacgtttctctttggtctcacttgcctttaaaggagcctgccaccagacagtcctcattgggattctgctattccatagccttccttagagagactgtattttagactaattttcaaattttattttttaactcttccaatgcaaatctaaatgtattagtctctctaaaaacattttgtgtgttttaatttctaaatgcatccagagaaggagaaaaatgactttaattgttgagaaaaatgtattaccgtttgcctcccctgcccccatgtcatatttcctcccttctccatgaaaattcctgaactcagtttttaagtcttgaaaataacattccatacctttagtacagaagaaaaaatgagttgttgtgtctcccaggggcctccacaatgagcctcagacctgcccccacagtgtgacacagtctttccatatactttcaaatttgacagaactttctaccttggccaacttggaatattaacagacaataagtaactttatttcaatttcttctatcaatagtataaatacttcatgtgctcttgagtgctggtgtctttgaggtcagagtcgttgaatcctctggagctggagtcacaggtgatttgtggctgcctgattttggttgctaagaattgaactcgttctttgtttatgatctcaaccattgagctagttctctaggctccaataaaaatattttaatttaaagtagtctgtcagaagcataaatgctaaaatttatgtagcataaaagagaagaatctgctaatgtatatgaattaatgtacattgtatggaagtataaaaatgttaatgccattttaattgaagatcttgatctcctttatcacttatagagctgtagcatcctctagtggtattaaagataactgcacaaaacctcattccattcaggcatagttatttctaacgttgatattgcaaagggtcataataacttattagtaggcagtactcttgctttaagtttttctattttcttttttccagtaatttccattagtatttgcctattatattgtatgtctaaaaactggtttttgatggtttagtttttttaagatttctattttatgtatatgagtgttttgctctatgtatgtctgtgtactgcatgtatgcctggtgcttgtgggggtcatcagatggtgtcagatgccctgccacaggaattagagatagttgtgagccaacatgtgggtcctctacagaagcggcaagtggtctccactgctgcatcatctctccagctctacttcctatttaattttatttgcagattataatacaatgactcatgccactttcccttgctttctaagacgtcttttgttgcccttatgtacatattacttttatgtgtgtcccttgcgcgcgcagcctgtgaatgcctgcaggaattgttctctgtttccaccacttgccttctgggtattgaagtaaaggcatctctgtttaccttgagtcggttcttggtggtgggggaacctgggagaatgaaacggactacagtctcgtgctagccagccgcactcagagcatcacacatttcatactcggagtgatttacctccttaaccttgattgttttttaattggtgataattagattggacgttagcattgtcttttttgtgttgatattagctaattttcattttgccatgtgtagataatagaacataatttgattgtttttttaaataagttttttttaatagaaattacaccattcctaggtaaaaagatgtaaaagagaatcctgcctccttccccagtgccacttgcctaggtcctatttctgagccagcctctgttctctagattctgggaatattttctatattcataggcaaatgcatgtatatattttcattcgttgttttgttgtattgaacctgggtttctgtgtggcctgggagtcataatctcccaagtgcacacacgaccacatgcccacctgtactatgcctgtatgtttactcaacagtgtagtagaacactatagataggcgttgactcttgatggtggtttacaacttatactctagaatcagacagccttaattcaggtcccatcctcgccagtaaccacttgctctgtgcttcttatttcgtgggcacagtgagggctgaatgtgctgagaacacagtccgcccatgagctgcagtctggccctggcccgtggtttcttcttcagtagctcagctgtctacttatcccgcttgctcgttaactcactaccatcacgtgtagtaccatcagctgtacttttactttaggtacttgctacagccaagagacaatggaaacaaatcatctaaaaccgatgacctgggatctcttctgttaactctctgctatacagaagactgcgtgcttccatcagagtactatggaccgctgaaaactttgctgctaaagtcaccagatgttcaggtactttaaaaatctttttttttccccaagtgttttgtgatttgttctggatttgtatataggtacaaagcttcaagggataaacccagaaaaacggtcagcttcatccgtccacatgtcggaggagcccttgtggtcagctctgggaactactttaaaaatcttatatgatccccaagtggggcagtctctggatggtcgttccttcagtctctgctctgaacttggtcagactgccccacttggggatccatgccataaacaaacccaggcactatggcagatgccaaaaagagcttgctgacaggagcctgatatagctctctcctgagaggctctgccagtgcctggcaaatacagaagtggatactcacagtcatccattggatggagcacaggatccacaatgaaggagctagagaaagtacccaaggagctaaaggggttttcagccccataggaagagcaacaatatgaactaaccagtacccccagagctccctgggactaagccaccaatcaaagaaaacacatggtgggactcatgtctctagctgcatatgtagcagaggatggcctagtcagtcatcaatgggaggagaggccctaggtcctgtgaagattatatgccccagtataggggaatgccagagccagaaatgggagtgggtgggttggtgagcagggggaggggggagggaatagggaatttttggaaaggaaactagcaaatttcatttgaaattaaaatatctaataaaaaaaaagaaattaaaaaaatcttacatgaaaaggctaaactaattctgcaaatgataaaagatttcatagtgtcagctcttacagagtgctgtgtatttgatttctctgaacctgaatactgatgtgcttcaaatcttatctctgattataatttagaaaactaaatactatcttacctctgatcagttataattaatgagtgtgtttaaatttcatccacaggttagtgattacgcatgcaaccatggttccttgattctgtccttgtttttaccttctttatcctagccagtatccgcctcagctgcttatattttgggtgaaatatgtcaagatcaaaaggatgctgttttgccccttgtacgactgttgctgcatcacaataaacttgtcccttttatcactgcggtggccgagctggacttgaaggatactccgtaagaactgtatttcattaaatgtttaaacttcaatttgccagattgtttttatagtctcagttcttttgtattgaccaagtttactatacactaggttaaaaagaatcgcttagtcagtaacaaaagacagttcttagagttaccaaacagaatccggctgaccgtaagaaccagttatgcagacatgtgtataagtcagtggtgccatttcctttgttactattactgatctttgctcctggatgcagtgattcacatgtcacagcaacagctctctatcacggttgttacactgtaggcacacgtagagcgttgtgaagagcggtcagtgcctttccatttccatcgcagtgagacaacaccatcatcttatgcacacagacccacactacaccatcatcttatgcacacagacccacactacaccatcatcttatgcacacagacccacactacaccatcatcttatgcacacagacccacactacaccatcatcttatgcacacagacccacactacaccatcatcttatgcacacagaccacactacaccatcatcttatgcacacagacccacactacaccatcatcttatgcacacagacccacactacaccatcatcttatgcacacagacccacactacaccatcatcttatgcacacagacccacactacattttttttacattcataaacatagttttgataggtttagaaattctaatggcagcaaacattgctgttaatagtagtaaaggttactaaaattgtgtatatgttcaaagtcaaattattactgtttgaaacttttcttctttttgctgtcaatggtttttgtctctttctatttcagagatgccaacgcaatatttagaggaaactccctggctacccagtgtctgactgagatgatgaagatagtgggagggcactacctgaaagtcacgctgaagcccgttctagatgaggtacagagtagacctcacaggcagagcctgtgaccagctagagcagccttctcaacttgtatgtcctgaaaagccctttcacagatcatctgaggcgtctgcgtgtcagatgtttacgtcatgattcgtaaccacagctaaatacagttatgaagtaacagaaagagtaaccttacgcaggggtcaccccaacatgcggagctgtaggagagggccccagcagtaggaaggctgagagccactgcagtagagcttctcttttaagaagtaatgtgttgattaaaagggtctgtccattcatgggctactggaggaataggtgtagacactttgtaagtaaatttctttgccctctgtggattcattcttactcacaagacacactgatctacattattgtttgttagatttttttttaactaggattttgatatagttctttgggaaattgtttatgctgctttaagttatcttcaggtggaagctttaaattttgttagatttattttttataatatcagaagaagaagaattatattcatgttgttaaatcacctaggaaagaagagtaactgagaaatacttgtatattccagatatgtgaatcctcgaaatcctgtgaaatagatcctgttaagttgaaagagggagataatgtagagaataataaggtatgattatacagtgtcatttatatctacattaatttttatcttcatgtgatacctgtctcccataaatggtttattttattttctatgtatgagtgttttgtctgcatgtatgtcagtgtgccatatgtgtgcctggtacctgtggaagtcagaagagggcattgaatcatctgggaatagagttgaggtggttataaaccattatgtgggtgctaaaatcaaacccaggtcctctgcaagcacataagtgctgttaaccacttagccacctctctaccctccaacatatactcttaaactgtgcttcttgtgaaaattactcatatattcattcatttgtctagaaagtctgaatttaacttaataaattaaccttaatgttgatcggcctttaacctgagttgggactagaagcaggagactcgagagtcatcttctaataagtctcatacccattatttgttctcatgaagatattgaagctgtgtgacaatcagaatcttagtgtttactttgttaaaacctgcaggagaatctgtactactatgtggacaaagtattcaatacaatcgtaggatcaagtgtgagctgccccactgtgatgtgtgatattttttattctctgaggcaaatggctgctaagaaatttcctagtaagtgccttggtatacttaatcacattttctttttctatttttttctccatgctgctcatttggtttgtgtgaaatacttgtgcataggtacaatcttctgagtttttcaaaatggtgctagcttctttgtgagatttaatgatttattttttctagaatctcaaaacatgcaattcactttatttcaatataatggcaactatataaagagctaatcaaaatcattagttttaagaagggacagtttgcatctgtacagttttctataatatgtaaggaaatctttatgtgtcgtatagttaacagattgtagaataaacccgtgtgtaccagctattttttccagttgcagattttcaaacagtagtaattggtagttttatacaattgactagatttgacagcttgaagatactaagatgtctgtggtgagatgtcttttcagaaatagtctttggctttacaaatacttgtcccacaatccataggatgatcttgcttcaggttttgcaaaaatatctatattaagattttgcttggaaaggctttataaagttatgagatctacttcttattgttagcacttggaaatactcaaaattttagttcatttctgttacataaatgaatttgccaaaactcattgcagatctgcccataacacagacaaggcaactatttacaataataatcaggtttatctatctgcataagactgtaaattaactttcttagccatccaacgagattttgttatttcattatgcttccattcgtcagaccctttatttaattcactcatactaactgctacatgaattcgggttttggtctcttggctaattacaataaagagataaaacatttagctttaaataaatatatctagtcttcataatcaataaaggaggcagagacttgattttgcatacataaagatgaaatagcaattagattctgttttcaaatagtgagctagatcataaccactttgcctgcttgctagtctgtcttatcctttactcttaacatgtttgaaaccattacccattgattagccaatgaaactgaggtctcagttgttgttactacctggagctctgctaccctgctagcagggcaggcagtcataatgatggacagcttgacagttccctactgggtgatttgtaagactaaaccccacgtcaaatccggagattctttccctcactgccctttctctggcgtctgattgttgggttagttgttgactccagtctgaaacaagtcctgacaatgagtgatcattgctacaagtagctttcaattcacctgcagtttatgtgaaatattggtagctttaaaagtactgtctctacctaattgcttttagtctttaaattgttggcttttctttttgtgacaagtacatgagagaaacaacataaaaggtaattgtgggttcatagtttcagaagcctcagtccaacacccacaggctccgttactttagtcaggcctgagacaaggcaaagcactgttacggcatcttgtagcagagaccgcttgtctcctggcagtgaggaggcagagagagggagggatgagccagggccagaatacacccttcaaagacatatccaaagtcctctgcttccgctaataagcctccagcttccacagccccaccacctcgtacaacagtctattgcagttggaatccgtcagtgtggtgaacgttgattagatcgtgatctagtcatctctggaaacattcttacagaaatactccagatggtggtctactggtcttgtaggcatttttcatctaatgaactgaataatcaagactaaccataatatagccttagacaccatgaagatttttagggtgaatttaaaacaaaaatataaaactgaaagctagtttttggtattcagtgttgtcactaggtagtactacgtagggctttaatgttacttttttttaaaataatttcaagaatcttttatatcaagaagctatttttcaaattaaaagtatttctttaaaaacagcaactttgctttccgtttgttattttaagttacagcatttttttctcttagtttagccacagtcagcatcatttcacagctcagtttttacaagttattttcctttcctacatagtttacatgatttttttttttgctttctcctctttggtttataagtagtgtgtttgcatgacgtttcccattttatccctgcagatcaccctcatgttcagtactctgcagtgagcagctttgtcttccttcgtttctttgctgtagcgatactctcacctcatgcttttcatttgcgacctcattatccagtaagtgtttgctcctctcaaagccttgttccatttttatttattttttgtaaaatgaagaagaaatatgccatttttctttttcggtgataagacatttcacagttggcagaatgctgctaagttgatgtctgctgatgagcagaggggagcactcctcagggcctttctccggctgctgcacacgggctgcggtccttagttacagggagctggggatgctggggtggtaggtggagttggggctggttgttagccgaccctctcctggtttattacagcagcttattttttatttctatattctgaggcagactcttgttccatagcccagatggaccctgactcacagtcttcctgcctcagcctctagagtccaggagtacaggcattcccaccgctcctggtttacggtggtttaatcatggcagtattttaagatctcagaaatgtgaaggaaaatgaagaagtttatttgaaaagtattcaggaacctgacttacttggtatctttgtgcttttgctttctgttcacctaagttatatcaaaagatgagactaaaatgaagttctgttcagttacctaaatctacatctgcgttgaatatatacctcttcatattttaaggtttcctttttcttttaacctatttctagtccttcatatagcatatttttagtcactctttggtctttctctgttgtaaatattttatatatactcttgatgctttagctgctgctgtgtacagtagaataggaaacatttagtgatgaccttgttctaagctttccttgaatcactttctatgtctaactcgcttaggtcttcctagtcactgtaggagtaaattactttattagccccatatacaggtaaggaaatcaccatgcaataacttctctaggctcatataactaagacatcacatttggatcctacacaatttgtactagattcaaatgggactagttcagtctccacagtctataagcagactggtattgaaaatctttttttttttttttttaatgtatgtgagtacactgttgctgtcttcagacacaccagaagagggcatcagataccattacagatggttgtgagccatcatgtagttgctgggaattgaactcaggacctctggaagagtagtcagtgctcttaaccgctgagccatctctccagccctggtgttgaaaatcttacagcaaccactgtcacagtgctcagtgctggagacatatgcagccttaattgacattccctacttcaatgtacccatggtccatctagtagtgcagtgtagggaaaacttaggggcaaaactggcttctgaatgttcacttcccctccgaatagcctcacagtgttagctgagagccatgctgcagtggcagaagatggatgttctgtgtagcctgtatccttttgttcatggagaacccttctgtggctgtgttaactaaagctggaatgacctggggcagtgagagcttgccagccacattctatacagaagtagaactcccacctctccacttgtggctctgcttgtattcagacttggaattcctagatggaatttgaagaaaatccctctaacacaaacacttttaggtcacttttcacgcaactttattatttaaagttttctttttgttgttatttgcccccatccccaatacctcagcatctccatccagtctttagccataattcttcattttaaagaaaatttgaagtagtgggaatagagacaatatgacatttgacattggtgctgtagggatgagcatagctgccttctattaaggtagaactattgcatcagtttaaagccagcacatgattagccaagtaaaaagtaatagtaagcactgctgtacaggccgagaatacagagcaatcccagactctgatggcttcatcaggaactggaagttacaaagtaatacaggtgcagaattgatcaaatgctactgaattttatgtttagaaatccttttaattctaagaaactaattatagaagatgttttagagtagacaagaaagaataaagaacaggtagctaaataatcatagcaagggcaggagatctgagcggtgcttgctgacagtcaagggatgtgtgcacacacatgtataaaaactgttttgaaaacattagtttagtaaaaatgaaggcatgggctggagagttggctccgcggttaagagcattaactgtacttccagaggtcctgagttcaattcccagcaaccacatggtggctcacaaccatctgtaatgagatcagatgccctctactggtgtgtctgagaacagcaacagtgctcacatacacaaaataaataaatcttaagaaagaaagaaaagaagaagaaagggtgagctggattgatggctcagcagttaagaaggcatactgctctttctaagcccctaacttcagttcccagcaccacgtcaggcagctcacggccctcagtaacacctattctagagggtctgacccctcttctgagctctggggacgtgcaccctgtgtgcacatacctacacacagatacacatatgcagataaaaaataaggttttaaaataatgtaaataatgagatggactaagggctgggactagagctcaatgttcagtcatttgccaagcatttgtgaggccctacattcaattcctagggctgtaagaaaggaaaaaaaacggaaaccttcacttgaacctccttggtgattgttgtgtgttttttttttaaatacagattatgtaaacattgattttgtaaaccaatgttgaaatttcaaaaggaaaatcattagatgattcttattaaatccctcattcttccttgattatccctttgaaggccctcctgctgaagacctcttttacccattggtttactttctgtctgttgtatatacctgtaataccctgtgcactctctctccctctcatggcattttctattctggctagtaacatctgtgtataacagatctctgcatacagactgccaggatctccagaacaagggaggaccttttcctaatatgtgtatccaaagcatgtggtagtgtctaagacagtcacatgatcagtttaattaataaaaatgatagttgagagaaggaactcatcaagtgagtcttttcttaatggagaaacagattcatggtttaaatacaggggaagaggcaggcactcgaaaagagggcttgctgcctccaggtcagaatcctagaggattctaagcaaaggtgtaagattagaaccgagcagctgctcttttgaaagataacagcaaacttgggacattagtttttttgtagaccaaagacagtcaaatggcaccaatgaaaaacaagagaatgtgtgctgagttactttgaattaaaaagtttaacattttggttgactttaataattgttacatagtgtttgctgagttgtgtactggaagccaggtgaggaaggtcctgggtatacagtgatgggaaatttttattacagtttgcatgtatacagtaacgagtcaaagcagccgagtgacgtggtactacagtagccacggttatgtgggtcaaagcagccgagtgacatggtactacagtagccacagttatatgggtctaagccagccttggtgacctgacactgaataaaatgagctctgttccctcttgctagttcaaaaaaagaataacctaaaacactgaatttaaaaaccacgtttaagcccggcagtggtgacacacacctttaatttcggcactgaggaggcacaggtaggcagatctgtgttcagggccagaatggtctacagaaagagttccaggacagccagggctacactgagaaaccttgtttcaaaaaatcaagaaaacaaacaaatcaacaagtttaaatggagaagtcttgtgaaattcaattcaaacttaatgttcccggaacttctaaagaatgttaactctcttcccaggtagagctgtagtggggttctcttacaggtagaacagagtcccaggtgctccatctgaagtcatttttagataaccataatttataacttttaccagatatatcataatggtcatataccagatattccttctccggatttcctcatttcttggtcatttcttccccactacattcattgcctgcttttaatatgagatattgaaagataaaacagtattaactataataattgtattttccttgatatgtcttttgataatattgtttactgtggtaagatagttggttatgtagacatgtaggtcagtaagactcatgagcgaactgtgttctgtccatttattatatgtactttaatgtaaattacactactatcaggtagacagacctgaaagataacgtggctaacagacccaaacagttaccttccagtacgttcttatgtgagtgggtgactccatttcctggtctgaatttgtattctccctctgctcccatgatgggaacagttgattgcagaagtcttacgtgttctttgaatatgcttagaagtagactgggcacagaaagttggaaacacctctaagttagaaaaaaaaaataggtatctctgatattccaaaaataaatagatttggagtgtgatccagtctttcgactacacaaagcccttagatacagttgattacattatgtttttctttttttctaagtccttagtattgtctttaaagattgatttatttatgttatgtgtatgagtaccacattatgtttttcaaagggaacaagtcattaagtgtttaatctctgacttttttttaatggtactgagaatggaattgaaaggtcacgcatgctaggcaagcattccaccactgagctgttctaccggccctctttactctttatactgaggcaaagcagtctcattcggttgcctggactggattttctctgtagctttaacagacctgagtttgcagtccttctgtctgagcctcccaaggaattgagatcgtagacctacaccaccaacttctttcattgtctcccaacccaagttctataagttgtcttaggcttggctgcatcttaactatctttgtttgaatgaacatttttagccattattttagagccatatagcccattcactctattctgctttttatataaactcaacttcttgaaaacttaagaattttgatcattcttaccttttctaggatacacagacagttaggacattgactctcatctcaaaaaccattcagattattggaaactggggatgtcagtccagaaaaaaggtgagtttataactgtttcctctttgcatacttaacaaattttattatatactaagattccttcttcacttacttccttacatgttaaaaataaaactgaagagaatacatattcacatgcaataatggtcttttagtgggtgttctactgtagtcaccttttgaaggagacggtgatacttaacctgatatacccgtggtagggaaaaaactaggaagaagacacaggcacagctgagttatgtggtggtctgtgccatagtcacctaacagcactggaagaagccttcagctccaggatggatgattcatggagacatggacagctttatccttagcttcaaaatacaggcccgtcattgtcttgtgttctacctcagagcttcataaacttgtcactcatgaagccgtttacttaagaaacttatgcaaccttacgtataaaaatcaaacatttactgataataacttactttagcattttgaagtcctcagctcccagtgctgaggagttttttcttccatttgcttttgcaactgctttcttggggcttttccctagtttaagacctagaaggaaaaggtcaaacagtgactgccagttcaaagctatatgcaggctctgagggatattcactgctcctcggttcctctctcaccaagaatgttcatcaaagaagggagaagagccaggctcagatcaataaagtaactgcaggtcactgactctacaaaaaaaaaaaaaaggctttgctggcaccctgcatctggcccagcatgaggtatctttggctatcagcagctggaatcaacagaatgtgaatggagcctgatcatgttcagggagaggctgagcatgatatcccatgtgctgtgtggggaaggctaaagaccatgagtgtgtggtagccatgatcctggaacattctgggttcgctgacttggaggaatgctctctaggagagctctgaacaagatggtgaatgtggctgtgagttcccagcccgcctgctgtcccacatggagaagagttgaagaagctctctatagttgcttctgagccacgatctggcctactacacagatgaggcagcactcttggccctctggctgcagacctggctccttaaggcacccaagtgaattgccatgagtaattatgactgattagccaagaggagagacaccaccttacttgctacctgacatgaatgaaatctgcggatcccagaggattggggaaccagaagagattgtgccgcgctttcccggagttggctcttatcagtggggagaaccgcatagtggccagctacttccctactctgaagaaagtagacttgagctcatctggggaaacaaagcagttggtatggaagctggaagccttaagaggaagtactttgccttgccctggaaacctgcctaggacacggctggtatgaagagccaacaaacacacaaagaaaagctaggattgggtgacctacacttgctctgatctactaactaacctgtattaggtacctttattatgtataacaagaggagttagctgatcttaatgggaagtctctgtaggacacagtctcaggcagtacttcctgaaggaggaagttgtatttgctagtttctggtcccagtaaatggaaggttttgccatttacaggggtctgaggcaactacagtccttgacagggctatgttcttgccatcagtccacattcaccctgtgcttcatctgatccccacactagagtgttgtaagttccaggttctatagggaaaatttatgaagttgttcacaatttttcatttgtgataaatacatttgaacactcctaagctgggcccattcctgtgtggctggtgggagcagcccctgtgagctggaggcctcacccttatcactgtctctcacgtctcaggatctttctttccctccctgccttcttcctttcccttgagactagaaatcaaagggctgggctgtatgtacctcagtgggagagcccttatcttttataaatcagaccataggttcagtccccactactaccatttttaaaacaaaaaagaaaccagacattgggctgcatagcttccatccagatctgcatccctccctgtgtttactctgagcctctggagagccatgagcttccaggaggcccttgttttggattcacagttgcacttgtcaggagacccccaggtagatttttatttcttacttggtcctttagaccttggagtaatgatggctctataccttattgtatgctagttaaacctatccatgcatttgtaagtacttttcaaattctctgttacatttttcattttgtcatataataataatacaaatttatatatgcaatgttttaatacatatttacattgtatattggtcagatattttaaaccactctttgtatatataattttaccacttattaaagacaaaatacaaatttgcatactaacgagaaggatatacttgtttatgtttacataaataaatactagttgaatatttagagttgagtatatagagcatcttcagtgtttttcagagttgattgtattttgattttgtaatcattcagtttacataaacatatagtacaaaatggcagaagtatatttaaggccattttttaaattgttggaaattttgtcctaatctcaagctagaatttacttagtgtttctttggtttttggttggttggtttgggatttatttgtttgtttagtgaaacttaagtcagcaacataagcaattaaagtcaaacattctaataaaatccaaaactactaattgatacatgctgactaatgatgtgggagaatattataggtttttgtttctgtaattaagccattatgtttttgttagagcaaaagccttcatgtctagtaaaaatagctcagttcctagtatacggtggcccagtgctttgcgctgaggccttcagggcagcagtgactggggatgtgtgatgtattggcatgcagagtgcaaagcatgcgtgcggtaccatgcagcagaaacacctcagagttggacatgtttgattttgaactagttcttgttgtttgtgtctttagaaacctttattgttgataagtttctcatgaccacatgtgagacacgactaataatttaagaactgtgcgtatttaacatacacaaatcctgtatttgttttctcatagtcacggttcaaaaagtcagtcatgtgtgaatttctcaaaatgtttcaagaagaaagatattttacagatgtgaaaaaggtatggttctttcttgtcatctagtttaaagaaatcaacatctcatattcttccaaagagtccatttccagctttaaaaaaataaaatcatgttgaaactgtcaaccatgaagtcttttttgggttggagagatggcttagaggtttaaagcactgactgctcttccagaggtcctgagttcaattcccagcaaccacatggtgactcacaaccatctgtaatgggatccgatgccctcttttggcacctagggcatgtatgctggcagaacactgtgtacataataagtaaagaaatctttttttttttttaaaggtctttttcttccaattctatcaaataaagctgtgagattaagcaagtcttaacaataactactgtaagccttaactctataaatacagatttctatgcaacactattgacatttggggctaggtagttattgattttgcatcgtaggatatatggcaacatccatcaattaaatgtcaatggcatatacccagttttgaaggccagaaatgcttttagctattactaaatagatgtcccctggaggatggaactggctttgttaagaacctttgttctaggactaaagcctagtagagcttgttatgtagtagagtgggtactcacttgccatagcaaagcaaaatgggtcaccaggatggctcagcaggtaaagggacttcttagaggaccttattgctggggtcacagtgattggaaggagggtaccagctcccatagttgtcctccaacctccatgtgtgtgctgagacacacacattcacataaagtcagaaaaaaatgtaaaacagtgttttcaatataatgagtatgcatggtagtaactggaaaaaaataagtaaaaataaaaatatataaatgcctacagcataaaatgtcgatataagacctacaatatgtaaaaaggagtgtgactagaaactgagaagtctttttaagtctttaattttttggtccttaacttgttattcattcacataaaatacattattataaccctgaaaaacttggaacaaaaaattatcttaggatatagctaaactaaacttgaagaaagtaatgtttcgttatcacaatcctaacttagtgaaccaagttagcaaggctagtcttaaagcctgttgagtttctatacatgatttagctgttgatggccaagaacatttttactgaagtacctgtttagactgaagacatactttctcgaagactctatgagtgaaaatgctcccatcagatagggcttggttttgttttatttttacagagtctcagtatatagccttggctatcctagttcttagtatgtagacccggctggcctcaaactcacaggtagccacctgcctctacctcctaagtgctgaaactaatggtgtacaccactatgctgaacctaaatttttttctcctttagttgaaagcttttgagaaaatttaataatatgcttttaatttgtaaaataaaattacaagttttgtatannnnnnnnnnnnnnnnnnnnnnnnnnnnnnnnnnnnnnnnnnnnnnnnnnnnnnntacatttactgtctcatgtatatctgtagtcctgaggtagcataagatagtttgtcctaaaatcttaattatcgccaggcagtggtggcacacgcctttagtcccagcacttgggaggcagaggcaggcagatttctgagttcgaggccagcctggtctacagagtgagttccaggacagtcagggctacacagaggaaaccctgtctccgggggaaaaaaaatcttgattatctttgtgtgtgtccatgtgtctttctgtctgtctatagatcggacctaggattttacatatcctagactgttctgtctccagcctctataattaaggaattacgagtgtccatgtaactcatcccatactggcatttatactagtgacttttaagtgactcgtaactaaatcatacgctgttgcccacacagtaaaaggaaaggtaaccagcagagttctggatacaaggtggttatgcagtttggtgacagaagcacagcactgtgagggagtgaagatgtttacagctctaagtagagtgaatctaaaccagctccttacctacagttacttacgtctgagtggtttcacatcacacattggcttttatctgatacttcttcatataatgctaagaagtgagatattcaagtagccattaaactccactggtggatggcccatctattagaactacagatgagacagcatactttgttactgttgtccctggatacttgaacctgcaccaccaagacaaaaaggattctgttcttggttgttcacttaccaagattcccttccagcaaactggaaggaagcctcttgagtgagtgctctggtgggcgaatcacagcacccatagccccagcttgctgcgccttcagtcctgtagaggaagcactcgtcccttgatgtccttcttataaaactatgtgcttttgtcgtgtgtatcctaaatcctaaacaaaataaagttaaaaacaaaagcgaagacagcaatacaggccagacaactgggagcataatatctcttggataagcagatagataggattcctctctaagagggggaggtgctttgtgaagtgctgtttcctctttccacgtgctgggaagcccgtgactagtccagcttacatactcatgaagctaaatgctgttcactgagtggcctcctgtttctagcaatggatgctacaaattttcttgagccacatccttatattctgcatagaaaatttgtaaatatttatatttgattttaggttagctcatttgtcaaggtcaccagttatatataatagaaatcagcaagctattttctatgaataaccaatgaatgggagggcttattggttacataagaccaataaatccttgtacttgtattaaatatccccctttggttccatccagtagtcacacacagtatttatttgtcacgatggaaaacacactgtaaaatagtacatgagagccctgtgccagtgtttgctgcaaatcaaagatgagagttttaaaagggaagaaaaataaatgctttgagccaggtggtggcagcacatgcctttaatcccagcacttgggatgcagaggagggtagatctctgtgagtttgaggccagtctggaccacagaatgagttctaggccagccagggtaccaaaaatatggataagggccagatgtggtggtatatgccagtcatcttagcactgaggaggctgagacaggaagattacagtgtgtttgagttcagcctcagaaatagtgagaccctgtctcaaaacgaattacagttaaggattatagattgagttatttctctaggtaagtacattcagaatttgagtaagttaagaaacaatttttgcctttaatcccagcacttaggaggcagaggcaggcagatttctgagttcgaggccagcctggtctacagagtgagttccaggacagccagggttatacagagaaaccctgtctcaaaaaaccagagagagagagagagagagagaaacaattttttagaacgcctttcttttgtaaattgggaactttgtataaccaaatgtattttatttcatagattactataagatgagcctctttgatccaaggatgatctaagatctgaactattgcaatatttaaaacttcttgagtggacatgatgtcacagtggaaaattaaacacttcatctcaagtgataggtcacaaactgcaggtgtagtaaaacaaaaactatatgaaattacccttaggctatgtatatgaattttgtttagatatgagtccagtccccaagataccttactatatatgcaaatgtttcagaatcctaaatctaaagcactttggttctaagcaagagatttccaacctgcatatatatatatactttagtaataagaaattccctaatataatcagtgacatgcaagataaaagtttgtttgttttttaagacagagtttcttggtatagccttggctatccagaaactcattgtagaccaggctgcctcaaactcagagatctacctacctttgcctctggagtgctggaattaaaggtgtgtgctgccaccaccacctgacagataaaataattttttataatataccttatttactcacacactgtaatacttccccatctccccatttagttcttggatgaaatttcatctacggaaactaaagagtccagtggtacgagtgagcctgtgcacctgaaagaagggtaattaactaaatgagacatgaaagttataactcactgtagacagtaagtacaaagaacatggctttgagaaggaggacacctgagttttcattctgttccagagcttcctaagcggcttcagccaggtaaatcaccctcacggccctgtctgctccgtcttaggacagcacacgctgactacacagtcccaggctgttctgtagttaggaaatggctctgtttccttaccgaggagtggttgttactaggaataatgagatggaaataactttcctggccctttttattctgtatagcacaattctaaaacgacattacttagaagaggagaggtgcctcactcatggttaagagaggtagtggctcctgtagaggacctgggttcaattcccagcacccatagagcagctcacaactgtttgtaactccagttccaagggatctgatgccctcttcagatttccacaggcaatgtacactgtgcatagatgtcatgcaggctacgccattcctaaaaggagaactaagacagccctgcattgatagaaggacgtcctgagtcatccccagacgtcactgctgtgcactagtagccgtgcatggccgcgatggcacctaacagtcagggtcagcttggtttcagggcagtggtttgcacctctgagggttaaatgtttgcttctgtctgttatgttggcagtgagatgtataagagagctcaaggaagaacccgtattggaaagaagaacttcaagaaacgatggttctgcttgacgagcagagagctcacctaccacagacagcaaggtagagttgtgcttgggcttcgttgtggctttactctgctggttcatggtgccgcggtgatcgctgcacagtaaatggttcagagtgtctgtcccacagtgacacacaaaactgaactgaagtgtttcttttatcacattatgtagtatataataaaactataacgtaaaagcctggtgtaaaccagtttgagaataaaacaactggacttggtaagtaagacagtataacaatacaaagcagaaaggcacagacttaacaggttaactaacaaccacaagcactcagctaatctgttaactcatggtgctcagtaggttttgaagtcccatgaaatctgatgggtaaataccaactaggagagcttctcctatgaataccgaaatgatgacataaaggcctgatacaaggtactttgagagaatatagagtgcttcattgggaattcctgaatagtagaataattgagaagagagatattttaaagagatgaggtcttgacccagaactctgggcttaagcagtctcttgcatcagcctcccaaatagcagggactactggcatgtgtgcacatgtgcacacacacatatgagcagtttaacctgaaggaatgaatagacatgtatattccaagtatattaataagaagttttttacagtgtgttgcattttaggcatctgcatagtttgttacagtatataatatgtatacagtatataaatatgtaactaacgatcagtaggcttacctttgtttttaaagctgtctttgaatatttcagaattctagtttatattaaattttatataaatattcttacctatggataccatagttgtgtgataatggttattttaatagcacaagcacaatttaaaccaggcatgggggtacatacctctaatccaggctctaaacagtgggtggagttataggacagagacagacagatctccatgaggtcgaagccaacctggtctacattgtgagtccttaaacagcccagataacagagagagactgctgcttaaaaaaacaatcaaacaaaaaaccctaataattataacaacaatagtgcaattaaataaaatttaagataaattagtcatcttctgtgaataaacaagttatttgttcctcagttaaaacactatctagccaggcggtggtggtgcacgcctttaatcccagcacttgggaggcagaggcaggcggatttcttgagttcgaggctagcctggtctacaaagtgagtttcaggacagggctacacaaagaaaccctgtcttgaaaagccaaaaaaaaaaaaaaaaaaaacaccaaaacaaaacactatctaatctaacccagcattccaaagcctgctagttagaaagttgttgaagtcagatgatagtcatggtgaatttcctgagaatcttactatgtacatatacacatggagtttgcataggaatttcatggacctcagaagcctcaagtgtacctacagttgtcacatttagccttttgttctagccagtgatgctaaaaaaggatggactttcacagaattaagctagtagaactgtaagaatggatgtattagatctgtgttggttttatgttggaggaaatacacaggatggtgagattatttgccaaagcttacagttctaagcatgaataattgttgttttaactattttgatggatttttttccaaattggattacatcctttcctgctgtctaaaaaagaattcatcgaacataagttcacattttctgatttcttggggtggtcatgggtgatattactgcatttttagagtgccaaagggtaggtgcagctgttttttccagctgacagcctttgttcccagttaaacacctcagaagctgcgcttttgtgtccgtgtgtttgctttgtacagtttatctctcacctcttttagtcaggctgttatcttaagtttcctttgctgtcagtgacgtgtctcactcccatccctgtagccagccttcatcccttatggctaatatactagggattaaggtgcagatactataattgctaaactacacctaagatctaaggcttcgaaagcagatgtaagggctttccctcataaataaagtgtccgagctttgtatttgctgcttgctcagcttacttctatcttctggctgttttcttgatagcctaaactagtcattattttttgttgctacagctactatattaaattttgctatacaataaattttgaggtgccgggcgtggtggcgcacgcctttaatcccagtgcttgggaggcagaggcaggcggatttctgagttcgaggccagcctggtctacaaagtgagttccaggacagccagggctacacagagaaaccctgtctcaaaaaaaaaaaaatttttttttacatttggtttggattttctatattgatacagattaaggctatatttcgttacaacatactatgaatatatgtttcaactcttgtttaaggtgttgtatctatgcaatgcttcaaaatgcaatattaagttccatataatgatccttaattttcctcagaactttaaagttataatactctgacctatggccatagtatcatagttccattcttagcttacctcagaaaataagtagacccctaacctagttagtagttagatggaaaactacttgggaataacaggtgctgtaggtgtgtgtgtgcgcatattttatttttatatatattgctccattgttaatagcttccattgttgctagtgaaaatttttatatctgattattaaatttctgatgtgtctctctggaaactcttgtaacatttctttagtaagttttgctattttgtgacccataatttagaaatttttcctttttctttttcttctattcctgcctaacacttggtatatctttccatttagagactccttatctttttcttaagggcatttagtcacttgccaacacttttaagtcctatgagtctaagcttgtattattgtttctatgtcattctgtgttgtagttttggaaacttcttggagagatcttttgtttctaactcacattgtaatgttatcatggttgacagaagtagccttcatagtgtaagaacagataggtagcccctagagcatctaacatttgtagtattagaattggttccaaatgaataagtacaactttagagtatggacatgttgtaaatatctaacagatttaaagaaagaatatttttaaattatctggcctccactgtcctgtatagcttggtacccaacgctgtctctctgtctcctttgtcccccagatcatacctctgattcattccctcagatgttctctgtatgtgtagctctgctttcgaatgctaattttcctatctatttggttaccgccttgacagtttgctcatcttgtgttctacagtccatttacctaccttagggttcagtaacatactcacaatgatcatgttatctcattgcactgccctgccacccagctacagccttgcttcactagcctgtgtagtttggcctgatggagctcatctgttagttaaccatcctgctatgtctgaggctccagctccagcctgctgtgcctgcagctctcctaacttctccccagctgtggcttccatcagcatttccttccgaccctaccttctgtcctcgccaatgttatcttgtctgcttttcttttgttcctgtagatgactggtatttgttgaatgttatttccacagggaagttctctaactgcccaatctagagtaactttccattacattttgtcacatcacttcagtttatcttcgtcacagtgtccatctctagttaatattgctctaccagtcttttcagaactcaatacagatttcactaggaacctattccctgtttattgttctgtcttaaattattacaatagtacctggcatatagtagacattcaagatgtatctttttaaaagtacatgccatgtctgtttgaatcaccttaaattttaggctttgtaccaggaaagtgtctgaacaactattttgtattaatgtctttatttacagcaaaaacaaaatcacaattaaccagatactgttctttgtcaaaaaaaaaaaaaaggtcacagcattaatcctttgaatagtgtaaaatagaatgtttttagcttcttatatttcaacccacacgtccttaaagaaaggcttgaggaagaagtagaaacaaagctttgttggtgtaaaaatgccatcacaaaatgacagaagtcaaaactgcatttgtcattagcttcttctataactggatgagggacagatacccaggctgtactgacatgcatcatcttagaggaggccctttaacaaactcaaattcccttacctacgtttcagattgtaaagggttagggattccatctgctccataaactctcacattgtctctagcacctcctaagcaaactttgtagtgtctagctagtgactggctaaccggtgacagctgtaaatagtttaaaccatgctttggagctagcaagatgagtcagagggtacaggattgactgtcaccaagattgataagcagtccactgtctgggacccatatggtagaagaagagaactgatttctgccagttgtcctatacctctgtacatgtgctggggtacacgtgcaggtacatacatgtgtgcgttcgcacacacgacacacacacacacatgcacacatatacacacatacactcaaacacatacacacacactaaaataaaatgtaattttaaaaaaatttaaacaaggctcatggtgctcatggtggcacacgcttttaatcccagcacttacaaggcagaggcaggtggatctctaaatatgaggccagattggtatacaggatgcgttccaggacagccaaaagagactttgtctggaaggaaggaaggagagagagaggggagagggagaaaagagagaaacttaagaattcagtgcttttaaccacttggttttgctcagtttccagcaccaacatggcggctagcagtcatctgtaacatcagtctcaagatatggaaagccctcttctgactttggggggcgggggagagggaattgtttgttttatttttttgagggcactgggcacacatgtggtacacgtatatacatgctggaaaacacatccacatgcattaggaatagagatgtagatcagagctagagcacttgcctaacatgcatcatgctttgggtttggttccttgcacatatacacacactaaacgatgatgttgttgctgttgctgttgttgttgttttgagggctagtcctttaattaaatgttaggttgacaaacagaaaggattctacttgaatagtcatattcactgtggtcatagctcctgagcctgggcctcaaagtgggtctctgtcactagacacattagttctttcagctgccacataattagtgttgcaaatttgtaatagcatagaaaataattgtccatataaagatcaaacttagatgcttttccttgaaaatattttcatttatgtgttaaaaggcagggacattcctttacattaaacatcaaaattctctttccgggctggagagatggctcagcgggtaagagcactggctgctcttccagaggtcctgagttcaaatcccagcaaccacatggtggctcacaaccatctgtaatgagatccgatgccctcttctggggtgtctgaagacaactacagtgtacttataattaattaattaattaatcttttttaaaaaaattctcgttccatattatacataaaccatccagaagtctattgtggatgcatatgcttctatcagctagtggaattagccttgcagaattaacatctcatctttatggttattacagtaattcttttaattttgtcgtcttttattatttaggcaaagatgcaatttacactattccagtaaaaaatattcttgctgtggaaaaattggaagaaggctctttcaacaagaaaaatgtaagttgcataaatattgaagcattttaagtcatcaggtgtacgtaattttggtatctaccattcaggtctctcaataatgtcccaagttaggccactcagctggtgcaggaccctccagtccccaggatgacatctctgttccttagcatctcctcactaacttgtggttcccccaggttctcctgcatctgaaattacctttttgttcttatgcagacagtggcctcctctgcacttgtatggcatctgcagtctgtattgttctgcttagccccattggctaagatgatctttggtactgacctgcttactgcaccaattcattccgacacattagcagacatttcttagccaagcaatccaggtctcctaagtgctttttctttttgtatagtatatgttgtttttaaggtttctctaactttttattttaatttgcaataaagatgttccaagtgatacatacagagaaaacgctgtacatccaagcaaacaactgtgtggaagccaatgagtggatagatgtcctgtgcagggtgagcagatgcaaccacaacaggctcagctctttccacccctcagcgtatctcaacggaaactggctctgctgccaggagacgagtgaaagcacaccaggctgcaagccgtgcaccgcgtgagtaactcatgactgcatgcgggcgtgggtgtgagagcatgacagacgctatgtagaagtagctggacagaggccgcacggtgctgaagacatttctataaaccgtgtctagaaaggcttgggttgttgcccagtggtagagtgtctctctcacctgacacacacaggggctttggtttaattctagtaccacaaaaattaaaatacagagagtaagtaaatttctatagacacaactgtaagttagtggtgcccaggggctagattgatgcattgttcggtgaacaactataggttatatatatgtttattgggactggggagcagttagtgcttgttgttcttgtagaaagaagactcaagtttagttccaaaacccatgtgacaccagctccagagcacagatcagataccgtcttctagcctctgcagaggcatgtataggcacgcacgcatgcgcacacacacacacagatatacatatatacattaaaaatattttttatgattttacttcaaaatctttttcaagacttgagtccttaacaaccagaccttgtgatcctgttg

SEQ ID NO: 1080 - DNA, 2547 bp, Mus musculus
atggcggcggcagcgcctgctgcggcggcggcttctcccgaggcgccggccgtctcgggcagcgcagacccggagacgggagacgaggacagtcgtgaggtccgagtgctgcagagcctgcgcggcaggatctatgaagcaaaaaatttattgccatatcttggacccaacaaaatgcgcgattgtttctgcactataaatttggaccaggaagaagtttatcgcacccaggttgttgaaaagtctttaagtccatatttcagtgaagaattttattttgagattccaagaactttccagtatttgtctttttatgtttatgataaaaatgttttacaaagagatcttcgtataggaaaagtagccatcaaaaaagaagacttgtgcagtcatagtggtaaagaaacttggttttcactgcagccgattgactcaaattcagaagttcagggaaaggttcaccttgagttaagactgaatgagctgataacagagaatggaaccgtgtgccagcagcttgttgtacacatcaaggcctgccatgggttgcctctcataaacggacaaagctgtgatccttatgcaacagtgtccctcgtgggcccctctaggaatgaccaaaagaagacaaaagtaaagaagaaaacaagcaatccacagttcaatgaagtcttctattttgaggtaaccagatccagcagttacagcaggaagtcccagttccaggtggaggaggaggacattgagaagctggagatcaggattgacttgtggaataatgaaaacctagtccaagatgttttcctgggagagattaaggttcctgtcaatgtgttaagaagtgattcctttcatcaagcctggtacttgctacagccaagagacaatggaaacaaatcatctaaaaccgatgacctgggatctcttctgttaactctctgctatacagaagactgcgtgcttccatcagagtactatggaccgctgaaaactttgctgctaaagtcaccagatgttcagccagtatccgcctcagctgcttatattttgggtgaaatatgtcaagatcaaaaggatgctgttttgccccttgtacgactgttgctgcatcacaataaacttgtcccttttatcactgcggtggccgagctggacttgaaggatactccagatgccaacgcaatatttagaggaaactccctggctacccagtgtctgactgagatgatgaagatagtgggagggcactacctgaaagtcacgctgaagcccgttctagatgagatatgtgaatcctcgaaatcctgtgaaatagatcctgttaagttgaaagagggagataatgtagagaataataaggagaatctgtactactatgtggacaaagtattcaatacaatcgtaggatcaagtgtgagctgccccactgtgatgtgtgatattttttattctctgaggcaaatggctgctaagaaatttcctaatcaccctcatgttcagtactctgcagtgagcagctttgtcttccttcgtttctttgctgtagcgatactctcacctcatgcttttcatttgcgacctcattatccagatacacagacagttaggacattgactctcatctcaaaaaccattcagattattggaaactggggatgtcagtccagaaaaaagtcacggttcaaaaagtcagtcatgtgtgaatttctcaaaatgtttcaagaagaaagatattttacagatgtgaaaaagttcttggatgaaatttcatctacggaaactaaagagtccagtggtacgagtgagcctgtgcacctgaaagaaggtgagatgtataagagagctcaaggaagaacccgtattggaaagaagaacttcaagaaacgatggttctgcttgacgagcagagagctcacctaccacagacagcaaggcaaagatgcaatttacactattccagtaaaaaatattcttgctgtggaaaaattggaagaaggctctttcaacaagaaaaatatgttccaagtgatacatacagagaaaacgctgtacatccaagcaaacaactgtgtggaagccaatgagtggatagatgtcctgtgcagggtgagcagatgcaaccacaacaggctcagctctttccacccctcagcgtatctcaacggaaactggctctgctgccaggagacgagtgaaagcacaccaggctgcaagccgtgcaccgcaggcatccctgcagacatccagatagatatcgatgaagacagagaaacagaaagaatttattctatttttaccctcagtttacttaagctgcagaaaatggaagagacctgtgggtctatagctgtgtatcaggggccacagaaagaacctggttattctaagttcaccattgaggattctgttgcaacctttaagacaattcagcaaatcaaaagcaccatagagaagctcgatgaacctcatgagaaatacagaaagaaaagatcgagtagtgcaaaatacggaagcaaggaaaatccaattgtgggaaaaatatcatag

SEQ ID NO: 1081 - DNA, 2547 bp, Mus musculus; identical to SEQ ID NO: 1080

SEQ ID NO: 1082 - DNA, 96596 bp, Homo sapiens
  misc_feature (19512)..(20471): "n" at positions 19512 thru 20471 can be any base
  misc_feature (41369)..(41388): "n" at positions 41369 thru 41388 can be any base
  misc_feature (85221)..(85596): "n" at positions 85221 thru 85596 can be any base
cttccttttcctgatcctgcccaaagtgaggaggtttgttaagcagataggggaaaggctgagggcttcggagtactgcatctttaggaccctgggaggagttcaccttatcggttgcctgacaccaccccagaagtggctatatcaaagtttaactcaatagcacagcatagcttgcagggaaaggggtgaaatataatttcctgagcttcccccaagaccagtacggactagactggaccaaggagtttccacatactccagagaagaggcgtggaaagcagctgaggtggtagccaccaggcttccaggcactggccatcacaagggaaaggtgaatcagcagcgaggctggggagagatattctagtgaagagccagatggaggatgtagggtctgagaggcagccagagtggagtctgagtcatcagggaaaacaagcaggcgctgccaagccaggaggaaccaaatcacaggtactatagatacagcctcaatagcaggccctcacacaactcccaggattgagcccgtctcaccctcaaaagaagtatccagaaagtatccagaccacccacccacaacagaaatctgcaaagatgcaaaagatactgcattgatacaaggaccccacctcttctctgtctctatggggtcatttagccacaactccatcaaaaactcagacaccatctcaaaaaaatataaaaaaagaacgcagatatctaagaggctgagcattatttacctaaatggatggaccatttatataatgtctatttaggtcgctgacacctgtaattccagtactttgggaggtcaaggcagaaggattgcttaagcccaggaatttgagacctgcttgggcaacaaagcaagacccccatctcaacaaaaaataaaaataaaaataaatggcttatacctatagtcccagctactcaggaggccaagatgggaggatcccttgagcccaggaattcgaggttgcagtgagctatgatcatccactgcactccagcctgggtgacagagtgagaccgtgtctcaaaacaaacaaacaaacaaactggtgcatcagaatattttcccctctattcagttattggagactcataaggaagagaagaacaattttagagaaatgaagatgctacatcttctttgcacatctgtgggtaggatgaaaaaaatctgcaacccttcacacatactagtgttgccagtttttcttgtcctcctccccactgctaaatttggtgctgcttgggctgctcagttcctcccatccacccacacccaactgtagagaagagcgtggagggtccagaccggatctttgggacttttgatgcaaaatttaaaaaaataagagaggaatagaaatgacataagccacatgggtacattctagggagaaaagaatcaaagccaagcttttcttgcaagaagcaactgagagtgggggccattgatgtgctcaggggcatcaagtgggagcaggaggacagtcagagatagaaagagagaacgggtgggtgggagagtgtgctactctggggaaagagggtgagggatcttggttttgttggatattggagaagataagatgaaaaacattttgataagaactgctccagcctggtgctgtgacacacacctatgatgccagctacctgggaggctgaagcaagagaatcccataaacgggagttcgagactcacctaggcaacatagcgaaaccccatctgaaaaagaagaagaaagaagaagaagaagaagaagaagaagaagaagaagaagaagaagaagaggaagaagaagaggaagaagaagaggaagaagaagaggaagaagaagaagaaggagaagaagaagaagaagaagaagaagaagaagaagaagaaggggaggaggaggaggaagaggaagaggaagaagaagaagaagaagatgaggaggaggaggaggaggaagaggaagaggaagaagaagaagaagaactgctctagattatatacttgtatctcattttttaacagtagaattactatcaggactttgcttctttgaactctacccactcaggcactgaacaacgcagacctcagctttgacaggtttacaaacacaatgaccctgttaatacaaaagatgtattaacatacagcagagattctcaacggggcggtgatttatctcccagaggatatttggcagtatctgtagacatttttgatagtcacaactggaatatgctggtggcatctagtggatagagtctagggtgctgctaaatgccctataatgcacaggacattccccaacgagaaagaattacccatcctagccaaaatgtcagtagtgccacagttgggaaaccctgaaatagagaaatggaggaagggcagttgtttccttacagcttccctttccaatgacaaaataaaagacagctttgtttcattcgaaacacgttctcaagtgtgtgatattcattcttaatcagcactacatacatataataatctcagccaaaccatataaatcagttccctaaaaccctttaaggtaaaagaattcccattgaagaattccagatcctgtggaaaaaacggagttgaataaagaaggctccagaaaattttggaaaatctttataaatatttgtattttcaatatgaaatatgaaaatataataaaactagcacagcaaataaaatagctatgacatgtaagacatgcttattatgggtaatcaggttactctctatgctttgctcattctgagagaatcctcagaatctagcttatattccatcacgccccttgagaaagtttagctgaggtgttagtacgtttgttttgcctcattgcagataagacattcactaagaaggattatttggagttaagggtgctggggacagtggtatatttggccttccatacagatgctctataaatgcctctggatttttatttcaatctccttggcccctctctccaacagcccttcccagttctatctctgcacagacagcccaagaattcagtcctaaggacccaccttacatggcttaaaacaacaatacacaaactagatgttttacattctggtggccatgtcgagtaattatttgataggccacgagctttcatttgtggctgtatatccaagtcagttttccaaaattcagttatatgattataaaataagtaccaatgtctttagaactagacaaaatacaatttattaaaatattttatctttatatatgtgataaggattgaggggttcactccctcattccatccccaatcttgccctcttttagatgaaaggcaggaggcagttgcctaggagagggcaaccaatagccctggcctaggcaggtcaatgctggcctctctccttcccttggaccctcaactgtgagggctaggataccaggccgggctgttcctaaagactctgagcccaagcagtgcagctgggcctagaaatggggaggtaacccttcttgccaactttgctgaaaatgtggaagccccgcgggttctgaaggataacgctctcggcttgggccttgatagtctcatagcaggcatcataaagtggtgagggtccctttttgtgacagtggcagggggagccagagcaggagaggaagaatataacaaatccagcaaccccatcatgttccccacaccctactctgccaatgtaacccactgggcactcctgaaaatcaataattgggaagaggtttaattatttgggcaggtagaaagtggagacacaatagagaactgcggattatttatgttaacaggatttcatttgtagccacagactgacatgctgcctagatatttggtcataataacaagtatgaaaacaccttgcaactttgaaatcagttttcccagcttctacaaccacccacaaaaaattgtatctagcctacgtttagaacacagattatgatcgatgagcttctgctctccttggctgtctctgacaaaaatgagctgcttgtgacagacgcagccccagcccagtgtgaggattggaaacctcagaccctgactctttccctttctccttccttatctgactcctgagctattattgccttttctctgcacctaagctttctgcaaagcccagacccagccagctggttctgtggtctgctctgatttcccttgtggattttaaattcagaattctaggctcatttgttagcagcttctctgaacacattatctcatttatttgctcattcattcattcgttcatttatcaaacatttaataagtgccttctgtgttcttctatattttctatgcgctagggaggcaaagacaaaacattgtccagtctttgagatggtttcagacaggtaaacaaacaggaatagtaaatgtgttatgagcactacaatgattatgtgtattcttatatacatggtacataatggcctaaaggaaaaagaggccagttctgtgagacaaagtcaggaggtgaagattgggcattaaatgtattgaaatattttcatttgaacttaggcactattattggaagataagtatgttgatatggtgaacagagttggctgcctactccatgtcttactgctcccctttctgtgtcacaagaaaacactggtttggttcaggcttcaggtctcaagtagcaatgtactttgggaaggagggttcatccccagacccaggggtatcaatgttgcttagactaagaaaattatatattccttgtgattgtaaatgagccttaagaagatacctcatggtggtgatttacaggaaagctacctggaaaagcgttcctccctaatattaggttggtgcaaaagtaactatgatcttgccactgaaagtaatgaaaaagacattttagaaaaaaaaaaatacaccttcctgccattggatgttgagatatttggaggtacaggagccatattgtgaccatgaggcaaaagccaaaagaattgcaaagaagctaacccaataaagtcctgtttatgaatgaatacagagtagaaaatgaaacaagtgaatggctgcacaacatttccagttttctttttacacttattgttttgtatgtttttatttgtttggttggttttgagttttgggggtttttgttgtttttgttttttgatttgtttttttaatagatttggggtctcactatgttgcccaggctcgtcttgaactcctgggctcaagtgatccacccaactcggcctctgaaagttctgggattataggcatgagtcaccatgcccagcctacacccattgttttgttttatcactaaaatgacaagaatgcactgcagatggaatggatatggcaaaatagttcaaaaggagggggattgagaaataactgaagtcacactgacctaagggcatcagctgtattgtgctcagatattcaggcctttaaagttctcttgcaagaggtgacagaatttgaaaaaaaaaaaattctatttttagagacagggtctctctctgtcacccaggctggagtgcactgggatgatcatagctcactgcagcctcaaattcctgagctcaaacaatcctcccacctcagcctcctgattagctaggagtacaggcaggcacgtgccaccatgcccagctaatttatttatttatatttgtagagacagagtctcacggtgttgcccaggctgctcctgaactcctagcctcaggtgatcctcctgtcaaagttggtattacaaccgactgttggattacaggcatgagccatcacatctggccttgaaaatatttgtaccgaaggagttggaggttttaaggtaaaaatttgtccacatttttgtccacacagccttgtcaatggccttatttggtcttcaaatgaaatgttgaaagtatgttttctgaacatttaaggtctctcctcacctcctaccactccaattttattttttaaaatgccagttggatttagagatttttttttaataatgtaattagtgcataatgcttaacatcaaacagtactctgatggggcaaatggggaaaccaagtcatcaatgatcaaaggaacttgctttcccaccagtccggcagaaacagttctgtctcatgagtgtccagccctatgaaaatgatctacatttaaatattaaaaagaaagcacatttctcttcctcctactcgccagaaaaaatgtaataaataactcaaggccaggagacaaccccttacaatgccatgttataggttggtgggtgctgattcaaaaatatgccgtaacagacaagttatggaattagtttctagctgcaggttatagtcttcttattaagagacaatgtagttttcctacatcatctgccataaagcaagccaatgtatgggttgaaatgactgaatgagtttaaaactggtgaagaaataggaaaagacatagtagtgaatggttgctcatcagaacgaagagtggtagggatagaagggatggcctttaaacacattcattaataatttgaggaaggaagtgaagttcaagtttgtgatgatgcaatattgttccagttactaaacatcatgaagaaaagagaggaactctagatgaatttaaaacataatgcaagggcaataaggggaatgagatgtaacagccttctcgtaattatactgtatgtcttgttagtctttagaaaactttattttcggccgggcgcggtggctcacgcctgtaatcccagcactttaggaggctgaggctggtggatcacgaggtcaggagatcaagaccacagtgaaaccacgtctctactaaaaacacaaaaaaaattagccgggcgcagtggcgggcgcctgtagtcccagctactaggaaggctgaggcaggaggatggcatgaacccgggaggcggagcttgcagtgagccgagatcgcgccactgcattccagcctgggcaacagagcaagactccatcttaaaaaaaaaaaaaaaaaaagaaagaaagaaagaaaactttattttccaaatattttatattaaggaaacattgacattacccaagatctcttcaaagtaggcaagtatcagtaaaaacagaataattagaagtgacttcggatgaaaaagcaatggagtttggggattttagtgaaacggtataagtccgaaatctgcaaaaggaagactgtctggaagaacaaaaaagtggagtgtccctttatgtaaaattgttttcatacctttagtgaccatttagtaacagagttatgcacttggggttaagctagtgaaaaggaagggaagttagaagattttgacactaatggacaaagatattgatactttgtccattggatacgtttgtccattggatacatttgtccatttgtacattgatactttatccatggatacatttgtccaaaggttcaaataatttctctgtttattggagaaagaaatagatggatgaggcatcgcttggccaagcaggaggaaggccagaatcaggctggtgagaaaaggggctcagtgtggctggagatcagaggagtcaggtacgctggatccagttccaactcttggctgaagaatttgaactttagtcatttctagcattgttcattacctgtagtgtgctcttgctagctggctgaagggataaatgaagccactgatgtcctcttgagcaggcaactgataagctccattttttttgttaggaaagttaatttaagtggtatgtaggaggaatgagagggatgggggacttattaccagagttccagtcaaaagcatgaggtcagttactgaggtaatcctactacgtgctcagcattccactagacacttaacaccctgctcccaatacttatttaatcttaataacaacccttcaaagaagaaagtttagcatttccactttactgttaaagaaacaggttcaaccgggcgcagtggcttacacccagcactttgggaggctgacacggatggatcacttgagcccagaagttcaagaccagcctgggcaacatggcaaaaccccatctctaccaaaaatacaaaaattaactggacatggtggcgcgcacctgtagtcccagctacttaggaggctgacatgggaggatagcttgagcccaggaagttgaagctgcagtgagctgagatcgtgccactgcactccagcctaggcaacagagcaagactgtcaaaaaaaaaaaaaaaaaaaaaaagaaagaaagaaagagaagaaacagaaacaggtttaggaaggttgagtaacttgcccaaatgtaaaaggggtagaaacaggctctatgtctgattctaaaaagggatgcctttaaaaataagggggaaaaaaccctgtaacacgttgatactctttaaatgagaataattttaacaagggcaatgacagagaatggaaaggaaggaagagatttcagcagagtcagaaggatgtggcaactgaaaacagcattgggacaagggataagaaaaagtcaaagtttctggcctgagtaacagtataagatgtgaactcagatttggaaagggagacaggaaattaagttttggacttatgtttgaaatgacagcaaaacattcatataagaggaagtggttcactttatccaacaagtgtaaagatcacatggggaaatagaagtcacctgcaacacaggcagaactggaagcttcgctggccaggtccatgttaaactctgaccattctctggggctgtccagcctttgcacaggcggcgcgtttgtcttcagttttcaggtttccccgtcctatttcttatctcccagtgcctctggccttttctgtgtctccctccagaatgagctggagctctcttcatcttgacctttgtgtagtctctgaggtctgaggccatcactatgtctgaccctcaaaaaatatttgttgactgactggcttattcctgttgttgccctggaaaagaattaccctgcccgattaagtcacagtttcttccttcttagggcagcgtagttaacaacctcaacaccaggaaattgtcttcctcatcacataccagggtattattcatgcagtttactcactgtaaagagttcccttgaaataaagctaacaattagtcaaagatttacacatttcctagggtcagtcaactttttaacaaagccaacttttagtagtggtggcggtggcgggggggagcccttctttgctttttctgttcctgaaatacaaaagtgatggtaaatgcttcagaatttctctatgagagggtctcaggcactgcactcacgctggagttgggggtggctggtccttttcttgaaccaggttttgcagagaattggtcctagtaaagagtatttgtgtgggaggagtttggcttgctggcggggagtatttggataatactggaagagcctcaaatgcatctcttgcctccttttgaataagatacttttgaggtccacccacctgccaaattccattctattttcttcccacagggagtttccctgattgggaagggcctgtatttcccgcgagcgttaggagatgtgcaggtctattcattgggggagcccaattcccgggaggatttagggatcacgggagggccggggcgttctcctggtggggattttaaggccgctcagagccacgactgggagctacccttagccagcgccccaagccgggagtacggttctctgcagggtagcccggctcgggggtggcgaaggcggtgaatggagacccggggggggcgggggcggggccgcggcgggcggggcggggcggggcgagtcgggccgaggcccgggggcggggccaggcgcgcggctggcctgggcctaggccgctgctgggctccgcctcgcccggctacgcaggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtaagcgggggctgggctgaggggacgccctggcggcgctgggcgcgaggctgagggggcggcgggttcgcggcggtggcggcgccgagctgcgctgggatcgcgggcccgggagggggcctgggccgggcgcggttgaggctggaagggggtgtgttggggggcggcgtcgcctcgacggggcggcgtgggccggggctgctgctctccggagggagtgggagctggagatgggcctggggtgggagagcccgggctgcgccggcgtgaggggctcggtcgtggggagcggcctggacgcggggacgctggagtccggggcgcggccgggggcgcggtccgggggcgtgaggagcttccggccgccctcagactcaggccttcgcgcggctgcgggcgctggggagtggccccgcggtgggagccgagcagtaattatacggaggcgcggcccgaggaggtggcgggctgggaagtggggctggcccgaggggagggggctgttcgtttcctgggctcggcgagcctgggagaggttgaaaaaggcgccctgagctgcaggaaacgggccgccctggggcccgagtggctaccgcgcggtctgttcgcgggtgagcgccccgggaggagctcggcgggacacctgtacttgccccacctcgctgcggccgggacttgaatcgagggacggcgtgacaggcgggactaaaggcaggatgtagtggcttcctgtgagcaggtctcaaaacacaatcacccagcccgcactcagcccgcttaattcccttccttctcatgcgtgtaattgctactttagtgagcgagcctaccagttgactaaatacgaaattttgctcagagttgtccgagcattactgtggacagattatttgagttctgtcatttgaacattttagttttaaaaacgaccttttggtgtcaggttgccattttttttttcacagtggtttatttagatgaagtgctttttgttttctgtttgtaagagagatcaataacatttatttttgcatttgtcgaaaattagcattattttcttcatgcagtattctcagattggaaacatgcttcatgtttcttataaataaccctcaattatgagggcgtacttttcactttgaagaaaattgacttgcattaaagtggctaacaattctttcctgggcaggatgtaaaattttcctctcctctaataccagtactgttgagctcacattctcccacttttcctcttttcaggtggttcacgtatttgggattttatgaaacctcagaagcagacatgttaacttttcttatctttttattccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttattttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaactacatatacacatgtcttggaattgagggttagggtttccagaaggacttagttgtcctgtgcttttgtctgccccatgccaaagaccactaagaacagttttgtaagtgaaacttgggtctacacgttaaaaaaaagaaaaacaaaaaaccactttgtttctatggtttaaagcaaccctggcttggaaattgatcatccagctgctgggaatgatattactgctttaaccacagttgaagtattctatctgttatcctagtcagtttcttgctttttaaattgcttatcttatagctcaggttatggagtgtctgctttctagaaaaaaaaaatgtatttgtatacttatatacagaagctctcttcccatttctttgtcctccttttaaatgatgtaatccacagttggttgacattcagaaccttgtgaagagatgctgttttctgtttccctgaaactaacatgtgggttttgtagggtggggactgaggggttggaagagtcattagcaggtgtcaaggtcacagaaatgagatggtggtggttctgacaagatattaagcagcttggggagggtgtaaccgtgtcagcttttctcttcaccacagtaggaaaccttggaagaaagcctgatagtgcccactaggagatgtgctggcagattttatactactgattgagagcctcttttctggagagttagagatctgtaggggctgaaaattagcctgaagaaattttcttatttctggacttgcataggacttttaaactgcacatcaccccagtgaaaagtgaggatggattggtttatgtatcttgaatgttcaagagataatagtccataaccttctttagggatttcattcctgtaattatttccccttatacttcacaaggtgaaatatctgtcagttggacagatatttgtctcttggacaagaggaaacttaacaaaaagtggtaaccaaaaaggtggaggtcacaaaataacaacatgagacctcaatatatataaaggatgaagccccaataccccttttttgcttgagtgtacttttttttttttttttgccggggggctggggaggagggaagaagggacatgcaaatatgtttcaggtgttttatatgcgctcaaacgaacccagggaattcgagatccatctataagacaaaatattgtcagcaaccctggatttgctgcagtttgcgctaggaaaccatgacagttctgaattgtctgcttccttaaactttttcaagaggtgagtttggttgtttgatatcctaaggttgtcatatgaacccttgataaaggaaattaggggtgtactcgactccattcttcggtctgcactcctgtgtagcgagtagcaagtatgctagaacacctgaaacacatttgcatgctccctcctcccctcaaaaaaaaaaaaaaaaaaaaaaccgtattcaaacagaaaagagggattggggcttcctcctttatgtatcttcaggcttcatgctgttatttggtgacctcctttttgattagcacttgttaagtttcctcttatccaattacattagattgtaaaaatgttgcggagagcacccatgccaccatatgtgtgggcttatctactcaaggaataccagatcaataagagagccaaatgggaaaattttgtgtgaattttcagatgtgtggtacagtgcgagatctgtgggactatgtgttccaaaactcacttagtttctctggtgtcttcagaccaagaatagcctagggttatttgacagagtagggaagatctatagggtatggttaagtgcttgagcttagaggctgggtgaaaaagttagttacctgggtttgaatcttcacctaatttccaacttttgttaatgtctttgggccttcatattctcatatataaaatggggatagtaaaaatacctatctcacgggttgttatgaggtttaaataagcctccctccctactctgcccctcctcatctctgcctgctctttctcactccccaggatctgggtcatacaccgaccatctcttaggaaggagtaaagtaggagataaaaactaatcttcatctgatgttcttgtccaacgtatactggagtttccaggtgtacaaagctgattaaaatctgaagacctatattcttctttaaacgttgttaattaatcttcatatggcgttagccagctcacttatcttgaagcttaccttccgcatcttttaaatgggaatgatgcttttccactatccattgtatacaggttgttccctctgcttgggattgtctttcttctttactccaccccatctttatgtcaggaagctcctactcatccctcaaaagcctgctctatgtgatctccttcccaaaaccttctgagacacttccagtgccatctctggccagcatctctgctgctggggaacacaattccttgctcatttccttattatagcacatttcatagaaatcatttgttcacttctcctgttagattgtgagctctttcaagatagaattgattcttgttcatttttaaaaaatcatcccagtgtcagcacaatgcctagaacagaataggcctttagaatatgccctacctcacaatgttatcctgtggataattactagatatgaaaggattttataaattatatacctaaaaaaactagaaggtgttagtattaagagaaaactgtatgagtctgcatcaggaagttcatccctttcaaaatcacagtgcccactaagcttaggtttgaattgatgccaaagttgccttgttaggaaaaagattaaatttttcttaatgctctgattacttattattagggcatttgaatattgttactaattggtcctggagcttggaaaagaaaatctcatattcatactttacacattaagtgttttaatttgacatgacaggtttgaataaaaccgtctatttaattctgtgaagtataaatgaaaacattttattgactatccagtaaagttgagtggaagagattaaaaagggtgtattcatgctaagagttcatttttatcagatatttgaaatgagatgatgagttatttaggatggaggaagaatccatctttcagatggatagaaactggggagaaaagggttctttgtaaaagttcacagagcagtctgctaatcatttgctctgtggaagacgggaggtaaacctcagtgagttcatagagttgtttttttaaaacttagaactctttgaatagatccttaagtgactaatatagccagaataaaaccatcattttatcctttaatcatagctgctaatcctatttccttgttaatgtgctttatgaaattatttgacaataatatcagattacatgtttttgctactaataaagttctattctcttttgagaactgcaaacaaaatgttgtatagtcatatattcatgtaagttaagctttttatgtgtattaagacatttttatggcatctctttaggtttgtatgtaattttagttatcaaaaacccctatctaaagtgataaacattaaaagtttgtatcagtacacatacagagaaccataaatgacaaatttgttttcctgtcattaatgacaatgactttgggcaaattctttaaccttgctgagcccgtatttccttacttgtaaaattagaggtttggatatggtctttaacatcccttctaccattttgattattgctttttaacttgaaccatttgctttaaggcagtacatcagatgctttattttagtgtttaaatgtatttagtacacttgttttgcatgattcactgttttaaaaatatttaagatttattagataagagcgtttgaattctaaattttttttctgtgactgttaattaattcagcagcacgtaatacatatcgaagggtctgttaagagacgctaacccactggactgaaatgggcctaagctgtgaatcggatgaaagatcctattttatcctaaagtctatactaagcaatagctgtttttagacatctgtattcttagacaattatagaaatttaaagctggaaggtagagaacatgaaggtagagaaaataaaggttcttacccttcattttacaaatgaagaatctaacagagacagcaagtgtcacacagttgatggcctgttcggcactagtccactattatcaaagttctttctagaatgctatatgagattaacttattactatgaatgttgcaaatgtactacatttaatacacagagattatactacttatctgtttatatattgagaggtggtaagattttcactgtgccgtctacacactcttaactgttccttcttaagaactttgtgaagtggttaggattagtgatgaaactatggttatgacctaggtggagattgaacctggatgtttagttacttgtgccatggtctacctcagctattttcagttctgactgtctgtcaccatcacctgtgaactaaaaaaattatgatgcccagactgtaccccagacctactaagtcagaatttctggtttcaaaagttccatagggggtgatgttgggcagctaggatagtgaatttctgcttttgtcacaaatagattagccacataccctacctaaatgatggcaacctgctgtgctatcatttaaaaggtatcagtagaaaggttggtatagttacagtgagattttagtttgtttgcatatatatttgatgtattaattctatttgattagataatatgaacacttggtacaaaattcaagaggtacaaaacagtatatacattgaaaagtattccttcctttcattatcttctagccattccctcccaagaagcaagcattaccaatttgttatatcctttttgttgtgtgttcttccagaaattaagcatttacaaacataaatttatgtgcactaatatattccttccaccaacatacaaattatagcaaaatatatacatttttctgtatcttgcttttttacacttaacaacatagcttgaagattttttcacattcacataaagagagatctgccttattttttaaacaactgcataatatttcatcatttggctgtaccacagtttatttagccagtcccctattagttgacacttaggttgtaaacagtcattgctattacagacattactacaatgaataaccttgtaagcatgtcatttttaatatgagtgtctttttgtaggatacatttctagatagatgttaaattgatgaattgaaggatatgtgcatttttattttggaaagacaatgctaaactatagcaatttaagctctcaccagcaatgtatgactgcctatttctttatacccacgtagggtgtattttaaaacttcttaatctttactggtctatgaaataaaaaggaacatttaatttgtagttttaatttgcacttttaaatgagagtgaggattgctctgtcaccagggcacgatcttggctcactgcaacctccgcctcccgggttcaagcgattctcctgcctcagcctcccgagtagctgggattacaggcatgtgccaccacgcccagctaatttttgtatttttggtagagacggggtttcaccatgttggccaggatggtctcgatctcctgatctcgtgatctgcctgcttcagcctcccaaagtgctgggattacagccgtgaaccactgcgcctggccctaatttttaaattttaaatttttctaaggcttgaaattaagttataggatctcttcatatttttaagagccattttttttgatgtgctatgtgaactggtctatttcttttgtccttttttttctggtgagttacagtcttcttgatttgtgagaaaatgctttatgctgtaaggaagttagctattattttaaaacctgtgcaaagatttaaaaaatctgtatactttggctgatgcctgaatttattcttaagttgattgtgagatccagtgagggcagtcagttgtaagtttcatctacttatataacgtctgatggttgagaaattgagaaagaactgcttgaggaaaggtaagtgaagacttataaacaaaagttaaaagacaatagattgggagaaaatatttgcagtgtatccttcagacaaaggaaatgtgtataacactgaattctttgccaggcactgttttaaagcactttatgcgtattaactaatttaatccttacagtaactctaaaaataccattattatccccattttacacattatgaggaaacagatacacaatagctaagctaagtaaattgaccaaggttagatggctggtgaatggtggagctatcaatcagactgggcagattggctctagagtccatcctgttaactcttaacctactgtgctattatgcctctctatttattatgtccagattatataaataattcatacagacttaaaaacaagaggccattagaaaaataaaggatacgaataggcatctcacaggaaaggaaatacaaatgtccagtaaacatgaaaatattggtaaagtaaaaattaatcagggaaataaaattttaaaacatcaatttacaaaaaaaggaaagtttatctcagtctttggtgagggtttagggaaataagtattttcctcattgttgttgtgagtttaaattgataaagcaatgttggagagcattttggctatatctgttaagaatttaaatgtctatacaccatgcatttttacttctacctatttgccctgcatcaacagttgtacatttagagaagaggcatatacaaagatattcaatgttgccttgttggtaaaacagaataattggagacgacttaaatgtacatcggtaggaaaatggataatatgttcatacacgtattctatagcaactaaaaagaatgaggtatatctatgttatgaaaggaaagaactccaggatgtcttgttgggtaaaaacagcaagttgtagaataatatgtgtagtatcctgtgtattgttttaaatctcaaaacattttacttttctgcatgtagatggataaatacataaaaagaggtctgaacagttgtacagataacagtgattgcctcaatggtggataaagggagttagccggtgctgggaaaactggctaggcatgtgtagaaagctgaaactggaacccttccttacaccttgtacaaaaattaattcaagatggattaaagacttaaatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctcattaaactaaagagcttctgcacagcaaaaaaaactaccatcagagtgaacaggcaacctacagaatgggagaaaaattttgcaatctactcatctgacaaagggttaatatccagaatctacaaagaactcaaacaaatttacaagaaaaaaacaaccccatgaaaaagtgggtgaaggatatgaacagacacttctcaaaagaagacatttatgcagccaacagacatatgaaataatggttatcatcactggccatcagagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatagggagtatatttatatattatattatcaaaagtaactatttatataaatgaacttgatacagtattaatcttaagctgtgccagtctctgttgctctactttggaagactatcctatctgcaaaacaagagtaatcaaatgttaggttttgtaacattttgagtgctatagaagaaataaagtcaacttttctgttaagtttttttggtaacttttgatataatttcaaacttacaaattgtaagaataggctgaggagggtggatggcttgagctcaggagtttgagaccagcctgggccacatggcaaaactccgtttctacaaacgaaaaaaaaaaaaaaatgccaggcatagtggtgtgtgtcttcagccctagctattaatacttggaatgctgaggccagagaatcacttgagcccaggaggttgaggctgcggtgagctgaggtcgcaccactgcactccagcctgggtgacaaagtgagaccctgtctcaaaaaaaaaaaaaaagtagaaataatacagcaaattcttatatactttgcctgtttgactaattgtttatgttagaaaaactttttaaaattttaatacattgtttcagagaaatgtggtaaaaagggtctgaaaattttggatcctttaaaatatgacatttgtgtgagtggtacagaattttagttttgaattttacagttttatataaaatattcttggtagatggggtgaactaatgtttattgagtatttcctggtttccagatgttgtgttaggatactttgcaaaatatttcatgtaatccaatttcatgaagaagattgttattcctattttagagaagaagcaacagacagaggttatttgctcaggattgtaagggagcagagccaagttttcagaaagtctttatgttaccaaagcccacatccctttctctacaaagctgcctgtgagatgatatattggaaggaattgatgaatacatttatgttgtcaagaagttgataattactcctaaattggctatggtctaatgtagtggatattcaataaaattatgatgtttgaatgccataagaatttatcttctggcctgttttgggggttcatgaatgtaattattttagctgcctaactgcttatgtgggtttgtatgtacttttgagtggttcttggatatgtgtacacacatacatacacacacacagatatacacatacacacctttatatgctcatgggtgtaacttctttatgtgtctaggtgtcttttttttgtggagggggggcgaagatcaatatgaatcctattttggccccctggatgctgtcaccagaaataacagccatatcccatatatagcctgtccatgtagccctgagttctgccagcacctggctttttgccttccttttgtttgtcataccaggctctcttggtcaccttggtagccttgctaagcttcttgtagctataggtaccattggcttagcccagaagagattcctgccatatgtacttcagagtttggtttgccacttgaggaaggggtctgtagggagcttgtagatcagcacacattcaaaactgaaaccggaagtgggcaaggcaaaccacaggaagatcctgcccgcaacttggtgacgtatctatataacccatagacacttcctggcaataccttgtgaaacttgccttttcgtgtatagtagtttcctaacttcttgttctagattaagcttcagtgaaaagtgattaatatgatagcagtgtagataactgtatgatagttattgtgcacatgacttccatgcagcaactagccccgattatgttctgtagactttatcactgaggagttgcagtggtatttatgcgtttactttgactttgtcttgtcactagccattgtcttacttatgtgtaattgtacttatatatagttcaggttttatacccacaaaaacccttgtgatataataccactatacaggattgccttatttatgtggaattgtacttatatatagttcaggttttatagccacacacacacacacgaaaaaacagttctttgcttcactgagtctcggctagccacccaaactgtgtcatattcctagagtcctgtgcccactcaagtgtttgctcactggtactacctcattttatcatagtgccttgttcttaggcagaaccagatttctggtaggagttatttaatgtgttgattttttttttgagacggagtctccctctgtcaccaggctggagtgcagtggtgcgatctcagctcactgcaacctccacctcccaggttcgacaattctcctgcctcagcctcccgattagctgggactgcaggtgcacgccaccacatccagctaatttttgtgtttttagtagaggcggcatttcgccatgttagccaggatggtctcgatctcctgacccgcccacctcggcctcccaaagtgctgggattacaggcatgagccaccgtgcctggccaatgtgttgtttttttaaagattaccaatcgagtgggattatagactcttggattattttacagatacaagtcatttgccaggagtgaggaaaattgcttgacaactgagttatctcaccatgttaatttatgcattggaaaactctgcttagtggtagatattccagcagtcaccatatgcctattggtactatttctcattctctgtctgattaatgtcacaaatgtgtaactttccagtggtgttttcaagatgacagttaaggagccactaaggaaggaaataacagctacataacttttttcttttcagtagttcttgacagtcccccctcctttttttgtttttgtttcttcataccctgcagcaatctgatgtactctgaagggggtaaatttgagactctttggaaggtcatgtgtgataaagacagttcttctcttcctttctccattcagaactgttaaagataaatcaatgggagtgtttttttcttgtgtaagatttattatatacaaaatattttttaagtgtgtgaaaactgattaaatgataaaggctaaggtagcatgtttaaagcatggttttctgctacttttctactaatcacttaacctctctgagcctcagcttccttgtctacaaattaggaatagtagttttactaatcatatagcatagttgtgaaaaggttaaatgactcggtatactgcctggcattttgtgctcagttaagtgttggttctaacatgagcagtagtgatactcataaagtatcttttcatagttttcttaatggataacttatttgatagaaatgtactggagtattcatacttacatgtatatccagttcttgtagtgttcatcaggttaaactggcaataagtgttaatatctgaaagcattagaaatcagtgttactctgtgctttttaaatttcaagtgttgtctctcagattttatttttttattttttattttttttgtctctcagattttagagctatagagaacctagaagattaactggctaaggagttgcaaactcaaatatacacagaccaggtataatgcagtaaagcccagcagagattattatgatttagtaagatacacctgtctgcagtttccactcaaaatcattttgccagattttgattattaaagagaaaccagaaatacaaatttatttattgttagctctcagtttctagatggtcacaaattattttttaaatttggtgcaggccaaacaaatctctggctagccaacctcagatttgtatcctcattttagagatgtggagcttgaggtataaaggttggacgtgtttccatgtatttcctataatagaaatccattgattctgtaacaaaggactcattttaaacaatgacctcctctgttatacccagttgttatattacaggttatttttggtcaggagctaatggcttggatgaagggaattgtatatagatgctaatttttaagaatgtctagccaagaaagggcactaatagttactatccattgaatatttactctgtcttaggcattgtgccaagcgctttaccttagttaatgctcacaacaatcttgaagcattatagttacctctttttacataagaggttgagagtaaggacatacagatagttaaatgcaaagttcatgttgaaacgcagatgtctgcctctgtaatgcattcatttaacttgctatactatactagtactgtatatgtttttataattatgcataccttttatcatattgcaaaaattgaaattaaactttagaagaaaatttcaaagaccttatgatatattaccattatatagggttgtcttatttatatggaattagattggcacaacagcattttaattttactctaaactagtcaataccagagactatatcatatttttaaatgtgcattagattcattctttctcactcttttttttttgttgttgttgtgaatgtaaatgacaaaatgtgcatattttatatcttttcatctcctgaagttctactgttctgtttaggttgatatttctattactggttgagcattccaaatttcaaagtccaaaattccaaatgctccaggatgcaaaactgagcaccaacatgattctcaaaggaaatactcattggagcatttcagattttcagatttgggatgcacaactggtaagtatatataatgcaacatttcaaaatgtaaaaacatttgaaatctgaaatacttctggtcctaagcatttcagataagggatattcgatctgtattagaacattatgtcctgagtcattcaagccagttaatgccaaattctgtggattctgtctccatagtagctcttctattttttctttcctcctatctccctttgttaccttaatgtaggctcttcagactatcagagtacttttcctgaagtatgaaccacacagaaacttttagcgacccttgttgcctactgaataaagttaaaccttagcttggcattttaggttctctgtttgatactagctgtcctttataatcttttccctctcattcccccttcatctctctttatgctttagtcagtttatactattcactgcctcctcgatggtgctcttcttgttgccaccctccagaacttgttcatgttatgccttcctcctggaacgttatcctccgatccccaatttctgtattttgaaaatatatatcattcagaagagttattgtgaagattaagtaaaataatatatatgaagtcaatgaaaaatctgtgtaatacatgtattaatttattcagtaagtggtagctattattatgatttggctttctgtcaccccaaataatccttaactttggatcatcttgtccaggaccctggctctttgcagtttttctaggggattaatcccactgggacccatgttggcgcctacccttgtacttcaggtaacctttgaagcagacctggacctactacatctctttcagatgggaatagtttctcagcacagctgtattcagaaagaccttaagagttgaatagaaagactctaggctttggagtttgatttatgccagataaccttaccagctatgtaactgaatttttttttcttaatttatgaaagggaatagtaatgcttatctcacagggttgtcgtaccgatcaaatgaaacatttgagaaaatatttaacactgtcttggagcatctaactacttaataaatctttatcttcttttctgtcttatccctgtagtgtcctcccctaggacatgaagaaacatacatgcaaaccttcaggtataaatgcatgcacataatcctcaaacatccacataggcacataggtacatactcacatatgtacatactcacatacatgaacagaagcatatacatcagaatctctacctttgatagtagcctgatattggaatttttgtcctagataaaatttatatggtaggatttgaatttactgtctgatgactgttacatggaatcattgatcttgtacatagagagttggctgtttttccatttctgttaatcttaacagttttgatttgatggtgtttatctttcgcgctttaaactatttactttttaacaatatctaaaagctgctgttttctatagttacatgtctctcctcttttttcaggtatttatgcagaagttactttctcaatgaagccttccttgagctacctcatttcttgtggtgcccatacttattagtattaggccatacatttttacttatttatcttatttgttgtcgatctctccatgtgtgttagcctaataaggacacagactttttgtctgttttgctcactgtcatatcctagcagcttagtaggtactcagtaaatatttgaatgtgtgaacttcagcactggtttattttcaaaacgtctctgtattaatacaataaagattctttaagtgcttttggtaactgtatacaggagactttttaaaaaatctttggagtagttgacataaatcaacttaaatgaaatggaaaaaagaagtttacatacaattttatggtttgtgatgtggtattggaacctcttttttgcccatgccaaagttatatacacacgcattgatacttattcagcagctgtttcattatatattttatgctaaggatggtgctaagaattggtccccttcctcaagaagtttatagttcagtgaagagacaaccaaactgcttttgcttggttgtgtctcatctttaccacctcaaaacattagagagccctgaggctcagtcttcaaatttcttttctatatttgctcccattgtgattttgtattgtctcttggttttgtaaattttatgtacttactgatgattctcaaattttttctctatctaggaccctttgtccttggacagattgtctgcacttggatgtataaggcatctcagatttaatattcaatacagtctcttgaatttggtccccaacaagaggctgtgtctctagaaatagcatctctattcatccagctgctcagactaagactcttagaagtcattcttgactactctatttctcacaccctgcagtaaatcctgttggctccatcttcaaaatacatgcccaaatgacccattctctccagacccgtgtctgctctgcccctcccctgacctgcaagttttcgctcattgagattactacagtagcctcctatctagtcacctgcttctacctttcccctctgcactgattttaaaacaaaaaatcttgccatttttatgctgaaaatccttcaaaaccttaccatctgacacacaaaaaaagcctaagactttcccgtgcctgtaagaccttatttaacctgtctcctcccatacccttactccatctcttactatctcctccctctccccactttgcttattgctttgtagccatactgccctccttgccactcctccagtgtgccaaactatcctgtctcagggcctttgcacattttattctttctgcctgtccgtctccttccccagatatctgtatggcttataccctcaatgacttccttcaggtatctgcttaaatattttaattgaaaggccttccctgcttccctatataaaataacattgacctcctccctgtctctaccctctgggcctgccattccctaactctcttaacctgctttgttttcttgaatagcaataaatatttatttcttccatgacaataaatactatatgcttatttaagagtttgtggtatttgtcgtccctgtatatattgtacaacagtttcgtatgggcagagacctgtttttattcactgttatatccccagcacttagaacagtgcctcgtgtgtttaggcacttagtaaatatttgttgagtgaaatgcaacaagtacaaaacaatatgatcactgtagtagagatgcaaggtacagtagaaacacatgggaaagagtgacatgactacataggaattgaggaagactttgcaaagatgcccttaagcagagctctttggagagaaaaacaggtagggcatttcatacaaagaaaatagcattgcagatacacagaggaatgagagaacagtgtgttcaaggaactaaaatatagtactgctacagcataatttgtgggggtaaagatgaactagatgaggttgaacatgtagtagatagcacctgatcatggagggatggagggtttttgtgccagactaaggaattttagattttgtcctgtcaagtgggcagtggtagatagtgtgagccattgaagacttctaagcaagggatgttttatttatatttatttatacgtgtctctgtgtttgtgtgtgtgtgtgtgtgtacgtattaaaaaggtaactagcaacattgtgaaggttgagtatcaaagctaaacacagcattttatttaagatatgtatgatttaggaagatatgatgtagaaaaacaattactatcacatgtgggcgagaggatatttcattttatatttggacaaaatcatggatgtatagtgggaagatgttcttggcatacttgcagtacatttgtgaaagagaagaaatgcacaatggaggattattctgtttgtctttgaaaatccaccctttaagaaagaagactttaaaaaattagttaacagttatgttgtaagtcgtaatgtacactagaaaagtgcttaaggagtaccagttatgaatcaacaagaaaagatgttacagaataaaataaattgtgcttgaatgtcaacctcctttcttcgtagaggaacagttggttgtcattgatatacctcctgatcttgatttattgttgaaggaaatagtgacagttgtacacacaatcaaatctatactgtttgctgtgggaacaatgtatctgcctttgtaggacaaatgtctgcttttgcatattgcaggactccgcatgcacagaatttttgaaatgagggatgaactataaaaacatttcttcctttcattcaaatgcaagtaaaaaccatttttattatttcagctggcttgcttgtgtcatatcttagcaatatattgaatttcttgaatactttattcttattaatttagggtcaaactatgatttgtgaatttaaggataaaatagaggcacccaaaatggtgcacacgatttgaatgttaagaatttggatttggcactcccagccaggcatggtagctcacgcctataatcccagcactttgggaggccaaggcaggcagatctcttgaacccaggagttcaagaccagcctgggcaacatggcaaaaccctgcctctccataaaatacaaagcaaattagtcaggcatggtggtatgtgtctgtagtcccagctactcgggaggctgaggtgacagaatcacgtgagtccaggaaggcgaggctgcagtgagccatgattgtgccactgcactccagcgtgggcgacagagcgagaccctgtctcaaaaaaaaaaaaaaaaagaaaaagaaaaaagaatttggcattccaaattcatgaaaatatgaatactgtattattgaatatatttttaaaattttatccaaatgctacagaagatgaagaaatattttgtgaaggtagatacaactatatatggagttaagatccatttcccaagttaaaggattccctttttaagtgtgctgctattcaactcactatctgatggaacaatgaaaataattttcagtgaaaaattgcttggtaatttctgtgtccatgtttgatccagatagccacgtgtagccggtggatttacccaaccatgatgaccagtaactcaaagtgggattttctaatttgttggaaacaaaggttagaaaagaattgagattaggtgacagcatcaactctagttagtttaagcagaaagagctttaataaaaaaattttaagtggcttacaaaattgttgacaaggctgaagaaacagactctagatctagaaaaagccatgttgcatctaggccaccaagagagttattgcctcttttaggatcagaaagacttttgcagaattgtgaaactgtaacttttagatgcctgtcttagaaccttaccacctctgccatgatcaggagtctactactgttaggaaatagccattagcaagcagccaccttcctcagtaagccgttgttgttgctggccctagagccaagccctgcctaccacaacctgtactgcagaatggatgccttgtgcctttcttaatattcatgaaatctgtgactgaatactaggacttcaacaaatactgctgtgaacatgaacatctccatgacaatgtttgctagtaaaacaacccaaactcaacctcccttctcttctgtccttgaaatttctagtgagtgcatctggttggtggaacttaaatcacatttacaactgtagccacaagagaggctgggaaatgtattttttaactttctcttctctgcagcacaggaagacatacactgaaggaggttgaaatggatgtgaacagtaatctaccatatttactgcaggtttagaacctggttctccttaaggctggctgtcattaaacgggctatagataagttgagaaagtttataaataataccgtcaaacaatgttgagaaactcatttgtttctttgtatatttttattgttttataatgactacattaaaaaaaaaactagaatttgtccttcacctctatgatgaattaagtggtctgtggataccgaaagtttcctcacgtttaagatgtggttagtggataaaaagaccaaaagagggagtataagaaaaaccctcatacaaggttacctgagctgaggaaaggttagtgttgtcaaataatgaagagtggtcaaataaggtgggactgaaaagcagtgttacgatttgggcacttaatattagtggttttttgggttttttttttctttctttactattgagacagggtcttgctcttttgtcccaggctggagtgcagtggcagctcactgcaactcccatcccctgggctcaagccatcctcacacctcagcctcccaagtagctgggaccacaggcatgcaccaccacgcctggctaattttttgtatttttagtagagatgagatctcaccatgttgccaaggctggtttcaaaatcctgttctcaagcagtttgcccaccttggcctcccaaagtgttgggattacaggcatgaccactgcgcccagcctgttagtgttcttcaaggttctaaacaagaagtagagaagtaggataagagggcaagttgcaggtttaggctgtgagttgaagggagcacttgaaaggagagattatagaataagttttcaagaaatttggcaatggattttttttttttttggtccaaggcgcatgctcatttatataccagaattggctagagttcatgaggccctgaacaaatatcacacacaagcaagtacagtcttccaaagttcttcacttttgtctttttgtgtagcttgatgtaaagtgtggctcttaacatattctctttatgcttagagatataataggcacaatattacttttattatatctgtaaccattacttcctttttgattatgttgtttataaagtgccaattaatcactactatagtttggagttacagtatctgacttaacatatttgtacaattgattgttgagccgggcattgattagatgaattaactttcaacaaagtttatttgaacttcagtcattggtggatatttaagaagtacagattatgataactgcttttataggaaaggatgcttggtacattttttcatatgacatagatcttacatttttatttattctggataaatatctgataatgtcaggttcattggattcttcaaaataacctcattgtctctctcttaagagggagagggaagtagaatatgtgtaaatttatataatgttgttttctcaaaactgcacctatgtgaatgaaacagaaacatgttcagggacagttagtgtttcaaattctcccaattagatatggagcatatttattatggagcatatttattaagtagaaaattattatggtctaattccaaattttttatattttaggtcctatattgcgacctagttggactttcgtttaaaaaaaagtctaaattatgcagaagggagacgtcaaagaaaaaggagagactgaagaacaagaaggctgaaagtaatgaaaatagaattgctagacagtgtcctggagggacaagagggaatggggtagagagagcacaggtaaatggatgagctttggatgagaagaggaataactagtctttggaggaagaggaaaatggatgaataccggttcagatatagattatttgtcttagtgacctggtttatttgtaaggactaacccattttaggcagttaattaaattaatcatttaaaaggtgagattcctcaattctgacttgagatggacctaaatttgtttattctgtttaagtagtaactttatttttttagtgacagatttaagaagtatcttactggtactattccattggttttcttattttaattttataaataatgtgtttactgagtttttttataggtgcttcttaggtttctaatagacttctctaaaatatattggtttaaatggcctttaaagttgataagcagaaagatacttgagtttatctagtccaaaccttcatcaggaaagctgtgattgagtgatttgtctgaagtcatacagccacttagtagcagagtaagagaggaatattggttttatggttcttggggtaatgctgtttcccttatgccaactgattgcataagggaactagtgtactgatttcagcgcccatacttgtgtatgtcctttgagctagagtatcaaaggacttcaaaacttcaaaactagactttttaggttatttaatattccttcaacaaatgtttctcagctgtctaccgtatgacagtcactgtttaagatcttgaagatcaacaagttcttgggcctcaagaatgagggaaccaaaaaataaacactgaattaaaaatgaacagaaatttagataatcatcagtgctatcaaagaaacaaaatggagaaatagaatatggtagcagaactatgtgctttagatagaatagtcaaggaagatttctctgagttagtgatatttgagctgagactgaatgataaggcactcgccattgaagatatctaggagtgtagcattccagacaaaagccctaaacttgaacatggtgtggcacagttgatgaatgaaaaaaactaaacactgaccggggttgggggaatggaaggagaagagatcagagagaccattaagtagggctttgtagactgtggtatagaaagataattttattctaagtgaaatggtgtggtattggaggaggagagtgagtgagtaacctaaagaatatgtttcaaatatcacactgcttgatggagaatggattgtaggagggccaaaagtggaagcaggggcaccagttaggcaactctcatgtttgttcgaataaaagattgtggtggcttggactcggtgattctggtcaaggcaaagagaactggttggatttgggatttattttggaggtctgctggatttgctaagagactgggtatgggagtttggggaaatagaggatggtgagagtaagagagaaaaatggtagactggggaaagggcacatcttggggaaagaaatcagatggtttttctgggacttgttaaatttgaaatgcctactggatatccaaggagacagttaaatagtcacatctagtgtttgttgaggagaggttagacctggtgttgcagatctgggaggcgttcgcattaacaccatatactgcagagttggcaaagagaaggaagagaaggtggtttggaattgaggcattgcatgtttagaggtagccagggggagaagtcagcagagagccagtgacgtaggagaaaagtcagaaatactgtgttgtggaagccaagagaagagagcattttaaagagggatatttatgttcacttgggttaaatcatgctgccaggccgggtatgatgaaaacagagaagtgaccgttgatttggcaatgtggaaggcattagtgtcctcagctagagcagttttagtggcatggtggggtcagaagctgattggagagggttgaagaatgaatggaaggtaagaagagacaacgactagagatgatgcttttaagaagttttttttccttttctttttgtgtgtttttttaagttgagaaattcccatcatcgtttatatgctgatgggaatgatcgctagagaggaaaattaatggtgatttgggaaagaaagattaattgtggagtaaagtccttgaggtagcactggtggaatgggatagagagcacaagtagagggattaccctttcataggagtggggatgcaattacgtaatataaaaaagggacctcaagccactttacacacagcccctcccttcagtcttaacaatctcctttagaccagcttgatctttctgtaatcactagtgtttttttttttttctgtgccacattaatatgttctttcagattgaagtcatcctatataaggcttagtatgaagcagttgatgatatttaataacaattttaaattttatgccaacaggtgaagcaaaaaatttattgccatatcttggaccccacaaaatgagagattgtttctgtaccataaatttggaccaggaagaagtttatcgtacccaagttgtggaaaaatctttaaggttggtagaaaaaattggtaaattataatttttactatatagattggtaaatattatgcattttccagattataataatcaagaagacaagacagaaacagtgcttgctttcatgtggcttttcattgcctcaaaatgtatcttcctcttaattgttcctaattttatctttgttttctggagaaaagttttttcacatgacaggctaaatattgcctattcgtttgaactttcctcaaagtacatctttattttatttatctaaagaataagttacttaaagttcatagaagttgcttaacttagtagtgcattatcagggaatgaattctcagatagatgtctcatctttgaaagtgtaattgccctttgagagtatcatattaaattctaattcataaaactggaatataccacctctgcaccgtagcaatgtgaacataattctagtgcagagttgtgctgagaatcttgttcagagacaaaagtcaaaataaggaggccgggcgtggtggctcacgcttgtaatcccagcactttgggaggcagacgcgggcagatcacttgaggtcagaatttcgagaccagcttgggcaacatggtgaaaccccgtctctacgaaaaatacaaaaattagttgggcgtggtgctgggtgtctgtaatctcagctacttgggaggctgaggcaggagaatcgcttgaacccaggggtcggaggttgcagtgagccaagattatgccattggactctagcctgggcaacaagagtgaaactccatctcagaaaaaaaaaaaacaacaaaaaaacaaaaaacagggtgtggggtattattggaatgagcatgtggtggatgaaatattgaatgccatgccttatctgaatcatattttaggtcagttgtattttagggatctgttttttttttttatgcctttaaaaaaatatctttcttttacatttgcctttgaagtttccctttatgtctttattttcattttttataattttaaatatctattgaattcttcttagaaaaggtattgtataaaactgaaaatacttgagtagcccaaaaacatttcaaggagtaaacttgaaatctttagtcttaattctcatattgttcttatttggctttagaatgtactttaaacataatatttgaatgtggatgtgatatataaaggaaattctgcatttataattgtttagaaaataatgcaaagagatacatacctacacatgtcttgtctttcatatcatgttttcatatcatatttgactaatagttctttttgcattgatttctatgttgaaattaattagaaggctctagttactttgtgagaccaacttttaaaagtttagtttggttacatttgaagggaaaaatatagtgacaaaagttcaccaggcattttaacaactaaaaagctgaaccaactgttttctagacaagatcagatatgacttctgtaggagtattttactttatatttcagcttctcatttagttatgacatcataaagatactgcatttcatagcgatatttctagagaatctttttgttctttaaactttctcaggaaagaggtacacttgacaaaagaaactatcatttcagagattcgcgtcttcatagaagaatcatagaaggataaatatatcaaaatggcattcttaaaatgaacttataaaaataagctttgcaacatgaggatgggcaaagatttcttgctttgaatgcaagaagcaccactaattataaaagatgaaaattggtaaattagattttatcaaacttagaggctccttttctttaaaagacactgtcaagaaaattaaatggcaagccacacctgggagaaagtattctgacaaaagacttgtatccagaatttatttaaaaacaaaaaccctgataactcaaaagaagaccgatggccatttaaaatatggggagaatacttaaacagatacttcagaaaagatatggccaagagcacatgaaaaggtattggacattgttagtcatcaggaaatcaatttaaaaccatttttgtcactatagattctagaacataatctgcagtgatagaaatcatatcactggttgcctgtaagaatatggtgggagtgattgcagagtcacaagggaactttctggggagataaaaatgttttgtatcttgattataaggtagagattacataggtgtatacatttatcatgttacattcactagaatagctaaagttaaaggctgtcagtaccaagatgtggaacaactggagcattgctgttaggggtgtaaaacagtacaaccactttgaaaacagtttgacagtttcttgtaaattacacattcacctgccttttaactcagcagttgcattctcagtaatcaaaagcatgtgtctagaaaaagctttatataagaatgttcatagcagctttacttttgatagcccaaactggaaacaactcaaataacatcactaggcgaatggatttggaatgcaatggaatactatgcagcaattaaaacagttgaactactatgtacacaacaacatcgaaaaaatctcatagacattaagctgaatgaacaaagctggacatgagtacatactatatgattctatttatgtgagattttaggatagatgtatagtgatagaaaacacatcacaggttggggcaggtatgatggggtaactgaaggagaggcataagagaactttctggggagatagcagtgtcctttattttgattggggtggaagctacacagttgtataaatttatcagaagtcatcaacctctatactttaaattggatttttattgtttgtaacttatagctcaataaaactgatttaaaaataccttgttttaattttttaaaaatattttttaaagttgattttaaaattgcatattttaattttttaaaaatagcttaatttaaaaaaaaattttgaagtagcctttcacataacattggctgttttaggtattatgtattgtaaataatacagctttacacatttctaagacaaggatggtatgaatgacactatcctcacctctcaaatggtccaccttaggtgagcatgaccccaggcagttactgtatcttctatccacaggactgctgaaaagctatttgttcagaactcatactggcaacttagatcccttcagtgttcagcttggtttgtatagaacttagttgaaatttagcattgagaattattttggggcttttcaaattcttttcaatggcattttagtccataatttcattaactttattgaaagtgatattatttggccaggaacattagctcactcctgtaatcccagtactttgggaggctgaggcgggtggatcgcaaggtcaagagattgagaccatcctggccaacatggtgaaaccccatctctactaaaaatacaaaaattagctgggcgtggtggcatgtgcctgtagtcccagctactcgggaggctgaggcaggagaatcgcttgaacctgggagctggaggttgtggtgagctgagatcacgccactggactccagcctggcaacagagcaagactctgtctcaaaaaaaaaaaaaaaaaagtgatattatcattctcagcaaactatcgcaaagacaaaaaaaccaaacaccacatgttctcactcataggtgggaactgaacaatgagaacacttggacacaggaaggggagcatcacacactggggcctgttgtggggtggggggaggggggagggatagcattaggagatatacctaatgtaaatgatgagttaatgggcgcagcacaccaacatggcacatgtatacatatgtaacaaagctgcacgttgtgcacatgtaccctagaacttaaagtataataaaatatatatatattaaaaaaagaaagtgatattatttgagtatttatacaattattattgaaagtgatattaattattatttattttatattatttgaagtaatgagctttccttttctttctagcccatttttcagtgaagaattttactttgagattccaagaactttccagtatttgtctttctatgtttatgataagaatgttttacaaagagatctccgtataggtatgtactattcataattatctttaatcacaatgttaatgtttatattcattcgttctcttagtatagttttgaaaattgcagaataatatatgctcaacatctctgatctttttctgtagactacatgttcatttgtgaaatttcatttttaatttgtatgttcagcttatatgacactttctcagggaggcctttgcagctcccctagtcactatgtcatatgtttttataattcctgatggttccctttccatggtactcattatgcttattcattagttggctgtttcatatctaggttctctagttaaatgtgaaatttaaaagggcagggactctttttttgtttttttttttgacacagaatcttgctctatctcccaggctggactgcagtggtgcgatcttggctcactgcaacctctacttcccaggttaagcgatttctcctgtctcagcctcctgagtagctgggattacaggcgtgtgccaccacgcctagccaatttttgtatttttagtagaaacagggtttcaccatgttggccaggctgatcttaaactcctgcaggaaatccacctgcctcggcctcccagagtgttaggattacaggcatgagccaccacgcctggccgggcagggactctttcttacggagcaccttacacttagtaagtgttgggtaagtatttgtttagtggttcaaataatgtttttatagaaagattgcagttttgatccttccaaagaacatctgttgttgaggtttttctaatagaagtaataattcactttaatctatttatacattttcttcctgtctgtattagtgactgtattagtccattctcacactgccataaagacatacctgagactgggtaatttataaagaatataggtttattggctcacagtttttcaggctgtacaggcttctgcttctggaaggcctcaggaaacctacatgagtgaaaggcaaaggggaagcaagcacatcttcacatggctggcaggagagaggagagttgggatgtgctacacacttttacaataaccagatctcatgagaactcactgtcatgagagcagcaaggggatgtctgcccccatgattcagtcaccttatgccaggcccctcctccaacagtgggattacagtttgccatgacattttcgtggggacacagagtcaaaccatatcggtgaccaataaatatatttctctttttttttgagacggagtgtcactctgtcgcccaggctggagttcagtggcgcgatctcagctcactgcaagctccgcctcctgggttcacgccattctcctgccacagcctcccgaatagctgggactacaggctcccaccaccacgcccgactaattttttttgtatttttagtagagacagggtttcaccatgttagccaggatggtctcgatctcctgacctcgtgatctgcccacctcggcctcccaaagtgctgggattacaggcgtcagccactgctcccggccaataaatatatttcttaaataattgtcagactagagtgtgatctgtgggcatgaactagaacagagctaactggccacatatgtgtcacattcctgatctttgcaccactatctttgtattttaatcataggcagaggtctaatttacatttattctctttctttttagtatcctaaatttcatctccctttccttttttatttgaaatatggtcaagtctcctacagcttaaaaaattaagcattatttggccaggtgcagtggctcatgcctgtaatcctagcactttgggaggccgaggtgggcagnnnnnnnnnnnnnnnnnnnnaaaaaaaaaaaaaaaaaaaaaaaaaaaaaataaattaagcgttgtctttgtcctcttaactaacttctgatgtttctctgtgtttgatattgaactccttaacaaatggtctgtgtcagtcctctgcttgctacttatttcttttaaaatctctataatctggcttctatgtttttttgataaacctttcttgaaatttgccaacatcattttaatcaaataacctttaaaacaatatgtttttcttaattataaaactgttatatgttcttagtatttggtagtgattctctacagaaataactacagttaataatttggtgtatttcttccattctttatttcatacatttgtattactacattttattcagattttttccttttcaattaataccatagtgatcctttccccatatcattaatatttgttaaaactatttgttacataatatcctttatagaaaagtgttttattttaaccacatccttgttggtgaacatttacatttccaaattttgggcatcctcagtggtgttgctatgaacaaatgtcctttggcataaatttttgcatgtctctttttccccaggataaattcctagaagtgaaaatactgagtcaaggggtatgaacatttttatgatttcctctgtaaatttctgtattgcccctctgccccacagagtatcatactaatatggacgacataaatgttgtactaatttacatttcctcaaagatgtcatgggcataaccattttaccaccccctggccattcttgcatattatcattgaaaaaaatttgccaatatgataggtgaaaaataacacattattattttaatgtgtgttttctgattttgaaggaatttgaggaatttttcatatgtttattggtatttacatttttcttctgtgaattgattgctcattcctttgcctatttttcttttggttggagttctaacatttatccttaagccttcttatttttagatatgttaacttttgtcagctatatacataccaaatactctgtctcacaaaaggcattttcttagtttttattgttatctgcctctgtgtcacatttcactctcttgattgcttattcggtttgctgaaagtgaaagaaaagacattttcatggtggtgtatttttttagatgtgtttctccctctgatgccttcttatatgcagactcttctgtttgtagcaaaccgttgattatagatcacccttgaagctgtatcctcaattcagtttaacatttaccaaacacttctccgtggcacacaaaggttgggacttttaagatgagtaagactcgttgctcatcagagaggcagacttctagtctaatactaatatattaatactaatatattagggtctgtgctggagatatgaacagaatacttagaatagtagggagaacagctcattttatttggtaggggaataacagagactacataggtaggaaaaagaagaacaatttcttttctttttctttttctcttttttttttttttttttttgagatggagtcttgctctgttgcccaggctggagtgcagtgacatgatctccgttcactgcaacctccacctcctgggttcaagcgattctcctgccttagcctccaagtagctgggattacaggcatgcaacaccacacccagctaatttttgtatttttagtagagacagggtttcaccatgtcagccaggctggtctcgaactcctgacctcgtgatctgcctgccttggcctcccaaagtgctgggattacaggtatgagccaccacgccccaccaggaagaacagtttcaaggtgacagggattggcagaagcagagggggaagaatgaatcatgtttgtggtgtacctgctggaggagggtgatagaagctgaggatataaattgggaccaaactgatgaaccctagaaaccattcttaattccaaaagctaaggaacttggactttattctgtagacagtggttttgaaccttttgagaatgtatgtaactatatataactggagtgtgtgtgtgtgtgtgtgttataatatacatgcatttgtactgctagaaacagaagaatctgcatattgtattatatgatatacagttatatatagttacatacacatatatatatatgcacacacatatatacacatacacttatatacacagatatatatacacacacagttatatacacacgcagatattatatattctaatttaaatatgtaatctatatacatcgagtttgtagtactgttgtaggccataagaagttgttgatttggaatagggagcggttagaggcaggaagaccaacaggtatgctgttttcaaatgaaatgagttagggcagttgcagtggaaatacagatgagggaatgtacttcaggggtttcaaatagggcatagggaccaagatgaacaggagatgtgaaaaggagaagagtttaaaatggtcttgtttgtatggctgtcattaaattagataaagaacacagcaagaacattcacttttgagtgagaaggggagaggatgactttggtttcaaacaagttaaacttagtattaccggggtacatcttagtggacatgttggttgacagttggaaatatagatctgaagcttagagaaaagagctagagatgtagatttgagagttattagcattaagtgataggtgaagcctgtgttggaatgaacgaaattacctgggagtggataaggagggtttcagggaagaagagacttgaagatagataaggcatatcaggaagtagaaagaaagatgggagagattaatgtcagagaagataaggaaaccttttaatgtcagcaactagagaaaggtggagtcagataaggattgatagaggctattggtagttattaataacctttgagagaatgtataacttcggccatcataccttaagaaaaatgtttagtaattttcgtctctttacatgttataatcttaaggtaatatttcttgaaaaggcctttaaggccttttaaatagcagcataaagttgaggtttatgatttccagaagttgcctttgttttttgtttattttgaaagtaaaaatcaactttaggtaaaataatttctagtaaaaatcagttgtttagggagtggtgtcagaaagctgtaactgttggtgtgataactttttcttaaatgtttattctttctaagggataaaatttatacatttaacagaaaattctttttccttttgcatatagagttattattaaacacactacataccctttaaggttggaagtggttgatggttttacttatacatttttaacatttttctagttcagtatcattttcttttgtcattaacacacaggttttttttttttttaattttgagctattggaagttgagttttcttaattataatttggagccactcaattgtagattaaacactgacacagcattttctggaaatgaaatttgagctagaatttagagaatcatcttttaaacttaagatcttagattcagtacaagttgagcatagatagattttaggggttttttatttttaattacatgagtaatgtatggattttttttttgtcattcatttatttcacatttattctcattgtaccaggcaaagagaggaaggagtcatgcaccaacacacacagattgtgctgtttttcagtctttctgatagaatcaggatccagattctaactgtcttctaaatctggatcagtcagtagagatggaccactgtggtggagggcccggggctgctgagagaaaggcaggatacatctgtagaactgaccatggcaggttcatgttccagggctcccatctgggtacctgagcattttccatatagatcacaggtgttggggcccacatcggctcctgaaagtctccgggaatgccataggcgtggggctggtgctcgggaggtgcaaggtcagccacatcagcacagggaggacctgagaagacgctgatcttccatctgtatcccagaatcctgtgcagggcctctccataaggacattgcaaggggtggcaccttggcctctggttggcctcatgaatagtgaagtataagtcctgcaagcttatcagcatctggagacattcctgccagctcttctttatacctctgtgcttgagatgcggggcaactgcttttgatactgtgtgatacttcttcaccccgtacacttcacgctcaagaaattcccattcttgcaggaaactctggacttcctggctactccatggtttaattaactggactgagggcttttctggtccctggactgctttttttctgcttcattttcaggatgtttctggtagtttcagtctgaagtatcactttctccatttttattcctgagttttcttctgggatgattctcactgagtctgcagggcctgttcctgggttggcggaacactggcacttactctgctctaatggaacctaggagagtcagaaggagcctgagtgtggaaatgtgtttgcttctctctgcttcttatgtatggatatttttatttttgtaaaaaaattttaaattatggcatagataatcccattttttttttttttgagacgaagacttgccctgttgtccaggctggagtgcgttggcatgatctcggctcactgcaacctccgcctcctggttttaagcaattctgcctcagcctcctgagtagctgggattacaaatacccacccccacacctggctaatttttatatttttagtagagacgaggtttcgccatttggccaggctggtctcaaactcttatccacctgccttagcctcccaaagtgctggaattgcaggcgtgagccaccgtgcccagcctaaattacttttgaccactgcctcctcccagtcctcttcccagaggtaataattgttattaattcggggcataattgtttatattaggcatctttatatgctaggaactgttagtacaaaatgagagaaaaagaaaaactttaagcatatatttttatttccaatgaggattctaataatattgaaattaaaacataaatgttttacctcctattatgtattttttagttattttgttattcaagagctcaaacaagtaaactatgactatttttctagagctcaaacaagtaaactgactatcttagtagactctggcagttctccccgacccctcactccaccttggttcagaaccatatagaaatgaaaggattttactagaatgtcagagacctgaataccagtcatgactatgtcactatctatctatgtgatcttcattgagtcattttcttaggcctggttcatccataaaataagattgggtttaaaattgctaaggtcttttccaacactttgaattgtaatttctgctgacatttagcttttaagcaaaatttactgtgtataaattgcttatggctacactttggtgtctgtttgcacagggactatatcagttatctactgctatgtaagtactccaatacttactggcttaatacagcaaccgtacatttactcatgatcctattgtttgtcagtttgagctgaacctagctgagtggctcggctggtctcgcctggggctgatgtgcagttatctgggagattggggctggctggtctgattcatatgtctgatggttggtgctgactattagctggaccttcctcaccacatggtctcctgattggttctaagaaggcaagccctaatgcaaaggtgtgtcacatttgctgatgtcccattggtaaaagcaagtcacataatccaagagtcagtgctataggagaccacacaatggtgtagataaccaggagttatggaggccattaatataccagtttaccacaaagaccaaaatatgtctatcgaaacctcgtacactaaggcttcgaagtgctgccattgtctctaaattgctgctgttgactgtttgccaggatttgttcagtcctctggtcctgtttcatttttctatagacagtaatatttgtcactgtttttgtttgtttgtttttttgagatggagtcttgctctgtcgcccaggctggagtgcagtggcgtggcatgatttcatcttactgcaacctctgcctcctgggttcaagcaattctcttgtctcagcctcccgagtagctgggactacaggcgcacactgccacgctcggctaattttttgtattttagtagagatggggtttcaccgtgttgcccaggctagtctcaaactcctgagctcaggcaatccacccacctcagcctcccaaagtgctaggattacacgcgtgagccaccatgcccggcctgtcactgtttttatctcctcttttagccatttctgctagtgctcaagtaggaacaggactatcaggattttcctaattggtgaattgtatcaggctgaaatttctaagaatatattgtatctaaaaatgggtcccaagggtaacacagtatttactgatggcaagaaaatgctgctgaaaaatggtattagaaagctaaaaatgctttttttttatttaaagatcaacaaaggtggtttctgtgcccacagttccttcatttccttttgtgtttcctttctttgtctgattttaaggaactaatacagcatctggtgtgtatatgtttggttttaagctctttctgtctgtgagtttgtcaggacagtgaggaaatgaagtactaactttaaatgatttgttgggacgtttgtttcttgttgactttttttttttaagagttgggggtctcactgtgttgcccaggctggacttgaactcctgggctcaagcagtcctcctgtctcagcttcccaggtacctggaactacaggcatgcaccactgcacccagatgtgtttgattttttttgaagttggtaacttcatagctagtgaaataatgaattaattttgtttaaaatagtaatcaacaactggccacagtggctcatgtctataaccccagcactttgggaggccaaggcagttggactgcttaagctcaaaagttcaagaccagcctcggcaacatggtgaaaacccatctctacaaaaactataaaaagtagccaactgggaccaactgtaaaaattacttctggctacttgggaggctgaaatgggaggatcacctgagcccaggagatcgaggctgcagtgagctgtaatcatgccactacactccatcctgggcagcagagcaagactctgtctcaaaaaaaaaattaaaaaaaatacataaataaaagaaaatagtaaacactaaactaaaacaatctttgggactattagaggcacaaaaagggtttttaagatcattaagttaaaagtcattctaatgcagaggaggcacatcagatgtagagtttgagtaattcacccaagattacacagctaataagtaacagaattgacactaggttatggaattagtgtttgtgttggaaggagcacaaacaggcatgccttggtttcaaaatctggctgcagcacctgttagcggcaagtttaaaaatattgttcagctttcctcatctgtaagatggtgattataccctctacctccaagattgttaggaaaattaaacaagaaaatatataagaatgtctcctacctggtagagactcagtaaatgctggcttttctttcagttcagtgctctttccactgtgtcgggctgcctaccttttactgttaatgcctgccagtttagtgattaaacaacaaatcagaatcgtgaggcttttttttttattctatttgtgtttcagaaacttgttccttctttccccatcctctcttctccctctcccgtacttccttctcatttatccttccaccttttttcctccttcattctttgtctgtcttctcctctccctcttccctgttttattcccttgggctgatgatgtatatttctttttatatgttatattgcctaataaagtgctggacatgttgtaggtatcctgctacctattaacttcaaatatttttcttaattttcctgtgccattcttatatatcattttctctaactttgtggaatcatgtactctttcttctctgtttcttcaggccaactggcctcatgcaactagatctttacatatcagaaactgacatcttaaaaaggagcttaagaataagagctggcaataaaattacagattattctcagctcacaaatgacttgtttatgcagctagtcagagaagggtttccctctcataggacaagaaacattcaactcttcagtgacagtgaatgtcatgatactcatgatgcagaataggaggaagaggctgcttgctttagaatatattacctgtgtgactaagagaggattctcttttgggaaggcacctgtgacagatgagatgtatttccagtgatctgagagtagtgagtcataaataggacaggtaaatttctactctagtttttagcagcattgttagttaaatagagtttggttagggaagcctggaaatcaaatcagcatttacaacacaatgccattgtgattgttgaatgagggaatgaatttgtcaaaccaataaactcctaaataaactttgtaggcaaccctcttttagaatttgggacttgttttagtggtgtttgtatgtattatatgtatgtacatatgtacatctatatacatattcataaattgtgtacaaaactaaaaattatggaaattgtaaagtagaaatttcaccagaagtctactgattcgtttctggatggtaagtaaactctcttaaaattttgtgccagatattatctgtcctttttctggggagaggacataaaagatacacagttacaaagattcttaaagggagggtaatggttctcaaaaggtaagagcttcagctataggatgtatagatatatttctgtatgtacatatatattttttgagtatcaaactgttatgcattgccttaacattttatttatgtctggtgtggaatctgtggtaattaggactacttgatagaattatggtaatcatttgtggtgtgcaatattgaatactttgtcataattttatatcttaagccattcctggtaatatatggatttgccaggaatttgatacaattcatagataaaacatatccagagatttggatgatttgtctcttaacctaaattcttcctgcagtttaaggaacatttgagtattccagttagtacctgaattttatatttggcttttaatctgtgtatttaatactataagaatttctgttttcccatcatttttatcttaaatttaaccaaaaaagaactaaaatacattatttccctagtgtcattttccatgtgatttgaatgaactataaatgctgtatattcacataaagattttgatcttcaattacattttatccaaagtattcaaaagaaagttgggaagatacgtatttgttatcaggaccaatttattttaaaattttatatgttttaacttcatgtattcatagacatataaagatgaactttcaataggcctccttcgattgtatttttttaatacagttaccactcgtatttttttaatacagttacaaactctttaataaaatacagctgtgtactttactattttctttaaaattagatgtatcgattgtctttacagtttgaattccaagacatgaatgagaagcttatcaaaaactgtaatgtggttacattctaaaaataacagttttattgagatgtaattcacataccattaattcacccttttaaggtatacattatatttgcttttcagtggttcagaaaaagaatcattatatacgttagagggagagaaacattataaaagttaacagtaggggaatgtgagtagaaaatatggaaatttttagtgtacggttcttgtaacttttctctgtttgaaattatttcaaaatacatctttttttcttttttccagcactaatggcttgggtgaattaaaatattttttaaattaaaaaaagtgtatggtgtggtgggggccttaatatattcacagagttgtgtaactgtcaccactaattccagagtgaaattttaagcatagtttgtgtttgttttcctgttccttccttttcacttgatatacaaaagttgacgtatcttgacagaaaaatttctttacaattttcttaaagttttcaaatgttgaactaaaagaccaaggtatatcataagtacaaggaaataaagtagaattagggcgtataaaatgaaaattcttacttgacaaaagaaagtgaactgcttttaactttatatatcctttgttgaaacttttgtgtagaatcctggaataaatcattagtcttatgcaaaactgtgtctacttcttaaaacttgaattgaggaaggaaatgctttgtaccaagatggcaaatattttattataagaacatttctgtttcttcctctcatactactatgttcattgtactgtatcttcctctgagagggtttaaactctttagagaactgccttaatttttgtatgtattggagcaacataatcagtgtttgcaatgttttgataaaagtaaattcttaataataaaattgttataatctcccataattttcaagtcagttttcactgttgttaatgatgtatgatattgtttttccttttctcttaattggaatttataaactcttactaaatgcagatacatctgctcaaaacttgtcatttgttcttagggtcaaaaaattgggaagattagtttgcactaccattgtaccttgctttttataatgagtgtactctgggtaaaaacatgaatctgaataagtactaaaaaaatgcagttgcctgtaatacaactgaggttttatctaatcccctgattcaaaatgacccagacaaatgtctgccaaggggcaaggagaaatgagacactttttcattctttagaatgtagaaaaaatgctttataaaaatggatttttatgtcaataggtacaaatcattttaaaatattttctataaagtattatataaaacagtgctaatgagtcttaggattatacgaagcatgttttcttatattgttttacttattttctgtaggaaaagtagccatcaaaaaagaagacttgtgtaatcacagtggcaaagaaacttggttttcattacagcctgttgactccaattcagaggttcaggtaaatattaaggcttatgtaatacaagagattgtcacaggaaatgagtaaaaaatgaactaattaaactggttcatgtaaatagagcatattataccttattttaaattctagcatcaaatattatagacttttgggtaatataggacaggaaggtaatggctttgtcatattgtttcaagaataatgctcatgtatatgcatatgtgtagatttgtggagattagggcatttctttcttaccttctgtttgagtcacaatagcaaattattatttgtctttgaggggaaaagttttaagggaaaatatgtgttttattaactctgactttgggggagaatccctggaagtctgattttgtctgtcttgattctctgtttactctctagtaaactggacttggggaaatgttattcatttaaaccctgcctgagcccactgtgcacagccttcactcccacacccaccctttcctgttgttcacctcgctttttatttgaaagagtatcattactctttaatctttttcttttttccaaaataagagacctttttcagattctgagtaaagatgtgtgtttagccatgtagctgaagtttctatttgtttttagaaaatctgagttgctcttagaaattatttttctaactaaagggaatctttttgctgtagccttatttatttataaaatatggtaaggattgtgaaaccatttcccgagggcataattgcaagcaggattcttcctctctaaaagaagttttaatttgccactgtgactcagaagtttaagacaagaaaaaagtgctacacccacaccacagataatttgcaaataagtgcctgtgtctccatttcctcataatctctcaagcattctctttgattaattattaaattctcaaaaaattaagtacttatgcactaaccccccttcttaactgcaaaatttaacatacttttcctgtttaacctactttgccatgttttaatattcttgtctttccttatgaccatagctattattcagatcccagttgtacagtattgtaaatgatccatgtgagaagcaatgtgaagaagtggaaagtgtttaaattaaaaggcagaaaacttaggtcctagtttttatatgtagttacttaaatgacattgaatttcatttctataaagtgggaataaaagttgctgtgttcgattcatatggttgtgagaattaagtgaaatatctgtaagaatagtttaaaagctgttaatgctatacagatgtaaaatattgtctgtttaccaccagtcagtctggtggctatttccctaatattcctttaccaaaaggcagatatgaaagttttaaagtaccagtttttcttttaatagttttaagaaaaggcatgataggaaaaggctttgaaaatttaaactgaaattttatgaaccattacattttataaaactcataaattttgtgaattttatgtaaatttgctaaacaatttaagagttccagctctcaaaaggtaaaaatctatatagaatatagaattcttgtagatggtactaaagattaatacagagacacaagactttatttgatggtgtgtgtgtgtatatatatgtgtgtgtatatatatatgcatatgtgtatatatgcatatgtgtgtatatatatgcatatatatgtatatatatacacacacattacatacacatgggtatgcatatttatagatatacatatatatgcatatatgcatgtatatatacacatttgagagatatatatctcatctatgaaacatgaaaattggggaagcaacagttacccagatataatatagtcatttaaaaattttgtacaagttattttcatgactgtgagttattaaactttacaactcttttgtcttaaatgatacttacttaataagatttgctcactatttaaaacagattttagaaggaaaagtactttgtggggtggaagagacatataacacttttgggttaatatggtaccattgaaaatgttgttgtcccactgctgataagggaatactaaattatgagtctagaaaagatagaaaatcatcccatggttcatacaaatcctactttgttaataaatttgttcacttccataaactttataaaattttacaaaaataccatgaaacataagagcaattaatagggaaataggtgaaagctatgaaacagattgcgttcaacaggaactcagtctgataattactattagtaattataccagtgtatcctaagcacagtactaagtacttaatgtcatttaactttcaaagtagcattatgaggtaaatagcatcacctgcattttacaaataaggcaaatgaaattcagaggttaaatgtcttctccagagtcacagaactactaagtagtggagccttgattccaaaagagatctgtctgattctaaaactcctaaccacagtgcctttactacctttcaccattctgtactattagtcattaaaaaaaatagattaggagtatcacttaagtaacatctgagtgtaaggaagagaagcctgctcagatttgctcaaagaaaatgggagaggccattggaaagctcctaaagagtttcttggaatgtcatcataggaactttacattgccagtgtgagctagaaagttgtcaggcatttgcagaggagatgcatcttaagtggaggctagattcttagaacaacagacattaaaatttgcctaagttcatctgtaaaatgagtatacaaaatgaaaagttaaaaatttttgcgtaagttacaattatttttgaaaagagtttagtttcttataaaatacactaaggtatttgggtggtttgtttgtttttggttgactaccgcataaaataattggcttgcattctgggccatggtaaatgaaaactatatactgtatctttaaactgtagacctcccccctgccctgactcagtacagcaatagatactgcaagtggcacatggaaactgagacccactaatcatttcttatattcctatgttcactgtgcttattgagcataagttctcactgtttaaatattgttttttttctttccctttcatgaagtgaataatgttttctctcagtctttccctctcattttaataactatttgctttgcaaaatataaaggaaagaaaaaaacaccattttgagatgccattgtattctttttgtatgtatgatgagacatgtctcttcctctgcttctctgtaaatctactccagtctctttttgagacctaaaagacgccacaccaatttttgagtccatgtgaccatacagcttcctcacctccaacatctgactcagttttctgccacaatctagagagaaagtttggctaaacttgggtcagatgtctacttcaatctaatttgatatggttggaggaaaattcactgtaaggcagtccactttagggctttgagtaggcatgttccctaaggaaggggtttgagtagaggaaatgaatggcattgctacctcagagggagagatgcttgtttcctagttctaccactaattagcatttgtgccccaaataatcgcaagcctgttacctgaggatcttcatctatgaaatgataatgtcagcgcaaagggttcccttagttgtgaagttctagggaaataacatgcagaaatgtaatttagctttccagtggaaggatcccagtagtattaagatgggctttatgccaaaacagttgaaaaattgtttagaactataacctcttaccttgaattgtctcccagagataattttttattattgctgatactgttatacttgtcaataatgttaatagttcttttcagtttcatcttcagtagttcaaaatattgttagtaacatttcatgagtgtatttttctactttttttttgtatttagattttggcttgattctaccttttgtaatttttccttctgggctgaaccatttttttcctcaacctattctaatctgctttcagactctgcagtgggtcagagagagagcagaaatggttctttttaccaatgacattgtgtcaataagtctagtggacatttttcagtcctcatcttacttgatctttgagcagcttttgatactggtgaccactccctccattttgaagcattcttttccttagtttctgatcctgtttatggtcctagttatcatctatttcatttggtattctttctcaatattctttgccacatatgtgaagttaatatgggttgtgctggtgccttctataaatcctcttttggcttcagtgaactacagccgtgctattagttattaggtcctgtaactcaccaggaacattaggtatttatcctttctttatttcttaggcacagtgataaaaagcatactttacatatggttgattaaccaggccgggtatggtggcccactgtagtcccagcactttgaaaggttgaggcagacagattgcttgagcccagaagtttgagaccagcttgggcaacatagcaagaccccatctttataggggggggaaaaagagtgattaaaccaaatctcccatatggagaatttgctgctctcattaattaaggagtttgtctcacacaacttgtccaagcagtaaatccagatgtgctatcaaccatgtcctatatgatgcaattacttagttaataggtctttaccaacaagcatatcttgaatttctggatcatgccataagttattgattgttttataggtgttttttttttaaagacctctgccttacctgtttaaaaagacatttaaaaagaaatgcaatgattatagctaataataaatacatgaggatttttaaaacatgccctattcaagacataacaaatgtaaaaacataattcattattgcaggttgattttttttaacttcattttaaatttttatgtgaattaataatgagccattctagatcatattaaatacttctttaaggagaaaacaacaccttcataaagaactgccattaatataagagatattaaataaaatttgtattttgctttttcatctgatgggcgattgtgtccaaaatcatttatagaggtaatttctacgtattaaaacatccatcagaaactccgaagttgggatatttttcacctcatgtacaggcataccttctttcattgtacttcactgtgtcgtgcttcacagatactgcattttttacaaattgcaggtttgtgacaaccctgtgtcaagcaaatctatctgcctcatttttccgacatcatatgctcacctcatttctctatgacagccttttttagcaataacatatttttaaattaaaatatgtatattgttatttaagacatattgcacacttaatagactgcaatatagtataaatgtaacttatatacactagaaaaccaaaaaatttttgtgactttctgtttagatatttgctttattgaagtggtctggacccttagacagtatttccaaggtatgcctgtaaaaacattttttaccagttgaaacatactgagttattttatatggaaatggttgttaaaatttagtgttttgtgataaaaacaaaataaagtttagacttgagaggattttaagtgcatgtattatgttttgctcaaatacctctatattagtccatttttgtgttgctataaaggaacatctaaggctgagtaatttataaaggaaagaggtttattttggcttacagttcttctgcaggctgtacaggaagtatggtgctggcatctgcttctggtgagtgcttcaggaagcttacaatcatggtggaaggtaaacggggagcaggcatattacatgatgagagagggagcaagagacagaaggcagaagtcccagactcttaaacaactagatctcacatgaactaactaagcaagacgcacttatcaccaagggggtggcactcagccattcatgagggatctacccccatgatctgacacctcccactaggccccacctccaacactggggatcacatttcatcatgagatttggagggacaaacattcaagccatatcaacctctgttcatcttattttcccaaactgtatgcagaaatttacacagtatcttctatatggtaccaagaatgtatgtaatacacaattgaaataatcacagatatttttgtgtgaaatttttgtaaaattaattgaaataaagttagcgtataaaatactaaatcttcaaatagtacctgtattagcccattttcacgctgctgataaagacatatccaagactggaaagaaaaagaggtttaattggacttatagttccacatgactggggaggcgtcagaatcatggcaggaggtgaaaggcacttcttacatggcagtggcaaaagaaaatgagagagaagcaaaagcggaaacccctgataaacccatcagatcttgtgagacttattcactattacgagaatagcacaggaaagactggcccccatgattcaatgacctccccccgggttcctcccacaacacatgggaattctgggagatacaattcaagttgacatttggtggggacacagccaaaccatatcagtacgagagtagtgtaagttcctcagaatgccccttaatataagataatgtgatattataactgcatgtatcagcctaacatagtcagtgctatggaagtcatatagagcaataccttccaagaatttggtttattttttattaaagacgtataatacagtgcaaggtatctgatcttccaacattttctgacatacatgaaaagtatactgtcattgagcttcctttaggagattgaataataagaatgcagttgtagaccaaatcacattacatgtttattatcaaacatagtaccttgttagattcttttttttttttttttttgagatggagttctgctggagtgcaatggtgtgatctcagttcaccacaacctctgcctcctgggttcaagtgattctcctgcctcagcctcccgaatagctgggattacaggcatgcgctgccacacccggctaattttgtatttttagtagagacggggtttctccgtgttggtcaggctggtctcaaactgctgacctcaggtgatctgcctgccttggcctcccaaagtgctgggattacaggcatgagccactgcgcccagcctccttgttggattcttaatgttacttcttcgtaggttctttatttttcttatttgtccctaggagttcttgaatctgtggcttgtcttctatcagttttggaaaattccaggcaattatcttatctcctttttttttctgccctgttctttttttctcttctctgctgtgactccagttacatgaataataggccatttcaccatgtctcatatgtctcctatgctttttccctctctgtgcttcattgtggatattttctactgacctgtctcccatttcaccagtcctcttttcagctgtggctactctgctactaaatacattttcattttggtttattgcttagttctaacttttttatttcattcattttatagtttccaggtatctgctggatttttcattttgttttatgtcttttaaaaaatagctattttaggctggatgcagtggctcacacctgtaatcccagcactttgggaggccaaggcgggaaaattacttgaggtcagaagttcaagaccagcctggccaacatggtgaaaccgtgtctctactaaaaatacaaaaattagccgggcgtggtggcacatgcctgtagtcccagctactcgggaggctgaggcaggagaatcgcttgaacccgggaggcagaggttgcagtgagctgagatcacgccactgcactctggcctgcgtgacagagctagactctgtctcaaagaaaaaaaaagcaattttaaattctgtcaattccaatatctgcgtctcttgtaagtccactgctttcctcattttttctcttggtttttgatcttctggcatattctgtaatttttaatggaatgctggagaataaaatataaaatatattggagataatttgagggcctgaatggtatatttcctctagagaagaagtatgattccctgccagcaactgctgtttctatcttgttggccagaactacatcatatggctatccctgatctcaagggaggctacagaatgtcagtttgctgggctcataactgccccatcaaaaaacaaaacacacacacacacacacacacacacacacaaacttgttttgctgcaattcaaatctattaaatgattacagatataagtaaaactgaacttttgtgtgaaaagagactaaaaagtattctaaaatgttcactgatttgagtttctaaaactgaaaagcagttttaaataatttaaaactttatttttctttactaagaacaacacagtagtagtaaaaactttgaaaattaaattggtagtatatacttttaaaatctgaaaattaaattggtagtatgaacttttaaaatctagagcaaaaaagcaaagaaaatcttctgaaatttcaccaaccaaaggtgtcttctatcaacattttggtagatgatcttgtaattttatacatatatgttttttatttttataagttaacattatagtatgtaccctattttgtgatttatttcttttgctaaggatagtatgtatttccttgttaaagtatataatgagttagtgttttacagtttagaaattataatttccttaatttaactcataatgccttttaatttagtgttccaccctaacagtatgtgttttgtgtctgcctgttctgtcctcacacttttcttgacctggttaatatataattgtgttattgttgattaatacctaaggaatgttttatttaccagtcagtgggagtaatgaacatattaggtaggctctgactcaataataatgatttctggcagaatctcattaaatatccttttgacttgctataatactatgattttagttgtaaacaaaatgattatctttttctactctattgtcatagtttttatttcttagaactggaatagatcccagacatttcctgagagacagttgtgttagcatacgatttctgtaataaaatgtatatatgttaaaattgtaaaactgcaaatttttgtgccgttggcttggctcccttgctagccaagtaatacatacatgctgtcacaacagaaaatatgatttcaaaattctagttgagtaatattacaaattacagatcatggaccttcaagatcacccttgaatagtagagattgtaaatactaaatgcaggaataatgaaagacctagtttacaaattatatatgattttatgaatatttgtgcctagatttttagtggaagatttgcttaatttagttccagctccacgtaactgctattaatttttctaccacagatgtgtttgctcctttagaccttagctttctcaggcagacttctgttttaagatccatcagtattttttgctcatctcttactattcatctaaccctgagctttgtacctggtggacctcagattcattcttgtataagtccccttaaaatagtgagggtgtttcaggttaggtttctgtgaaagaatttttgaaaagggttgttctaaagaggaacagtgactagataatgaactttcctacctctaatgaaatcactcacgtcatcagtccctagacatcactcccctgaaatctccacatggcaatgtgagaatttgtcttgtcagctggagggaggtaatccagtactgtttcttaaccagtttagaattgttagcgcagaattgctcatcaccagcggcaggttagaaatatcaagctctagattatattgttcctaagcctttatttcttgagaagttgattgtttgaattcttttgaacttacactacttaatttttaaaaattcgtctattaatatctctttaagaaagtactcctttattttcagtgtcccatctttccatcaagactcttggccatatgttatcttttgtttattgtcttcccaactagattgtacgctgcttgtaagcagtgacttacatctttaacatctatggattcctacccactcccacagtgccttctgaaacatagtagacattccataaatctttattgtttgatcaaagtaagtagtgacaaattgagttttattggctgtaacttagtttttagttgttttagaattgtatgatttctctgtcttttaatgagactgcttctgtccttaatgctggtttatcttctggaaaaagcatcctacattttataatttggttttatctcaaaatttccttaaatttaggtattgtctttccttttagtctgtgataattagatatataaatatttattgaattggacataaaattcttaaatttgaataccatgtttgacataagtatttgtttcatatctttcagaactttgatctctggttttggttattattcatttaacaagtacttagtgtaggcaaagccatgtgctagtggtcagtggataaatactgtggtgatttgaaaaggcacatacctttaatattttgtcagtaaaatagactactcagtttgtaatctttttgtcattatagggtaaagttcaccttgaattaaaactgaatgaactgataacggagaatggaactgtatgccagcagcttgttgtacagtaagcattttttttaaccaaaatcaactagaaataattctccattttgtattctttcgattttaagccaactccttgttttaacttcagaaacttttttcaaaaatgaaattctgctatgtcattccttttgtgaagttgattttcaatttaattttctcatagtctactcaggttatggtgagtcattaatttattcaactaatatttattgaatatgggttaaatgatatatatgggcattaaggataagggtgtctaactctctggcagtggagaattggaaaggcttcccaaagaaggtcctctagaaattgtcataccacagagcagagctttagagactttggagctagaactaatgcccactcagagatgaccagtattgattcccacctactttgaattcctttttacctcttccaccctcaagtcattttttaccacccagactctaatctcctggctgttctggaaatctgttgtagcccaatcccctactcttttcctcccctccaaacccttactctgtgatatcaatagactgccagataaccttcacttcttctgggtgttttcctctatttttgcattagttgacatctgaatatcccacaaagtacagcagtttcacagccttctcagttagaggctttgtttttctatcatgtccacatattgtaaggtcagggagtagagtagatattactctcctattgctgctccagactgtaacttattctcatcaattgtgaaccccagctcctttgaggtattctatctgtatataaatatgtctgtttgctactatatataatatttatttcattaattttttctgacctctttgaaagaagattgcatatgtatgactcttaatatatcagtatgtatttcctaagaataaggaatattatcttaaataactccagtacagttaccaaattcaggaagtttaacattgttacaatactttttaaaaatctatagttattttctaatattttaatctgcagttattatattccacttttgttaactgtcccaatgatgtctattaaggcgtttttttccttctaagaaaggatctgctccaagattatgttttatgtttagttgacatgtctctttaatctcctttaacatggaatagttttttgcttttctttgattgtattaacattttttaagaatataaaccagtttttttttttttaatgtttctcaatttggatttacctactaaaaatagttcaagatctgtttgcagctttttctccacagactgactctgtagaccaactgagagcatatggtgaaagtatctggattaggtcttccactcctccctcccctgcttcagtttaattataatagtcatttgaaatatagttagtttggttggtttggtttgtttgcattcaatttaagggtttttttgtgccccttccccccaatttaagttttttcccccatccttctaggcttaattttatttttgaatagaatatttgcatgatttcaaaaatcaaaactataacaaaaggcgttactcagagatgtgtgtagttcagttccctctccccacacccagctccaagcaaccatgatctgatttctgtccctacagtttttgccttttccaaagtgttatttgaacaaaagtatatgatatgtcttttttgtgtctgctgtctttcacttagcataatgcttttgagattcatccacactgtacgtatatcatttcctttttggtgtgttatttgtttcttgccataatttggtagatactgttatcctcattttgcagatgacaaaactgatgcccatattggttaaataagcctaatttcacacaggaagtgttggaggctggcagtttgatttttttcccccaactttaaaattttgaaataattacagatttacagaaagttgtaaggatagtacagagaggtcctgtgtacccttcattctttttccctcagtgggtacatcttgcatgactatagcacaataccaaaaccaggaaatttacattggcataatgtatgtatatagttatagatcattttatcatgtgtgttgatttgtgtaactaccaccaccaagatacgaaactcttctgtcaccataaagatatctctcatcccatagctttatagtcataaccactcctctcttctaacccttggcaacctctaatctgtctttatatctataattttgtcatttcaagaatgttatgtgaatggaatcttataatatgtgaccttttgagattggctttttttactcagatctatctgaatgactgtgtgtagttttttgtagacagaatatagttgggtcacttttttaaaaaaatcatttttgccaatctctgtctttttttggtgagttttttccatttatttttaatgtaattattgaatattaggcttaaatatgccattttttgtttgttttctgtttgtctcctattttatagttttctgttttctttttcctgtgggttacttgaacactttttagaattccattttgatttatttatattgtgtttttaaaaaatctatggtctctttgtatagatttttttttagtggttgctctaggtattacattatacatgcataactaatcataatgtactgatgtcaacattttaccaattagaataaaatgtatgtactttacctttctttaaatccctttaccctcccccatttgtaatatactttgtcttaaatattttgtctacatatattgagaaccacatcaaacaatgttataatttttgcttcagccatctaacacagttgaaaagagttagaggaaaaggaaagtgtaagtctgttgtctctacccacatttttgccctttccatgttatttttttcctttctgatgtttcacgattccttctgtgattaagtgtatagagtttcctcttaacattcttttagagtaagtctcttggtgatacattctcttggttttccttcatctcagaaggtcttgatttcctcttcatttgtaaaagataattatactagatatagaattctgagtggacagttcttttctttccacatttgaaaatgtaccacttccttgtgtcctcgatggtttctgatgtgaagttcattgtcattcaaattgtttttccctataggtaacacaccgtttttctctggcttcttttaaggttgttctttgcctttagatttcttttcttttttctttctttctttcttttttctttttttttttttttttgatatggagtctagttctgtcactcaggctggagtgcattggtgtgatctcagctcactgcaacctctgcctcccggattcaagcgattttcatgcctcagcctcctaagtagctggaattacaggcatgcaccaccatgcccagctaatttttacatttttagtagaaacagggtttcgccatattggccaggctgctctcgaactcctggcctgaagtgatccttctgccttggcctcccaaagtcctggggttataggtgtaagccaccacgcccagcctgcctttagatttctatatgttttagcttgattgtgatgtatcctggaatagatttatttaatttatcctgtttggggttcgctcagcttcttgactatgtatatttatgtcttttgccagatttggggaattttcaaccattatttcttctattaattctttatcacctctgctatctttctcttcttctttcagaacgccagtggcacaaatgttaggtcttttttttacagtcccagaggtccccctgaggctttgtcctttgcttttccccccagtctattttccctctgttgttcaaattgggtgatttctattgttatgtcttcaagttcactgattctttcctctgtcttcttcattcttctgtttagcttatctgttgagttttttattttggttatttatatttttaagttctaaaatttatatttgattcttctttataacttttttcctttggtgagagtttcttttgcagagactttcttgtttttttgtttcaaacatattcataattgttcattgcattattcacaatagcaaagacatggaatcaacttaaatggccatcaatcgcagactggataaagaaaatgcagtacatacatgccatggaatactagccgtaaaaaagaaagagatcatatcctttgcaggaacataggcggagctgaaggccattatccttagcagactaacgcagaaacagaaaatgaaaccaaatactgcacgtgctcacttatagtgggagctaaatgatgagaatgcatggacacatagagaagaacaacagacgttagggcctaccagagggtggagagtaggaggagggagaggatcaggaacaataactaatgggtgctagccttaatacctaagtgacaaaataatctgtacaacaaacccttgtgacacaagtttgcctatataacagacctgcacatgtacccctgaacttaagttaaaaaaaaattgctcattgaattatttttatgatggctgctttcagatccatgtcacataatcataacaatcatgtcatcttggtgttagtgtcttgtgttagtccattctcacattgctataaagaaatacctgagactgggtaatttataaagaagtttaattcactcatggttctgcaggctgtacaggaagcatggcagcatctgcttctggggaggcctcaggaagcttccaatcataacaaacaccaagcgggagcaggtgtcctacatggcaggagcaggaacaggagagagagtggggaggtactacatacttttttttttttttttttttttgagatggagtctcactctgtcgaccaggctggggtgcagtgacatgacctccacctcctgggttcaagtgattctcctgcctcagcctccgagtagctgggattacaggtgtgcaccaccagacctggctaatttttgtatttttagtagagttggggtttcatcatgttggtcaggctggtctcgaactcttgacctcgtgatgtgcccacctcagcctcccaaagtgctgggattacaggcatgagccaccaagcctggccctcttttagttatttttaaatgtataataaattattgttgtctgtagtcaccttcttatgctgttaaatacgagatcttatccattatatctaactatatttttgtaccctcacttcccgtcccagcccctggaaaactttgttctactctctgttatcatgagttcaattgtttgagtttttagctcccacaagtgagaccatacgaggtttgtctttctgtgcctggtttatttcacttaacgtaatgatctccagttccatccctgttattttgaatgacaggacctgattcttttttgtgactgaaaagtactccattatgtatatataccacattttctttatcagttcgcctgttgatggacacttagattgcttccaattcttgactattgtgaatagtgccacagtaaccatgagagcgcagatacctcttcaatatactgattccctttctttagtgggattgctggatcatgtggtagctctatttttagttttttgaggaacctccaaactgttctccatagtggttttattaatttacattgccaccagcagtgtacaagggttcccttttctccatatcctcaccaatatttgttacgcatgtcttttggataaaagccattttaactggagaaaaattataatttcattgtagttttgatttacacttctctgatgatcagtgatgttgagcaccttttcataaatttgtttgccatttgtatgtcttcttttgagaaatatttattcagatcttttgctcatttttaaatcagattattatattcttttcccgtagagttgtttgacctccttacatattctggttattaatccgttctcagatggttagttagcaaatattctcccattctgtgggttgtctcttcactttgttgatccttcctttgttgtgtagaagctttttaacttggtgtgatcccatttgtctattttcgctttggttgcctgtgcttgtgtgcttgtggcaaccattatgcaagaaatctttgtctagtccaatgtcctggagagtttcccaatgttttcttgtagtaatttcatagtctgtggtctagatttaagcctttaatccatttttatttgatttttttaatatggtgagagatacgggtttagtttcattcttctgcatatggatatctatttttcccagcaccatttattgaagaaactgtcctttccccagtgtatgttcttggcacctttattaaaaatgagttcactgtagatgtacggatttgtttctaggttctctgtaatgatctgttggtctatgtgtctgtttttatgccagtacaatgctgttttgattattatagctctgtagtataatttgaaatcagataattgtgattcttccagttttgttctttttgctcaggatagctttggttattctgggtcttttgtggtttcatataaattttgggattttttttttctatttctgtgaagaatgacattggtatttcagtagggattgcattgaatctgtagattgctttaggtagtatggacattttaacaacattgattcttccagtccatgaacttggaatatctttccatttttgagtgtcctcttcaatttcctgcatcagtgttttacagttttcattatagatgtctttcacttctgtggttaattcctagctattttgttttatttgtagctattgtgtaagcagtattactttcttgatttatttttcaaattgttcactgttggcatacagaaaccccactgatttttgttgtgttaattttgaatcctgccactttactaaatttgtttatcagttctaatagttttttggtggagtctttaggttttttccaaataagatcatatcatctgtgaacaaggatgattttacttctttctttccagtttggatgcctttatttctatctcttgtctgattgctctagctaggacttgaataacagtggtgaaagtgggcatccttgtcatgttccagatcttagagaaaagactttcagttgttccccattcagtatgatactagctatggatatgtactatatggcttttattgtgttgaggtttgatccttctgtacctattttttgagggttttattattatgaaggactgttgaattttgtcaaatactttttggcatcagttgaaatgatcatatggttcttgcccttcattctgttgatatgatgtgtcacactgattaatttgcacatattgaaccatccttgcatccctgagacaaatcccacttggtcatgatgaatgatctttttaacgtgttgtcgaattgggtttgctcatattttgttgaagatttttgcatcaaggttcatcagggatattggcctatagttttctttttttgatgtatctctctctggtttggtatcagggtaacactggcctcataggatgaatttggaagtgttcccctctctattttttggactagctgagtaggattggtattagttcttcttgaaatatttggtagaattcagcagtgaagccatcaggtcccaggcttttctttgctgcaagactttttactgtggcttcaatttcattacttgttattggtctcttcaggttttggattttttcatggttcaatcttggtaggttgtatatgtccaggaatttatccatttcttctaggtttttccatttattctttttttcaaagtttcttaagcttttgctctccatactcactgtcttgtagcagcagagttccagtggtagctttatggaatttattgttgatttctcatccttatagatattctgaaattcatgacattctctgttttttagtattgctaaaggcatggtttcacatatggctttctttgtgcttcttgctggactttggttttgggggagtaatgtatgggaagattcatatcctagtagttactattatcctccagacctagaaagtccccactacaacattttttgaactttagtgagacctccctgccatccattgatcttcactgtgttcctgttttcacttctttctacatctttttccgtgacctattgctgtagtcattttctcgcaggttccgtaaactcccctattgttctcatcattcttatttatctggaaaaactctaattgaaaatgacctcttcctctgtgttcaatctgcacatgaatatagctggagaaaatcatgtaggctgatttcactttaaatttatcatcacaggcctcacatgggcacttatatctgccctggaatttaactgtgcttctctaatacagctataagattctctaccaccacagcctggaaattgcttacatcttcctgaatccaaatctataaacctaatttgcatccataattttgtccttagagcagaggaggtactccttttcttgacattgaattcttccatctgagctctggattccatttatttcctctacttaatgagttttgctccttcagttatgccttctttttcttgttttgtcagctttaccttctctcctacatggttctcaccacaaataaacatggtctagtatctctgtcctaaaaggcatgcctccccagacctcatctctgcccacccataccccagtcctttttatcattcccattcctctgctctcctttgaaggcagacttctctagggaaaaatagtggtaggagtgtgtatgagtgtgtgtgtgcgtgtgtgtgtgtgtgtgtgtgtgtgtgtgtttgcaattctccagtcagcactctccagtagatttttctgtgatgtggaaaatgctttgtatcttcactgtccaaaacagtagccactagccatgtgtggatattgaaaacttgaaatacagctaatgtgaccaaagagctgaagtttaattttatttaattttaattaaatgtaaaaaaccacacatggctaatgactacagcattagtgcagcttcagtaaaagaacctggactcctttttagcagtagcttatttcaggacttgggcagggaaaatatgagatgagtctggagcatcttggggtctcaaaaagtaagaaagtgctaaaaaataatggggatatgtaaaaaggacattgaagccaatgtaaagggacttcaaattaccaaatctggaacaatttgagcttcagaataaataataatagtggattaaaacttatagaataaaataaatataagcaaatactggtacaaataaacaattaaaaactcaaatacttggtagggagaaaggactgatttttcctatagtagaattctagttaatgaatgtaggaggaatgatggaaatgaaaatcaacattggcaaacatcacaataataagtgggtgaggggacaattcaaaaaatcatctatggatgctaagtgagcataagtgtggtgacaagatgtctgatagatgccaccttaattgagtgatcaaagttaacatcaccaataatgagacatccagtacttcccaataggatgcattgagaaggacaccaagatacataacctcaacctaatcatgagtaaacatcagacaaactcagattaaggaatacactacaaaataactggccaatactggcaagatcacggggcaaagaaggaaaactaatgaactgtctcaggatggagaggaataagaagacatgacaactaaatgcactatgggatcctgtattgtgtcctagatcaaaaaaggacattggtgaaatttgagtaagggctacagatttcagtaattctgctgtggttctacaaaacgttaacatttgttgatgagtatacagaaactattattttaacagcttttttgaatatctgaaattatttcaaaataaggtttttaaaattgcctgtaccttgtgcattcaacccaggtctgttttctgagtttcagattaatatgtctactttgatgaatcacattgcaaacttaacacatttaaaactgaagtacagggaggctgaggcaggagaatggcgtaaaaccgggaggcggagcttgcggggagccgagattgcgccactgcactccagcctgggcgacagagtgagactctgtctcaaaaactgaagtactgattctcatgtctatccaactcctcccccaaagtcttagcaaatgtttaattccgctcagtatgtttttcatctctagatttttccatttttattgtcttctgtgtctggatggatcatatggaatataattataacttttaaatgtctttgtctgctagttctgtcttctttgtcatttctgattctgtttctattgatttttcttttcattatggatcataatttcttagttccttgcattcctggttattttctgttgcatgccagacattgtgaagttgctggatattttaatatttctatgaatgtacttgagctttgttcggcacttggttaagttacttagaaacagtttgatccttttgtggtttacttttaacttttgttaaacagacaagcacagtctttactggagggcttatgttttcctactattaaggcagtacccatgaattaccaggttttctactgtggctgatggtacctcttgctagccatgtgtgggttttaggaactattgcctctattcttttcaaatggttctttccccagcctcagatgatttcctcatatatacacgtatcaatactcagctgaatactcagtggggattcttgtagctccctggaggtttttctttctctgtgcaactttcttccctttagtactctgccctggggtccctagtcactttgacctcctcctgctgacagctttgcctcttcttctcagagaaaccatttagctgtaagctggggcagttggagggctcacctgtccttcactgctgattttgttcaattcgttttgggtggagagtaaatctagttcctgttactccatcttacctggatgtagaagttaaaattttcttttagtttaaaaaaaaatccaaagaaaagaatcagatcagtcttattctgaactgtttataatattttcttacctttgtaaattttagatactatattgtaaatgctttatatgtcacatataaataaaatatcaaattccttattgaggttattttcaacatttgttttctgcccatccatgatttatgatatgaaattgcttacttacagattggaagaacagtgctatgctaggtaattagaaaaataatatttccaaatatatgtaatgaataacctatatttaataatattacttaagttttgcagaaaactcaatttttaactgttttatatttaaaaattaagagtactgatgatttctgtagggtgcacttctggtttatgggcatccgtgttttggtttgtgggtattcttatcgtttcataagttttttataagtcagtactgcattttcctctgcttttttttatacctcataaaatagaaaattggatttctgtcattaaggtttctcataattggtgtttatgtgagataaatgtggtattacaaggacagtaatattgtatttgggggcacagtgggaatgtagaagggcactggacttcagtaacaaaattaaaaagtagaagttgagtcttggccagcttcttacaagttacgctacctctttgagccttaccttgtaacttcctcacataacctgtgagccttacttcttttaaatggcataattctcttctcaaaggcagttgtgagaattaggtgcattttgtgaaagtgcatagtaaactgcaaatgccgtgtcagatatcattttgaggtttagcctgagaagggtaagttttaagcagtatgtacagtgggaaaatctgactgtacctcaacccaacattaaaacccagaattatcttggcttgtgttttctttggctagtttcaaaatttctttctttatttttttatgctcagctataatagaaatgagtcgtattatcatttctgtctttactctgcagtataccaatagcacttcactcacatctgtgacctgtgggttgtggagagaaataaggatgtactcaacagcttgcatctttcaacaaagaatacttttcagcaacactcatgagtttctcttaggcattagaaaatgcagacccttagacattaaactaaactcataaactcagtaatatttagtgagaaaattggaggaacaaatcactaaagttagattctgtgttctctgtaaatgccaacaactgtgagccatggagtagattagatgaccttggtttttatggtctaaaacattttctacagaatggtgcttactgaggagctgtttactgagaattggaataaaaggctgcagaattgtgtgaagcttgccctatatttatgaatcagatttttaagtggaagctgcagttgtttccttgtttgtcattcatgctttagcagaggatatgatgccatagagctggcttggtttgtagcttctcatttagggtttgcaccactttcttttcctttttagaggccacagcagttttgatgtattatcaaaccgcaaaatgtaccttgttgggtatttagcagaaggaaatgtgttgactattacacatcccttatctacagtgcttgagactgttttgaatttcttattcttatttttttttttgagtatttgcattatatatacttgcccattaagcatcccaaatccaaaaagcccaaatttgaaatgctgcagtgagcatttccttggagcatcatgtcagtgctcagaaagttttgaattttggaggactttggatttttgaatttggaatgctcagtctgtgtttgatagtttcattagtgattgtggcattcctgtttagtctcattttgaaaatacagcataaatttaaaaatgcatacatacatatgtccatacatattactacctattccatataggtagtatatagccatacaactgcagacacatggaaaacaattcttaaccttttgaatgtattagtttgtgtttaaagataatgttttatcttgtttaactggaatctaatatgttaaatctcttttattctaccttagcatcaaggcatgccatgggttgcctctcataaatggccaaagctgtgacccttatgcaacagtttctctagtgggcccttctaggtaatatttattgaattattattaggttttaaagttttgatgtttgatttaaaaatttaaaaagtaagattctacgagcaaatgataaatagctatttataacacacagtaataaatgctttgaaagaaaaatctttagtgagttctattatacacttgtcaataacaaagccctctttttacagacagaaattggtaccccattttaaatctgccatgctcttaggctttaaggaacaacttcagttttatactagtacaatgtagtactttaaaacataaacttgacttttcatgcatcagcattcctacttttcaaatatcctgaattttatgcatgtaaaatcctgttttaatgaatgccagttcagaataacaagacaatttatatatttttatctggaaggcagctcaggactgaaaattgccttttctactcatgaaatctgtcctctacagagagaattccaactgtagaaaaactgctgaagtactagagcatggcaaagtgtaccatatcattgatttaaatgatttataataatttgtgaaaaaacctatagcactttgtaatacggtgtgttatatgacttcattatgatttctttaaggaactgacacatctgaaatatgtctacaacttgaaggtttagaatcaggaagcaagaaacacagtattccctctacacacacatacatgcatacatacacaccccttttccccatccccagaatctctagttattcttactttgtagaaaatcactactaagtcactttgaaaaatgtatttatgtatgtatgtaaagtacctagtaccatgccggtatttattaggtgctcaaacaatagtatgctattagcagatactcagtcgtatgacattaaatgctattagagagatttatttttgtgtgttaaaaatgttcaatctagtggagctatttttgttttttttaataatctctacctgacaaattatttggtaacatacagttagagacaatttggcatatgaatttgtgttttaaaaagtctggccaggcgcaggtggctcacgcctgtaatcccagcactttgggaggccgaggcgggtggattacctgaggtcaggagttcgagatcagcctgaccaacaaggagaaaccccgtctctactaaaaatacagaattagctgggtgtggtggctcatgcctgtaatcccagctactcgggaggctgaggcaggagaatcgcttgaaccctgaggcgaaggttatggtgaaccgagattgtgccattgcactccatccagcctgggcaacgagcaaaactccatctcaaaaaactaaaaaataaaaagtcactgttggttttgctattgtactgtagttgtgtaagatgttaacactgggagaggctgggtaaaaacacaagatttccttatgcgttttttgtgacctcctctgaatctataattaaattaaaagatttttttaagaagtctctattatacctgaagcccaagaagtaagctgagttaagaatgtttttcaagttccttgggtatttttcaacatagatgaaggtgctctaaatcttattgtcttccttctatttattctgagttgcttatagaatagaatgtgtttttaaaacccctgaaaaaggttggcaatctagtgtgtccgtagagagaataatacaatcttggcacataggggatgcctaaagcttatatattctttgatttgagtttataaggacagttacttttttccaagcaatatttaaaactgaatcttccctgagtcaccttaacttttaaatggaggtcaggctccctggttggaaatagcatgttttataattgtgtactgttaagttctacaaggtaaaactctaccacattggaacaggaatgaccaaaagaagacaaaagtaaagaagaaaacaagcaatccgcagtttaatgaaatcttttattttgaggtaattttttgttttacgtaaatgttaacattaaatatgtaatatttaatgctagttgatttcttttttcaaaccacagtcatagtaatcattttatcaattaatgcagataagcatttctctcctgaaagcagtagaaccatggtgtgatgcaatggatgcccaatatataaaatgaataaaggcagagctctaatttgggagcaggaagggccagggccatacccactccccagtcatcctcactattcatgcccttcctttgcaccctcccttaccctacccagctccctacctaacacatagtggccacaggattcttctgcagggtaccctttgacagtcactagtgaagtaagtgtaattatcactcaagaaatctgagttccagtcaagttgactgaaagagtcactaaatgtgactcaagtttcttatcctgtgaaagaataatcggaagggaaactagcagcactacctgactcagagtttttgtaagacccaaagcatgtgagaatcctttgagaccataaaatactttatgattacagctttattattacttttttttttaagcctaattcattctgtggacgcctgcttatcttcatagacagcttcagctgccttgaagttgtcccaaatacagtttggacaaaagctttggagtgcttttctttggagcatttgttaaagaaatcctttttcatattatttgcaaactacagaaaaaaaaaatcaaactctcaaaaagattgtattctaataaagcatgttgcagttcatatcaacgtgtagggaaggtttgaaaaaaggagttacattttgtgccttttcttctgtgtgtatttttcttggtatttcacagtggagagaataacggtacctctagtcatgcctgattgctgtactttaataaaggaacacaggccgaagaaaatgccaaaagtgaagcaggaagaattgtggagggggaagcaagggagaaaaaaaaaacaaaagaaaaagtaccaatgtgagacttttccatttcctggctaaggacttggtgcagttgttctacgtttattaatggcggttgcatctaacctggagaaaacaaagaaggcagcaatgtaaagggccgctgactaaaggcactcacactccccattagcccacataccttaaacctcagctggatggaatctactctgcttcatggatccttacagtcagcagatgaccttttaaaagtagaaggcctgacctgcctgctgtagcaggagtacttgttaggccttgcaacattcattcagagggcctttagttggttataaagatagatacatttccatctctgtcctttaactgaagcaaggaacacaaagcagacatatgtatgcatatacacaacagtaaaatgcagtagatattggggaggtcagatgaactctgctccattaaaggcttgaagaaatattggattttctaagattgaggaaagagagtattagagatgacgaacattttgagcagaggcacagagacagaaaagcagaaagttatgtccaaagtacagtgagtactgattttactgggcttgtgtaaggaaataatggaaactaagattagaaaggtagagtaagaccagctgatgaaaggccttgagtgcctagttatggtgcttaagtaaatgattttgagcctataagttatgagtaaaacagtgtttgggaaggaattaactatgatctgaggtccaggtggcttagggagaaagaacaaagctggggagactgttgtactttaggtgtaagaaaaatggggaggggatggggtatctttcaagagagtgctatggaaatagagaggaagaggcagataaaagagagaatgcaaagggcaaggtaacaaattggttatagaaaaaaagagaaaggaagtagttgaatgctgcccccaaggttccaaatctggaaaaatagaagagtagggaagaaggaaaataaaagtggcttagtttggagcataattagcttgagggctgacattttaaatcctccagtagggagtttatgactgaaacttaatatgagtgatagttattgaccaacactcaaggtttgtttatataaacagccaagaaagccaagagaatagaggtatacaatacaggagaaaagtgaagaaactaatttctgcgactcaagtatttaactttcagcatgtcatttaatttctgtacttcagcttcctcatttttaagtgagggtaataaatctagccctgtccgcctctgagcagcgttctgatgaacaaaggagataatgcatgtgaaagcactttgtagattgtacagcactgtgcagctccaagttgtttttagtgcaaaataaaacataaaattttgaagaataatttatctatagattctgaaaaagaaacaaagacagcagcataaggttgccaaggtagtgcccaggtaaattctatagagtgtttctgggaaaggagatacagttgtatgatcactaaattaaataggagatcaagggaggtaagaactgagaatttatcgtcagatgtggtgatgaagagagattttaggagagtgatctgtgaggaagccaagattataaggagttactatagtgagtgggtggtgaggaagtacaagctgtaaggatggattgcagttttcagatttgtctaagaaaggaaagagataggaagaccataatttaaggggagaatttttcttagacttgagtgagatgaacaagctggtattattttgattttttttttacactaccttattcttttctgctacttccatagttgcttttatattcagctattgagtaaaatattacttggacattttcctctgcttttatccacaattgaatattttgcagatgatcatttttaagctgtaggaaaaatgtatttttttaaaaaaaatttttactaaaatattttgtttacaggtaaccagatccagtagttacaccagaaagtcccagttccaggtagaagaggaggacattgaaaagctagaaatcaggtatgtgccttggggttttacagaattgcttttttgtataccaaaagaaaatcctagattcaaccaaaaaaagtaaaccaactttaatagaattctctatagcaagttggttgatgaaacttagaggaatatgcaactaatttaaatccagattatctttccaaagtctgatttgtttgcagaaatagtcaaagtgtattaattttataaacaaagatgatctaattttcatctgttttattgtattgatttttaatttttcccaaattgttccttacatttctggattatagtgtaatggatggaaaggaagttatatctcagccaatttagaaatttttttttattcttcttaacatatctgctgtctaacagaaatttcagtgaggtaagaagataattcaacaggtgcatgtgtttgaagtttgtgctgtttcctgggtcttaaatatctatgccctttgcgaaggaaaaatcttataaatgcatgtgtaggtgtgatgttaacagtgtgttcatctagatggtatattaatcatgtgtttggagtgatcaggtaatgtatttttctaatttttctatatatatattaattggtggtaatctagagagaaactgtagtcttattgtagtttctttctgtagtccttattgctataggttaaaataaagcctcgactttcaaactaagacagtttaagtgccttctttcagactatttaaaattactttctgtgctttttaaataaaagctgctgtagtattttgcttctctagtctggatagtgaggtatgtatatggtgttgctaacatcttttaagcatgtaaaattaatgctgtaatacagatcaaagtaatttgaagctgttttgtggtgtgaactctcttaaacattgtttgcaaaacataaagccagttttcaattttcaggatcgacttgtggaacaatggaaacctagtccaagatgttttcctaggtgagattaaggttcctgtgaacgtattaagaactgattcctctcatcaagcctggtaagggcccagcattttagtgaactccatagtttaattctctttagtacagtatatatatgcaaataaatgcttactctgaacatattttaaatttgccatgtaataagctaaacgtcattaatattgatatgttcattaattcattgttgcagaagtaaattgtaagttttatgacttgacctgtggtactgagataaaagaactgaatcatctaggaatatttttctgttcagaagtgaagacgactcttaaggagaaaaatgggaaacatttaaaacattacataagagttgttcatgtaagaaaacgcttggtcacaaatcagtgtctgcatttcagaagttttattagtggtcataggaactgtgggtatttgaaagcaaaggattttatttaggggactcagttgtttatgggaactaaccactgttcttccttcaccacaccccattgaaatgtactgtagatggccctaatgttactttttgaatgtctaaggtcttatgttgttgagctggcactttttagggctcttggttttcaataatgactataatattattttagttttcagtgactctaataataacattacactgatgttaaattcaaattaatgttcagacattacattgagctagtttccttagcagaatcaatgtgaaactattgttttttttctgtctatagcacttaaaagcgtgtgtatcctttcagtatgttgcccagcatctctcttgctagattttggtttcaactgggtataaatgaacatgcctttctcatttgccttttaaggagcactttttggatctcagtttctgctgcctcaaagaggagtgtttaggtgtttcttatggatatcagtttcatctgttcctaaaagagcctgcctcttctgattggccatcagacatcttcattttagagtcttgtcctagagcagttatcacttgtagactgatatggagactctcaaaatttttactttatttttgcctctctatagtccaaggcagatctaagatttattggtctttatgttggcattttgtgtattatagtttgtaaaatgcatccacagagggggaaaaaaatcaaatgtagtcactatgaaaaattgatgaagatttgggacctgtcatcctcccactacaccatgtcttccaccttccatcaaatagcatacattttaaaatgaaaatttctgagctcagtttgtcaagtttttaaaattatgtgccagaccactcagtacagaagagaaaaacacgttgtagtgcctccgggtccctcaaaatgaacttgaaatgtgccacataatctgttttttaagtaagactgtctccagagatgccttccaaatttggcaaaactttgtgcagcttccttggcagtatgtaagaacattaacaaactaattttatttttatagatgtttttggcccatgatattttaaagtaacctgccagaaatataagtgctgaaatttatatagcatgaaataggaacatctggtaattcatatataattccacagttgtaaggaaacataaaaatgtgaatgccatttcttttaagttggaaataaaactcttaacctcctccatcaattgtagagccatagcatccccttgtggggttgttagtaactgcatgaaaactcaagaaaagatttatttaccctcaggatttcaggcaaattctttctaatgttgatgttaagagagtaatcatcagtaatttaattctgttgtttgaaaagtctcaaaatagattaatttttaaatttgaaagtaagattcaaataatagataaaatgaattactgggtttttcttttcaacagaagcactttatacatgattttagactagatgaatatttgatatgatttagctttccagtttgttaattttgacaccttttgtcctcaaacttttttttgtgggggggcggtcttactttttttgagacaaagcctcactctgttgtccaagctggagtgcagtggcatgatctcggctcactgcaacctccacctcccgggttcaagtgattctcctgcctcagcctcccaagtagctgggacttcaggcacacaccaccatgccgagctaatttttgtatttttagtagagacggggttttaactatgttggccaggctggtcttgaactcctgaccttcgtgatccgcccacttcggcctcccaaagtgctgggattgtgagccattgcgcccagcctttggtctcacatttttaacgtatctgtttaatatttgaatttagaaaatataacaagtctcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccattctcctgcctcagcctcctggtagctgggatgacaggcatccgccaccacacccagctaatttttgtatttttagtagagatggggtttcaccatgttcaccaggctggtcttgatctcctgacctcttgatccccccgcctcggcctcccaaagtgctgggattacaggcgtgagccaccgcacctggcccacgttcagttattaatagaactgcttctttattctctcatttacatagcattatgtacaaataattgcactttgggtttgtctacctcaattttaattacacagaccctatggttagaattgtttaaatgctgatttttttctgttaagggactgtcaaaactgcttactcttgagagcataaggattgcttttatgcctgtgaatgaaaagtacatgtttagagcaactgaatgctactttcagttaaaaatttctctttattccctgtttctttttctttcaaacggaaatatttcattcaaaaactgacatatatatatatgagttttttgttttgttttcacttagaaatgccagatagtcctgaactatttaacaaatcttgagccttttctctttagctctaattcatacagaattatttaattcacaaggatccttcaggcagtttattaaattgagcttttgtaataatattttaaaataatcacatttatatagttatacaaatgactattgatagttattcatatatttaagtggtaatagttatacatcacatatataaatgttatatgtgtaacatttacatagtgattactgtgtgccaggaactattctaagtactttacttataataacttttttagggctgttgtagggttttaatgtgttaagacactattaatactccttatttgacaaatgaggaaaaagcacagagaaatttagcaacttgtctaaggtcacacagctgggatttgaaccaaactgtttgaccccaaagtttgtgcttttaaccagtgtactgtaagtttgaactctggcatatttctgaatatatttaaaactcaaaaacattcttttaagccattagcaaagatttgagtgtcccttgcttataaaatattatataaaagagaatcagagagttccctactcatttaaaaaatgatcttttcaagggatgggtaaaacaacaacatgttgtgaagtctttttttttttttttcaagtagacatagatgagatattttgtctatggggatttcttatcctgcaaagaaaatccaaggaaacaagtttagaaagtatggcaggagtgaacccttctggagttcttaagcatccaaaaacaatgtatgcataaaaatgagtaattggtatagcactaccctaattcctctacatagaacaatgctatgttaagactgtaggcctggtaattttcagttatatgagagtaaagagggatgtcatacccctccctcagttatttggagctaaaggaaataaagttgcgctctgagcaaaatttctgtagtaaaaaccaaaacagagtttgttttgactgtagagttcagagacactgtttaagatggatagggatggtcccagagaggcagaaccagttgtaactgagtaagcagtaatacaagtaatgttaatctactgtgcatggaaaacattagttcaataggaggaaaagattcatctagagtaataaaaaaggattccaaagaggtaggcatggtactgcctattcaagcacaattgagggggtaggggattctggtccagaagaattactgtttccttggcaagactgttgtcttagctgagagattcttaaggctgcataaaactccttgtcatgcctctgtactcaccacaacgccttttgataatttgcctttccaaatagcctaccaacaggtaaaaaaatacagtgaaagatatagatgaaaaccctatggtaaatggtgataattgttgtaaccaagtgacaagcacatgggggtggtggtaagaaagggtgttcattattactattatcactcttctccctacttttgtaagtgagcatttctataataaaatgcattggtcacttaacaatccaggtacttatgccacttgactatatttctttttcataaatttaataattgacctgcttttaagtatatcaggctctgcactcagtcattgcaattcaggtgcaccttattctttttttttatttttttgagatgcagtctctctctgtcgcccaggctggagtgcagtggtgcgatcttggctcagtgcaacctccacctcctgggttcaagcgattctcctgcctcagcctcccaagtagctgggactacaggcctgtgccaccatgcctggctaatttttgtattttggtagagatggggtttcaccatgttggccagcctggtctcgaactcctgacctcaggtgatccacccgccttggcctcccaaagtgctgggattacaggcgggagccaccacacttgaccttcaggttcactttagatgtgctgataaaacgagatgtctgaatttgcaaggttgccgaacatgccctggattgtgaaaaattgaccaaagtatcaattgtcaggatgcttggtcatcaaccagctaaacttcctgatgtggtttggctgtgtccctacccaaatctcaccttgaattgtaatcatccccacatgtcaagggcagggccaggtgaagataattgaatcatcgggtggtttcaaatccccatactgtgcttgtggtagtgaataagtctcatgagatctgatggttttataaatgggagttctcctgcacaagctctcttgcctgccgcatgtaagacgtccctttactcttctttgtcttctgccatgattgcgaggtctccccagccgtgtggaactatgagtcaattaaacctctttcctttataaattacccagctttgggtatgtctgtattagcagcataaggacagactaaatacacttcccttagaggtacttctgagtcacctttgctaacaggcttgtttctaattatttcattgaccatatctttacatcactatttcttaaatcagacagtagatgttctgaaggttgatcttcctcttttgtgggatagtgatgtaatttcttcttgtattaaccatcccttcatcctttaaatttgccttggttaattcgctagttgtcttttctgtctttatcttatctttctcaaagctaataaatgttctattaaagccttcctccttctatttttaaatgaattaatatattagaggaggtcatagctgataaatatataaattaagtattaaaactactatttcttttataaaaagcatctcagcattccagctaagtgaaggaggagtgatagagttataaaattatcattttgatgattaatggctctaagccgtgatcatcagtggctgctgatattgcaaaaggagaaacaaccagacatttatgcctcttggtagaactacacagcattatcaatgaagcattcttgccagaacatcaaatctgaatctaaccaagcctctagatctaactaccaatatagaggaaatacagagaggatgaaggaatatggtaaatgacattgtggaggtagagataagagttaacacaattccaaaggtggaaaactctataggaccaacagtgaggaatctataaaagagacttaagaatgctattaccaattctaatctatggaccttatttggattcgaacaaactgtagaaaaacatttatgataagtttggggaaatttgaatactaagtgaatagtgatgactttttaaaattatatatgaaattatacctggaaattgctttaaaataataatgcaggaacaggatgggagagtgagtgaaggtatggctgaaacaagatcagtcttttattaaaaaaaaatcagtgtatgtatttttaaattttgtttggcattgcctttagatagagaatagagaagatggcagcttttttctcatgttagttagaaacttctaattgctttcaaaaagtgacccaaggcttcaaaaccaaagcattcattcactcactctctagtcaatatccatgggaatgtctactactaagcccatgtgccctattctgacctatctactaaaaataaaatcgtgggttcaaacagcaatgcttaaaaaaactcaaactgcttaaaaatattgcacctgtgaatctgttttagtatttttagggaattactttactactgggctttgtaattttaaactttagaaaggccttagcacaggatttataaaacttgaaaactatgagtataaataaataattccaggccaggcatggtggcttacacctgtaatcccagcactttgggaggctgaggcgggtagatcacctgaggtcaggagttcaagaccagcctggccaacatagtgaaaccctgtctctactaaaaatacaaaaattagcccggtgtggtggcccgcgcctgtagtcccagctactcgggaggctgaggcgggagaatcgcttgaacccgggaggcagaggttcagtgagccgagagcatgccattgcactccagcctgggtgacagagtgagactctgtctcaaataataataataataataattccaaacattctacattcttagataaaatatgtaatttatttctcaaacagtataggggaaatattgacaacatttaaaatgcattttaatgtattttaaaactttttaaatgtatttttaaaacattaaaatgcattcttaatgtattttacatgtattcacaaaatataagaaaatgcaattcgtgtcataattgtgacatgataccaaaggagaaaatccctccctttactgtagcaagtgtataccatagaggcagtgagtaagagaggaacagaatagagcagtaacaagatgaaaatggaaagacaaactcttcctcagtataagtaaccagtgctataaatttgccgtgcctagtacaaatgttgaacaattgtataaacagaggttgaggattttctgcaaataataaaagaaatatcagtgcagattattctgggagaagaatggcaaagaaaatccacaaaagcattttagcaggacttgggtaacagaggactgagagagagaatttcccagacccaaaaagcaaataaataattttccccagtctcttagtaaggagggttgaaattaaattcaaaattttaatgtttgctgtttattgctttctgaacacaattatttttaagttacttatggcctattaagctgtatagcattttcacttcacaagacagtacaattatttttcattatattcataaatacctctcttaaagaactcgagtccattcattgcatgaatattatgtacccgttaaaaagaacaaactggatctatgaaaagtagtttcaaagagttaactaggaagtgctttcaggtaaaaaaaacaagatacaggagagtagaatatgataacatttttgtaaactgactaataggctcagaactcatttataaatgtgtatatatgcacacattttaaaaaatctatataaaattatataagcatgaagaaaatagagaagggtccatagtaggtagttaacaggttcctaagagaagcggaggtgcagaatggtagtgttttgaagataggaaaaaagataagagaaaaacaaagttaaaagagaaaataaagaaaacgttccttaaaaaaacaaaagcattgatttgatgacattgtttatatatgtatgcatcgttatctatttgtctatgtgtagtaaggattttttaatattaaataaagaagattctggttcaaagagtgatgaaaatagtaagtggcactccacacagattctttcttggttcttgaagtttgagcttcactacaaaaagaatctccattcagttgcttttatctaccctacagcgtttgttaatagcaaatccaaatttgtaaatttaatttggagttatttctgaaaataaattttgtgggcaatatgatgataagccacaggaaaaaaaatatgcagataaatatttataaataaattcctttaatatattctaattgtgatagtttctgcagcataatttaaaattatgctattttcagtgtccaaataaggatgttatcagtgttagtattgatcatctggctgcacatagtaacttaaaataattttgttttagaatatactaataaaagacatatataatacagtttttctgcagtttggtttctggttatagttaagtaaagcaaagattcactattttatatacagcacaagaaaacgcctttttaaaataatgaattattgaagaataagaatacagttaagtttttttcctggatgtttttagatattttgctctaatggaataaaggggatgaagtatttgtaatgggcatattattttagataaataaatttttaagagtttgaacaattttttaactcctggaactcttgtgatatcttgaatgagtagcaaacttttttttttccagtcctagaaagatatattttggctaaagcccagcaattctgaagttttaatgaccaaattagttgagttcaattgtttttgccaacttaggctactttaagagtaaaaattgcctttctctaatcctgatatagtctagaaaaaaataggtatttacactaacaacaaatcataaatttcaaatttaggcaagcatattgctgagtatccccccaaaaaggaaatatgaatacttgattgtcaatggtactttacaatttttatcagccttcatccaattttgttttgttttgttttttaattttagattcaggggtataggtacaggtttgttacatgggtatattgtgtaatgctgaggtttaggcttattatcccttcacccaagtagcgaacaaagtaccggatggttttttcaatccctacccccctatctccctccccacttttggaacccccagtgtctattgttaccatctttgtgtttgtgcatacccagtgttcagctcccacttacaagtgagaacatagggtatttggttttctgtttctgcattaattcgcatagggtagtggcctccagcagcatccatgttagtgcaaaggacataatttttttctttctgtgactgcgaacaagattagtcttcagttgataattgtttaagctagataatgggtacatgagcgttcaatattctcttttgtttgtgtttttaaattcccatgataaaaagctttttttttttttttttaaactcttagatttctggttttggtcctgcaaatttctcttaagttcaaatttttggaaaaagaatttactttaaaacaaggttacttacgcattctgatatgtcttatctacttttttttttttttgagacgaagtcttgctctgtcatccaggcaagcccagactggagtacagtggcgggatctcagctcactgcaactccgcctcctgagttcaagtgattctcctgcctcagcctcccaagcagctggattacaggcacctgccaccatgccggactgatttttgtatttttagtaaagacagggtttcaccatggtggccaggctggtctcgaactcctgacctcaagtgatctgcctgcgtcagcctcccaaagtgctgagattacagtcatgagccactgcacccggactgtcttaattttcagctaaatgcctctttcttaaatttagttggtaaaaatttatttttgataatacattggattttaaatgtttaccttttattatcattttttctaaacctgcaagctaatcaaactcttgttcaactcctttgagatcttaatttctgtaatatctatgctttttgtttcctggataaaaatgtgtttatagctttgtaatccaatgtataaccaatattagttttctgaagatgagtatcctgctacttatgaagcttcctaactgtaaatactaagttgacttttttggtttagtttttttataacttaactcttaacttgcctcattggcttgaatgcatttccatcacatggaatcacttatatttttactttaggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaagtatgttaagaatcttaaggatatgatttaacacgaaacggctaaaataattctataaatgataaggaaaagatttcaagagtatcaagtcttattaaaacagtaaaaattatatacatacatatatatacacacacacatttctatttatctgaaccagagtactatgattcctacatgtgctcccacaatcatctctgataaaaaatttcgaaaattaaatgtcctgtataacagctttagtgacattatttcagttacttttacaggctagtgattgaacagttaatcatgtttccttgatgtttgtgcttgttttctacctttctgtatttagccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacagtaagagttatattttattaaatgttaattacatgttgttgaaattggaccttagtttgacagattgattttgtagtctgaatttttttgtattgatcagccttactgtatagtaggctgaaaagaagtacttaacaaataacaaaaggcagttaagctatcaaacagtattcacctaccttaaggacaacaattaatgaaggatgtttttctttaactcaggaaatttcatttgttactaatctgcttcttagtgtaatggttcacgtgtcacaagttaaaacaccagagcagaagtgtttttttctttattcattatgtatcacccttatatgcatatgtatgacattctaaaaagcagtcaagtgacttctcattcacgtcatagtctaacactgttgtttttttacacacagagacatacatatactccacatttttggttcataaacatgatttgcctttttaaaaaaacatatatatatatatatatatatatatatatatacacacacacacacacatatgtattgagttttttgtttgtttgtttttaagacagagtctcgctttttcacccaggttggagtgcagtggcatgatcttggctcactgcagcttctgcctcctaggttcaagcgattctcatgcctcagcctcctgagtagctgggattacaggcactcgccaccacgcccagctaatttttgtatttttggtagagatggggtttcaccatgttggccaggctagtctcacactcctgacttcaagcgatccacctgcttcggacccccaaagtgatgggataacaggcatgagccatcacacctggccattattttaatatatttttggtaagtttgaaaaacctaatggcagcaagcttttaaataaatggtaaaaattactaaaattgtaggtcacttatgccttctagtatgtcttaatctatttcagctaaatgcttctttcttaaattggtcaagtatgttatattattggtttcaaaacctttgtttactacatttggtttcatctatttctatttcagagatgcaaacacaatttttagaggaaattccctggctacccgatgtctggatgagatgatgaaaatagtgggagggcactacctgaaagtaacattaaaacctattcttgatgaggtacagaatatatctccaacaatgatagtttgtggccttatgatagttgttcttttatcaagtgatctattgatgggaaggatttattcattcatgtgttactgaaaaaatagactgaacactttagaagcaaattatttacttctctgtcaatggatttttactcaaaaggtacagtatagtataatctacattatttctttgttatgggatttctattttagctagagtttcaaatatatgacaaatactttttgatatcatgttttaagaaaattgtatatgttatccctgcataggacattttacgctttgctacagtttaaatttctataattaacttttattatcagaaaaataagttattttcattttgtcagactacttagaaaaaaatcattaactgaaaaatttatttttcagatatgtgactcctcaaaatcctgtgaaatcgatcctattaaattgaaagagggagataatgtagaaaataataaggtaagtccttgttatattatttataattgcattaaaattggtcttaatggtgtacctttctcccacttacattatgataaagccatatagagggaagcagtgctgtttattcttcacataagcctttattattagcagcacttccagctcctaggattagtttttagaatgttatttcctcagtggtttcactttatttttgttcttgattgtctctttttggctctagtaacaatagtgaacttaagctatagctagttgcagcccccgttctagccattcctttgggctcaaactgatcaggctaagtgacacagtgactttatcagtcagtagtttcagtggcctctgaaaaaacaatgattgtgttagggtcacaaatttttattgcagtggataatagtgtcacaatgtccttgtgcttgtgtatccgagttattttgtgatttccttttggatcattttattccctcttgcttcttgtgaggtttattcatagattcacctcttacgcctagcaaatctaaatttaatttattaaattaagtca

SEQ ID NO: 1083 - DNA, 2592 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaagtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttt

SEQ ID NO: 1084 - DNA, 2550 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaagtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttag

SEQ ID NO: 1085 - DNA, 23243 bp, Mus musculus
  misc_feature (491)..(5362): "n" at positions 491 thru 5362 can be any base
  misc_feature (8773)..(8792): "n" at positions 8773 thru 8792 can be any base
  misc_feature (11227)..(11300): "n" at positions 11227 thru 11300 can be any base
  misc_feature (13245)..(13804): "n" at positions 13245 thru 13804 can be any base
  misc_feature (14949)..(17597): "n" at positions 14949 thru 17597 can be any base
tgcctatagtttcagaggctgagtccattatcattgtggaagcatagcagaaggcagacaggagttggggcactatctgagaccttgatatcctgatccataaggcaaaaagagacacatgagcttttgaagcttcaaagcccagcccagccccagttgacacaggtcctccaacaaggctactcctcctaatccttctcaaatagtgccctaccccttgatggctaagtattcaaatagatgagcctatgggccattctttttttttttttttttttttttttttagttttcaagacagggtttctctgtatagccctggctgtcctagaactcaaactgtaggtagaccaggctggcctgaattcaggaatcagcctgcctctgcctcctgagtactgggattaaaggtgtgcaccaccactgcctggctgggccattgttattcaaaccaccgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtgcagtgctggatatctacaggcccagtctcagtactgaggctgaagcaggaaaggctgcacagttgaggtcagcctggtatacagccgaaaccctcgtctcaaaaaactaacatgattttgtgttttgtcaagataattgcttgtttcaggttgctctgcctgattagttttcttgtgtttgtggtgggttttggtatttgtttgtttatttgtttttgagaccaggtttctctgtgtagccccaacaatcttggaactctatagatgggccttggccttgaactcacagggacctgccacctccgcctctgcctggaatgaaaaggtgggaattaaaagcgtgcaccctcacctcctgacactgttgttttgagagcttcccactttagcctggccttgaactcaaagtaatcttcttgtctcagcctcccaaataccaggataacaggcatgagccagggtgcctgatttccgatgctttccttgtgcatactcatgtgtattcagatgcccgtgaacgtgtcagtgtgttcacatggaaggccaaaactgatgttgaatgtcttcgccaatcattttccactttactgaggcaggttctcagggaacctggagcctgtcgatttggactagtctcacctgccaccctgttccagggattctgtccccatccttctacttgctggcatgataggtagacaatatgtctgtaccactatgctcttgatgactagggagtggagtcttatgaaagtcaaggttatggggtgtggtggtacaccctgttaagtcccacatcaggcagctcacaatgcctctgcagcctgcgttcaaggggatctagttctcacttctggcctacacacacagacacacagacacacggacacacaggcacacagacacactgacacactgacacacaggcacacaaagaaaaaagttatcttttaaaaaccaaagtcagttgagtgcagtggcatgtgcctttagtcccagtgcttgggaggcagaggcaggagaatctctgtgacttcaaggctagtctggtctacttagtaagctccaggacagccatggctacacagagagctcctgtctccaaaatgttaattaattaaaaaaataaaactaaagtaaaacatttattcaagtacataattattgtaaagttctgagactaattcctttacaactatggttaagtaaacaactactgacttaggtgttctgggatatttgaaattctacatatctgttgctacacatatatacacgcacatacacatcttgaggctaaattaggatatgtgtctaagtttttccaagtgttaggcaaaagtttgtgtgttaaaagtgtgtaggtttaatacattaaggcagtcaataatattctctaaacatgatgcattgtgtgaaaaccttaaacacatcattactaaaccatctgacatttctgctgtatatttagtaaaattcaggattatcggcttgttttatttttaattatgtgtccatacttaattatttgagtatatatatatatatatatatatatatatatatatatatatatatatatatatctgtgtaggagcattgtagacatgagtacaggcccttggaagccagatccctcagctaaaccatctctccagctccttgttttgttttatgagacagggttgtgttacatagtactggctgatccagaacttgctatgtagatcaagcttgactaaaactcaccacatagtcaaaactggccttgaactcctggttctcctgcctctacctccaatataccatcatgccccagtcaggtgccatttgtatacttctcacacttaaaatctggcctgcagcaagatgtggcagcttatatccatgagtcaagcacacgcacccccaagtctgacacgagaggatcaccagaagttggaggccagcttaggctggcctgtagtgtatggttctgtctcaaaagagaaaaaaaaggagaaaaggagtaaagaaagtgtaaaaagctttgggctaggggtacagctcagttgatagatcacttgcctagcatgtgcaaggccataggtctattattaaatctgggggaatcacatcatgtaccccaactcaggtgtggccatctgttgtcaataagctatttaaaagaggcaaattaaaagtgaaaagcagagccgggcgtggtggcgcacgcctttaatcccagcactctggaggcagaggcaggcggatttctgagtttgaggccagcctggtctgcaaagtgagttccaggacagccagggctatacagagaaaccctgtctcgaaaaaacaaaacaaaacaaaacaaaacaaaacccaaaaagtgaaaagcaaaaaaaagtgatttagtcaatcaggccacattgggaagagggataaagacctcaatacaagtgcttccttcgaatagcttcaattctaccagaccagtcccaattctaccagaccagtcccaattctgagctggcacatggtgtctatgtctgaaacaaaaggataaatacagtgaccgtagggatggcagctacaatatagtgtggggtaccacacctaagaatcattttccatggctcttagttactgttggaaggggtgggacaagcaactccatttcactggcttgagacaggctcccatcaggaggtctacactggcctcaaatttgggatctgcttgtgtcagcttcccaggcaagtgctaccatgcctactgtgactttattttcagtctgaccatctctctaccccccatctctgaacaaatattttctgaagacattgctaattgaccatctggtggtttgctttccaaagtcccatgatgccaggcaaagactccttctggttggtctgctttgaaccgctttgggagcgtaaatgagagatgtcaggagctagaactagtcagcctttcaggcctgatttaaacaactgggatatagagggattggctccgaggtcaggtacacctgaggtccattcacttgtcctgtggctaatgtcctggtgtctcaaaaatgctgttcgggttcatttgtcaaaagcctgacttctgtagaacgttaacagacagttcacttataaggctctgcaaaacagagttagtgggctggagagatggctcagtggttaagagcactgactgctcttctgaaggtcccgagttcaaatcccagcaaccacatggtggctcacaaccatctgtaacaagatctgatgccctcttctggagtgtctgaagacacctagagtgtacttacatataataaattaataaatcttaaaaaaaaaaaacagagttagcaggtatttcgcaaccagtaactataacacagtacacaaacactagttggggctggnnnnnnnnnnnnnnnnnnnngaaactgagtctgggatggtgagactcaaagttcctgaaaacagacccttgtccccacccacctgttactcttctcagaggaagccagtagctttggggtgatttcaaaagttgggcggggatggcagagataagcagtgtgggggcaggagtactgaccccccccccatagaacagggaggaactaacggggcccacagtctgcagacacaagtgaagtgggggaggggataaagccggaaaccacggggtttctgagaaagtcagatggcaagatacaacagatagggatgaagttggggagcacagaagggtgaaccccaaactcctatgggagctgtcaaggggtccaagggatcttggtcctgcattctgcctctgcagaaggaaagaaaggaaggggaagagagaataaaaagaggaaatggaggaggccttgaagaatgggagaaagagaagcaaaggcttgccggaggaggagaaagaggaaggttagaaggaaagtaaaggaggaaggaaagaggagacacagaaagaggaagagaaatatggtacatgaaaaggagggacaggaggaaagaggtgcgagggaagggaccaacagagaaaggaagggaatacaagacagtggaaagaggaaaaggggaagaaaagagggaagaaggaagacctggagagacctggagatgaggaagatgggaggagggataggagaggaagaagagggactcagaggcagcaaactgatggagtagtagaggtatgacagacaagaggcaacaggaggatggggagagatcagaggaagatgggagaaagggacaaaggatgatggaagaagacaagagacatgacagcctagggagggatggaagggaaggggagaaaaataatctgagagcccaaaaggagacacacagagtctcagtgacagattcggagaaagagaaaaaaaaggagggaagagccaggcggtggtggcgcacgcctttaatcccagcacttgggaggtggaggcaggcagatttctgagtttgaggccagcctggtctacagagtgagttccaggacagccagggctacacagagaaaccctgtctcgaaaaaaaagaaagaaagaaaaaagaaaagaaaagaaaagaaaagaaaagaaaagaaaggagggaagagaatgtttctgtgtctcacaaccctttctgtcctcacaggttcaaccccagtgttcccatggattttcctggtctaggggccctggggacctcagaacccttgccccagtttgtggattctgccctggtgtcctcaccatcagattccacaggtttcttttcctctgggccagagggtttggatgcagcatcttcttccacttccccaaatgcagccacggccgcagcatcagcactggcctactacagagaagctgaggcctacagacactccccaggtaactgttgggtggctgccttggcactggctggaagctgtcagggttgccatagagatggttagctagttcacagttctgtgaggtcatcttggaaagagttagaagctctgtggataggtgtaccgccccatttgtaccaatcctcgtctctgtctgccatactgtagtgagcacacggagaagccaggctggaagtgtgtacgaagctgtcttatttgtcacttgacctgcagcctcttggtctcaatatcaaaaagggatggaggggatcgtccttgctatagtgaccagagggacatagaactccgaagtcacccaagcagcaagagactattgtaggaagaccagaaaactagccaccatgttgggacagacgaacaccatttcactgtaaaagtaggactacctaaggtttgctgttctttccttttcctctctaccccttcaacagtctttcaggtgtatccactgctcaacagtatggagggaattcctgggggctcaccttatgctagctgggcctatggcaagacggcactctaccctgcctcaactgtgtgccccagccatgaggatgccccttcccaggccctggaagaccaggaagggaagagcaacaacacgttcttggacaccttgaagacggagcggctgagtccagacctcctgacgctggggactgcactgcctgcatcgctccctgtcaccggcagtgcttacgggggagctgactttcccagtcctttcttctctcccactgggagccctctcagctcagcagcctattcttcccccaagtttcatggaagcctgccattggccccttgtggtgaggctttcaaaaagggaccaggaggttgagttgggctaggtggctcaagacatagctaagctgaccgagccttgcttccttttctctccatctaccagaggccagagagtgtgtgaactgtggagcaacggctactccactgtggcggagggnnnnnnnnnnnnnnnnnnnnnnnnnnnnnnnnnnnnnnnnnnnnnnnnnnnnnnnnnnnnnnnnnnnnnnnnnncagtggtggtgcatgcctttaatcccagcacttgggtaggcagtaggcaggtggatttctgagttcaaggccagcctggtctacagagtgagctccaggaacagccgaggctacacagagaaaccctgtctcgaaaaaccaaaaaaatttaaaaaagacttatttaagaacgccacctgggctggtgagatggctcagtgggtaagagcacccgactgctcttccgaaggtccggagttcaaatcccagcaaccacatggtggctcacaaccatccgtaacaagatctgactccctcttctggtgtgtctgaagacagctacagtgtacttacatataataaataaataaatcttaaaaaaaaaaaaaaaaagaacgccacccaactcatactggtcccggcactattatacttgccctcttccttatcctttccccatagggaccatccatccctttcccatgcaggaaccccgctacctacctagaactcccatccaaggccaggaatttttacagcttccccaagggattcttgtgtttgttttgttttgttgtctgatttattgattgatagatttggtttgttttttgtttgaaatggggctttgctatatagccctgggtggcctggagctatgtatacgatactggtttttaatttgctatggtcctcctgtctctgtctcttgagtgccagggttacacccctgtcttcctccaagacattctgatatgtggtcaaagtctaaaactagagatagaagaagtcttgcatagctatagaaaagaaactccttgctgggcagtggtagtgcatgcctttaatcccagaactggagacagaggcaggtggatctcttgtgagctcaaggccagcctggtctacagagaaaattccaggaaagccaggctacacagtgaaagcctgtcttgacagataaatacacagatacatagatacatagatgaataaacttcttatcccagataggaagcctttccttaataggactctcatcccttaagctcttttctcaggccctgtaaggccctgtccccgaatcctacctctcccctacccccagcactaatctcctgtccttttattcctcagattgtcagcaaacgggcaggcacccaatgcactaactgtcaaacgaccactacaacactctggcggaggaatgccagcggagatccggtatgcaatgcctgcggcctctatttcaagctccatcaggtatgctatcctccatgttgcttcctgtcctccaagcacactcccggctcctcatccagccctcatctaccttgagctgtcttcctctgcctttgcttcctccctctttgctcctctttctcttctcagaagttgtgtacttgcgcctccttgcccaatttccacggcttccacctcaagcctccttccatctgtcctctctttcctccttgccacctcccgtgatttgagtcttggctacctcttaccagtgtaggaggatattctgagctgagatcagggccacacacaagcacaggtctcacctccctagcacaccctgggtatattactctagccattgaactaattccccattcttaacaaagtggtgttaagagactgtccctagcccagctacatcagcacaaagggctggagctggtaacccctgtggtggtctccgtttctacaggtgaaccgcccactgaccatgaggaaagatggaatccagacgaggaaccgcaaggcatctggcaaagggaaaaagaagcgggggtcgaatctggctggagcgggagcggctgaaggaccagctggtggcttcatggtggtagctggtagcagcagtagtgggaattgtgggggaggtggcctcaggcttggcactgggcactgcaggtactgcccacctctatcaaggcctaagacctgtggtactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactggatgaggttgcaggtataatatgtcacaactgaaactcatgatgcaccaacggaactgtgtatctgaagccttgtggacggcatccaggtggccccatatgtcatcgtaagatgctggatgactgattacttgtggatgaggtggcgggagatggcagggtgtcatcaagttgcaggtaaaacagcatgtggagctgtgcgtgcaataacaggtgaggagacatggaaggctgtaaaggtgtgcttgtgcatgactgggctatcgttgacacagtgtgacgacacataaactggacatttttgaaacactgagcaagaactgaagtgtaggattgtcctgaaatcaaggccattgagggctacaaagcaaatgatatacatatagtggagagagagagagagagagagagagagagagagagagagagaggatctcaaaaataaaaattaatcacaatagtttatattcctttcagagactgtccagaatggccatggccctataaaagtccccaaagcagctcagccctcagctcccacaccttgcagacaccccttacctgaatagcaagtctactcagaattgctcttacacaggttcctggccttaccttgaaaaaagaacccaggttcacaccctcatagaaacagctgccctgactggtgccggaagcacaggctagccctgagatcctatggaacaagacctcttgctcactcttgtaaactccctctccttccgtccttctctcttcctctctctccccctccctccctttcttcctctccctctgtccctccctctcccagcctttccttatctccctgctctcactctctcctttgctctcatgcagctcaggtctcatacctgccgtgcagttcaagcttccctctagttgatttgtttttctcgatttttctgagtgggggtctcactctgtatgtgacccaggctggcttatctgctcagtaagtatcccaaattctggccttggactcatggcaatcctcctgcctcagctaggatttcaggcaagagccactgcacctggaagggagccctttctccaataattcacaggcagcccatcctgacctggataggagccgcagtccctaccagcccattcagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtctcaaaaacaaacaaaacaaaaaacccaaaccaaaaacaaacaaacaaacaaacaaagcacagctgaggtacatcagttagtaaagtgcttgccttacaaagaccaggacctcaatttgactcccagaactttggtaaaacaggtcatcttgcgggagcatacttataatcccagtactgatggaaactggcaaacccctgggatttcctggcaaacccacttagcctatttgaggaatccccagccagtgagagaaactatcatgaaaatgtgctgtggggctggtgagatggttcagcggataggagcacttgactgctcttccgaaggtcctgagttcaaatcccagcaaccacatggtggctcacaaccacccataatgagatctgatgccctcttctggcacatctgaagacagctgcaatgtacttatgcataatagtaaataaatcttagaaaaaaaaaagaaaatgtgctgtgtctgagaaacaacatctgaagtggtgctctggactttacatacatgtgaattctcctctacacacagtaacacacatacacaaacccactcacatgcatgtcaggaaaaagacgacacataagccacactctgaattccataaacgcctgtctggaccccgcattagacccttcagcttgaatatacaagatttcacagatctgtctagtccaggaacttgggtccaatgctgtacagaaacacctagatttttaaaaaattattgtttgatgaatctttgggatgtttttatactagcctgtccctgtgggttgtaaggatgcctgcgttgtgaactattttatgttgggcacaaatgtttttaagtgcagaagaagttaaagcaagagcattgtttgtcttgtggcaccaccgatggtccacagaggcaaatgtcagtgtgcaatcggatgttttcagaagcaccccctgtgtgagtggaggcataaacaactgggaacagatataaacagaagcatgcacaaaggtcattctcccaaaagaggaggcacaaggaatatccatctggcaaagggcattggtccataaccctctgggctaaagttgtcatatgtgatacctgacttattatataagtttctggcttgaccaactactgaaagccactcttctggctttaatataatcttatatcttagtctgtatagaaaaacagcgccttcacatccttccctcttcctcaatcatgtctcataacgtttgtttgtttgtttgttagtttgttttgtttttctctagacaaggtttttctctgtaacagccctggctgtcctggaactcactctgtagaccaggatggccttgaactcagaaatctgcctgcctctgcctcccaagtactgggattaaaggcatgcgccccccccccaccccccagaatgtctctaatttaccagctaatataatcattctcctgagaccagacaggaaacacatagagaaattcttacctttgcagtaaaagaattcctgtgccaggcttgggggtgtagctcagtggcaaagcacttgcctagtgtgtatgagtgcctgggtcccatccccatgcctgcataaaagaaaacatgtcagtcactgtgatttgaaatcaatacaactatttttccagacttattttgaattatatgcagaagtgccgtccaccgcttctagggccgtgccacaagagcttctcacgggagcctccactttctgcttccctacccaccaacttcgtaacaagaactccaagtacccggaggaaagtagtcagaaaatgaattacctgggtccctgaattaccaacagtcagtattctgattggggcttatatgagaaagaagaaatatttacttgtgctggctgggttttccccatgatttatttatttttactcacattacgtccccatctgcagcacaccctcttgttcttggtggtcatcccatggtactggcatctccaaaactgctggggtcttgcactacaattgggctgcactttcaccaataggttctgttcacggtgccaagcctcaacttctctccatgaccccatcaatcttggggcttcatttgctatggaggctgcactttcagcaatggcctctcctggctctcacagtgctaggcgtcagctgctctccatgaactctctacgccttcaaaccagtaccacctgggtgactcttacactgccaagttcagctgatagcgcaaggtacaaacttggctgcctctggaacatagcttttagatttcaccttgacagtgctggtcgtctcctctacctcctcctcctcctcctcctccccctgcttttctttctctcttccttcctttttctttttcttttgccccgtctgtcctggaactcactctgtagaccaggttggcctcaaactcaagagatccacctgcttctgcctccctattgctgggatcaaaggcatggaccacttccacctggcattaagattttttatttttgtggatctgtgtaagtacactatagctgttttcagacacaccagaagagggcatacgatctctatagatggttgtgagctaccatgtggttgctgggatttgaactcaggacctctggaagagcagtcagtgctcttaactgctgagccatctctccagccctctggtctcttctaaatcaccattaatttctcatctacagatgagcagaactgaatatcccagcaagacaaaggattcacttaagcagttgtgctagcttgttaaatcttcagcccctactgaccagaaccatggaatattaattcaaaacaacaaatggccccagtagtgtctttaaacttctccctgtcacttcacaagccaggtctctatcctcggcattgctctcaaaagtctcatcttccaaccttttacagaacagctcatcaagcaatgaacaccctccccaaaacaacatggccagggttgtcacagcaatgccccgctcctaacaccaacttgtctgagttaaggttactatctctgggatggaacaccatgaccaaaagcaacgtgcagaggaaagggctcatttcactcacagttccacgtgataataggtaatcatcaaaagcagtgaggacaggaactcctagggcaggaacctggaggcaggagcagatacagagaccatggagggtgctaattactggattgttcctcatggcttgctcagctgctttctgaaagaatccaggaccaccagcccaggagtggcgccacccacaatgagctgggccctcctcctcaatcactaattaagaaaacgcctcaggagaggcctgcaaaccccaggccagaacaatagaccatcgcccttcccactatcagagaggctctatttagcacctgatgggagcagatacggagacctgcagcgaaaaattaggcacctctggaaaccccagggaagagggggaggacaagttgtagaggtcagagggatcaaggattccagcaggacactgcccacggaatcagtgaagcagggctcataggggctcaaagacaccgaaccaacaaccaggagcctgcatggagtttgctagactctctgcatatgctacggttgtatagcttggtgttctttctcgactcctaacaatgggagcaggggctgtctctgacttttttgcctgcttcagggacccttttcctcctaccgactggcctggtccagccttgatgtgagggtctgtggctagtcttaccgcatcttgttattgcggtgtttagcaggtatccgtggaaggcctgttgtcttctgaagggaaaatgcaggagaagtggatctgggagagaggggattgggaaggggtggagggagggcaaactgcttttgagatgtaatgtaggagagaagaagaaaaaagattgatacaaataactgtcctctaagtacccaagaatagaaacgtaaccatttagagaggggcaaagaaagccttacaggcctgcctacagcctgatcttacggaggcattttctttgctttttgtaattttgctagttatgatagataatgtaaatatttttagagagagagggttgtcaagggggtcataacccgcaggttgagaagtactgttttaagttgctgaactagagagatagatgccttcagtgcttgagtcccagcacccacatctaaaggctcacaaacacttctcactccacctcctggaggatccagtgtcctttcttgcctccttaggcatacacacaggcaaaatccatgaagtatgctgggcatggtggcacatgcctttaatccagcacttgggaggcggaggcagaggcagaggcagaggcagaggcagaggcagagacacatgcatctccgtaagttggaggccagtctggtctacatagttagttccagtacaggtgggactgcatggagagaccctgtctcaacaaataagtaaacaagtagcagaggaagatggcggccgccttagctgttcgtggagcgggatctgcagtggtctttgggcctgaggctctcaccccagactgggaaaactgagaagtctccacagggaccatgatcatggctttgtaatttaatggaggcgtggttctaggagcagactccagaataacactgggttttacatcgccaatcgagtgactgacaagctgacccctatttatgattacatctgctgctgctcaggctcagcagctgataccggagcagtagcagatgctgtcagttaccagcttggtttccacagtattgaactgaacaattctccactagtacacatggctgccaggctctttaaggagatgtgttaccggtgcagagaagatctgatggcaggaatcatcattgtaggctgggaccctcaagaaggagggcaggtgtcctctgtacccatgaagggtatgatggtaagacaatcttttgccaccggagcctccggaagctcatacatctatgactatgttggtgctatccatcctgaaggcacgaccaaggacgaatgtctgcagttcactgccaatgctctctctttggctagaaaacacgaaggctccagtggaggagttatccgcttggcaaccattcaaggatcaggggtagagcggcaggtgctttgaggagaccagatccccaagtttaccactgccactttgtcacctccctgaagcctagatgcaaaagctaataaacagtgttaaagaaaaaaataagtaaacaaatataatttttaaaacaaatggttggctgggtggtggtggcgcatgcctttaaccccagcacttgggagggagaggcaggcagatttctgagttcgaggccagcctggtctacaaagtgagttccaggacagccagggatatacagaaaaaccctgtctcaaaaacaaacaaacaaacaacaaaaaataccaaacaaacaaacaaaaaaccccaaatggttgttaagctgggcagtgctggcacattcctttaatcccagcacttgaaaggcaaaggcaggtgaatttttgagttcgaggccagcctggtttataaagtgagttccaggacagccagggatatacaaagaaaccctgtttcaaaaaaaaaaaaaaaaa

SEQ ID NO: 1086 - DNA, 1807 bp, Mus musculus
actcgtcataccactaaggtggctgaatcctctgcatcaacaagcccaggttcaaccccagtgttcccatggattttcctggtctaggggccctggggacctcagaacccttgccccagtttgtggattctgccctggtgtcctcaccatcagattccacaggtttcttttcctctgggccagagggtttggatgcagcatcttcttccacttccccaaatgcagccacggccgcagcatcagcactggcctactacagagaagctgaggcctacagacactccccagtctttcaggtgtatccactgctcaacagtatggagggaattcctgggggctcaccttatgctagctgggcctatggcaagacggcactctaccctgcctcaactgtgtgccccagccatgaggatgccccttcccaggccctggaagaccaggaagggaagagcaacaacacgttcttggacaccttgaagacggagcggctgagtccagacctcctgacgctggggactgcactgcctgcatcgctccctgtcaccggcagtgcttacgggggagctgactttcccagtcctttcttctctcccactgggagccctctcagctcagcagcctattcttcccccaagtttcatggaagcctgccattggccccttgtgaggccagagagtgtgtgaactgtggagcaacggctactccactgtggcggagggacaggacaggtcactacctgtgcaatgcctgtggcttgtatcacaagatgaatggtcagaaccggcctctcatccggcccaagaagcgaatgattgtcagcaaacgggcaggcacccaatgcactaactgtcaaacgaccactacaacactctggcggaggaatgccagcggagatccggtatgcaatgcctgcggcctctatttcaagctccatcaggtgaaccgcccactgaccatgaggaaagatggaatccagacgaggaaccgcaaggcatctggcaaagggaaaaagaagcgggggtcgaatctggctggagcgggagcggctgaaggaccagctggtggcttcatggtggtagctggtagcagcagtagtgggaattgtggggaggtggcctcaggcttggcactgggcactgcaggtactgcccacctctatcagggcctaggacctgtggtactgtcagggcctgtcagccatcttatgccttttcctggacctctgctgggatcgcctacaacctccttccccaccggtcctgcacctaccaccagcagcaccagcgtgatcgccccactcagttcttgaaggtacacagaatagccttgaccttgtggcagaggagaccccccctttttttggagacaggatcttctgtagctatgtagctatgaactatgtagataagggtgaccccacatttcccattctcctgcctctacctcccgagtactgagattcaggcatgtattgctatgcctgacattttccttcctttcagttttgttttgtggggtttgttgttgttgttttgagacagggtttcactatgcagcctaggctggctttgaattccttatgtagtccagactaagctccagcttgagatccttgtgcctcagttcctgagtgctgggattacaggcatgtgctaccgtgcccgtttctccctcctcttagagccactggcctttacagcccaaccatctccttgccctgcacccttaaagattttgtaaaataaaaccacctggagacatgcgctggtatttggttaaataaatgtcagtgtcaagtggagcatg

SEQ ID NO: 1087 - DNA, 1242 bp, Mus musculus
atggattttcctggtctaggggccctggggacctcagaacccttgccccagtttgtggattctgccctggtgtcctcaccatcagattccacaggtttcttttcctctgggccagagggtttggatgcagcatcttcttccacttccccaaatgcagccacggccgcagcatcagcactggcctactacagagaagctgaggcctacagacactccccagtctttcaggtgtatccactgctcaacagtatggagggaattcctgggggctcaccttatgctagctgggcctatggcaagacggcactctaccctgcctcaactgtgtgccccagccatgaggatgccccttcccaggccctggaagaccaggaagggaagagcaacaacacgttcttggacaccttgaagacggagcggctgagtccagacctcctgacgctggggactgcactgcctgcatcgctccctgtcaccggcagtgcttacgggggagctgactttcccagtcctttcttctctcccactgggagccctctcagctcagcagcctattcttcccccaagtttcatggaagcctgccattggccccttgtgaggccagagagtgtgtgaactgtggagcaacggctactccactgtggcggagggacaggacaggtcactacctgtgcaatgcctgtggcttgtatcacaagatgaatggtcagaaccggcctctcatccggcccaagaagcgaatgattgtcagcaaacgggcaggcacccaatgcactaactgtcaaacgaccactacaacactctggcggaggaatgccagcggagatccggtatgcaatgcctgcggcctctatttcaagctccatcaggtgaaccgcccactgaccatgaggaaagatggaatccagacgaggaaccgcaaggcatctggcaaagggaaaaagaagcgggggtcgaatctggctggagcgggagcggctgaaggaccagctggtggcttcatggtggtagctggtagcagcagtagtgggaattgtggggaggtggcctcaggcttggcactgggcactgcaggtactgcccacctctatcagggcctaggacctgtggtactgtcagggcctgtcagccatcttatgccttttcctggacctctgctgggatcgcctacaacctccttccccaccggtcctgcacctaccaccagcagcaccagcgtgatcgccccactcagttcttga

SEQ ID NO: 1088 - DNA, 27756 bp, Homo sapiens
  misc_feature (3029)..(3702): "n" at positions 3029 thru 3702 can be any base
agcagctttccatctctgctgtgactgcaggccgtatttgtcacattcttctctgcttattttatgttttacagcaagattctctgcagtcattgccatggggagctggacatgctgatctgttaatcctatccataaagaatcttccagcttgatatctgatccaagcttggttccaaaacacacatttctgacacagtagggagcttggctcatgcttttggttcctccgcataaaacaacttcagcttctttaacacaaatttcctaacacctattcacagtggactgaaaaccagaaccacagagcctattaatcgtgagagctggggtctcctttgggattcccacacgcaaaccaacatgccttgccaaaaaaatatggaacgcttcacgaatttgcatgtcatccttgcgcaggggccatgctaatcttctctgtatcgttccaattttagtatatgtgctgccgaagcaagcatggagatgatttttttaaaatggttagattctggagatattttgaagatagggactggatgagttcaacaaaaaagaggatgtcagctagagaagaggcctgaggacattttgggttctaaaacaagagaagggacagacagatgagtcaggcaagtgggaagggaagtgtgtggattcctgagtgaaggagtgatggatggaggagcatgcgtgagagtctcctgaagtaaaggagcccctggtcttctggactctggtcgctaaatagtcttcagacggtagttcagccagaccctgtgactgaaccgccaaggagccccaagagtgctgcgaagagagggagtgtgaggatatgagttttagcaagtaaaaggctttcctaaaacctgtagcattttctggcagtggaaaaaaagaggaaaggggttttctgcctcattctaaaagacaatttgccatggacccagacattatatgcctgaagatggatgatttatggatgaaaggaaagagaaaatgaaggaatagaagaaggaaggaaggaacagatgggtggatgggtgagtgggtaggtagatgaatgaatgggtagatgctctgatatttcctccctcctcccccgagaaactccttcacaggtgtgcacagagagaggaatatgagtttatgaattgcagatttgctataatagggaaagaaactagaaacaatgcaaatgttcatcaacagattagtggttaaacaaaatgtggtatatccattccatggaatattactttcaataaaagggaacgaacttatgaggccagcattactctgatgagaaaactagacaaagatatcacaagaaaaactacagaccaatatctaagtatagatgcaaaaatcctcaaaaaaatacaagtaagtagaatccagcaacatataaaaggattatacaccacggccaagtgggatttatcccaagaatgcaaggtttggtcaactaatgaaaatcaatcaatataatgcatcatattaacataataaagaacaaacaccacatgatcttttcaggagatgcagaaaaaacatttgacaaaattcaacattccttcatgataaaaacactcaacaaactaggaatagaagagaacttcctcaacctgataaaggacatccacaaaaaacccacagctaagatcatacttaatggtgaaagttggaaaggaacaacacaaggatgccccttcttaccatgtcttttcaacactgtattggatgctctacctggggcattaggcaacaaaaagaaataaaacgtatccatattggaaaggaagaagtaaaactatccctatatgcagatgacatgatcttatacatagaaaatgttaaggaatccaccacgaaaccattagagccccattagtgcataaccattagagcaaggttgcaggatataagattttgtatcatatatgctagcaattaacaatccaaaagtgaaattaagaaaactattccatttacaatagcttcaaaatgaataaaatacttagtaataaaatgaatgaaagaagggtaagacttatacactgaaaaccataaaatattattgaaagaacttaaagaagacctaaataaatggaaagacatcacatgttcatggattggaagactttatagtgttaagatggcaatactccccaaattgatctacagacttgatgcaatccctatcagaatcccagcttgcttctttgcagaactgacaagctgattcacatgggagtgctaggggcccaaaatacaacaatcttgaaaaagaaaaacaaagttagaggactcacaccttccagtttaaaaacttactatacagctacagtaatcaagaccatgtgctactggcataaaaacatacatataaattaacgaaatagaattgaaagtccagaaataaattcatacattataggcaactgatttttttgagacagggacttgctctgttgcccagtcacaaacatagctcactgcagcctcaaactcctgggctaagcgatactcccacatcagcctcccaagtagctgggactacaggcatgcaccactgtgctcagctaatttttaaaaaactttttgtagagacagggtctcaatgtgttggacaggctgaactcctgggttcaagtgatcctcccacgttggcctcccaaaatgctgggattacaggtgtgagccactgtgtccagctagcaattgatttttgacaagtgtaccaagaccattcaatggggaaagaatgctcctttcaacaaatggtgctgagacagctgagtatccacatgcaaaagaataaagtgggaccccttcctcataccatatacaaaaaacaactcaaaacagatcaaagacctaaatgtaagagctaaaacgataaaacttttagaacgggggtccccaacctccaggccacaaacccatctgtggtctcttagaaactgggccacacagcaggaggtgagctgcggcttgctgccattcatgaagctgagcccgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctacagaagcacaatatttgaaaatcacatatctaaaaaggagtctagtatccagcaatacataaagaactcttactactcaacaataaaaggacaaataacccaattcaaaatgggcaaaggatttaaataaacacttctccaaagaagataaatgggctgggcacggtggctcatgcctgtaatcccagcattttgggagactgaggcggatggatcacttgtggtcaggagttcgagactggcctggccaacatagtgaaaccccatctctcctaataatacaaaaattagccaggcatggtggcgggtgcctgtaatcccagctactcaggagactgaggcaggataatcacttgaacccagcaggtggaggctgcagtgagccaagatcgtgccactgcactccagcctgggtgacagagcaagactacatctcaaaaaaaaaaaaaaaaaaaaaaagaagatagatgaccaacaagtttatgaaaatatgctcaacatcagtggtcacagggaaatgcaaatcaaaaccataacaagataccacttcacacccacacccagtaggatggctagaatcaaaaagagggacaataaaaagtgttggaggccaggcatggtagcctgtaattccagcactttgcaaggccaaggcaggcagattgcttgagcccagtagtttgagactagcgtaggcaacgtggcgaaaatcccatctctacgaaaaattaacaaaaatttagctgggtgtgatggcatgcacctgtagtcctggctactcaggaggttgaggtgggaggatcacttgaacccaggaggttgaggctgcagtgagcagagatcatgtcactgtactccagcctggggaacagagtgagaccctgccaaacaaaagaaaaaagaaaaaaaagaaaaaagaaagaaagaaagaaagagagagagagagagagagaaagaaagaaagaaagaaagaaagaaagaaagaaagaaagaaagaaagaagaaagaaaagaaaagaaaagaaaagaaagaaagaaagaaagaaagaaaggagtgttggagagaatgtggttaaatttaaatttgaatccccatatggcagctgtggagaacacttgcagttcctcagaaagttaaacatagaattaccatatcaccccgcaattccattcctagttatatacccaagaaaacgaaaaacatatgtccacataaaaactttcacatgaatgttcatagcagcattatttgtgatagccaagagtccatcaatgggtgaatggataagcataatgtggcatttctttttccttttatcttttgagacagggtctcactctgttgcccaggctggagtgcagtggtgcaatcatggctcactgcagcctcaacttgctgatcctcccacctgagccccccaagtagctgggaccacaggcatgcaccaccacacccggctaatttttcttttttgtagacacgtgttcttgctacgctgcccaggctggtctcgaactcctgggctcaagcaatccacccacctcaacctcccaaagtgctgagattacaggtgtgagccaccgcatcctagctataatgtagtaggtattttcatacaaaggaatattattcagtcatgaaaatgaatgaagtactgatacatgctacaatatgaatgaaccttaaaaaacttatgtgaagtaaaagaaggcagttacaaaaggccacatattatatgactgcatttatatgaaatgtccaaaacagacaaattcatagagacaaagagatttgtgatggcccggggatgggaggagagggaaatggaatgggagggtgtatgttaatagatatagggttccttttgggggtgatgaaaatgttctggaattaggtagtggatagttacacaacctcgtgatatactaatcgctttgctatacattttaagagtgaattttatggttaagagcaaattttatggtatgtgaattatgtctcaataaacagaaaaagaaaaaaaagaatgaactattgatacacacgacaatgtggaagaatgtcacagacattatgctgagcaaaagcagcacatactgtatgatgtgcttccatttccatgaagtgcaaaaacaggccaaaaaaaccccaggtatcatatggtgtttatgggtaccaacatatggagtgatggagtaaaaatactcatgaggaagataaacaccaagctcaaggcagtagaaggagagagggaaatggaatcagtacaagagcatctgtaatatcgcatatcctttaaaaacaatctgaagtcaataaggcaaaatattaatgtttgacaaaagtagatgcttgttacagcaccctttatactttccattttttaaaacagtcaaccaacagtttgtttctgagggcaaacgcttgactccttaaccaggctttggttgacatttgccttggtgcttttgacaccacagtctgtcaggctctgtccccaccctgatgggctccacagtacagaagaggcacaaacagtacaaatgccatggggcctggaccaagcaggggctctagaaccccagaagatgccaggagggagtgagccagtcagggaaggcttccgagaagagaggacattgaagaagagtctcaaacttaggcctgacggagaagacgcgcggccaggacaccccacccccgccctcgtctcccccaaagcctgatctggccccactgattcccttatctgcccactcccagctgcctccttgctggctgaactgtcgccgcagacttctgagcctgcgccccctccacggggatgggggagggaatggggtgaggcctggcctcacagcctcggggtttccagctcttgctggaggcagggctctggggcgccctactcctcacccttggcttctcttcctgagcgctctgtgctctccagaaatgaagaaatggggtgagtccagcggccaaacccttgtcttagctcttagacatgcctcgagcctgccattccctgtgaggacagatttccctatgttgcgaccgctgcttctaataataataatgatgatgataattcccatttacagagcacaccatttatggtgtgccagcaggccctgtgctgagtggttcctacccacgtggggggctaggactttacccgttttccagatgaagaaactgaggctcagagggcgtctggcccaggaatcacacagcaaatcacacagcaaatcagagttgagacaagaacccagggccctggaggaacatcttcatttccacacacctatgtagaaccagtctggaggtgagggcaattatacacacttgcaccacaaggagctggtgagaatgcgatagaattatgggtggagagcgcttagcacagtgcctggggtcactcagcaaataatgccgctgctgttattattagtctattaatgctattattaatatcagaattaaacaagcctcggcaacatagcgagacttcatctctattgaaaaaaaattttttgctgggtgtggtggcatgcacctgaagtcccagctcctcaggaggttgaggtgggaggatcacttgagcccaggaggtggaggctgcagtgagccaagattgtcactgcactccagcctgagtgacatagtgagacactgtccccaaaaaatatttagtacgtatcattatcactattgttgttagaattagaatagttttagaattagtgttagtattaataatagtattagtgttagattaaaattagtattagcattagatgagtattactatgaaaattagtatgtcctcatagaagtagagagtagaatagtggttaccagcagatgggagggtaggaggcagggagggatggggagaggctgtcaatgggtacaaagctacagttagataggaggcataagttctggtgttctaatgcatagtacaatgactagagtcaacaataaatgtatatttcaaaatagctgaaagaggcgttctcgaatgttctcatcacaaagaaaagataaatgtttaaggtgatgaatatgctaattaccttgatttgatcactacacaatgtatacatgtaacaaaacatcatgttttaccccatatatatgtacaactattatgtgtcaatcataaatttaaagaaataaaattagttttagtgtcagtatcaatattacaatattggtattactcttagtgtcagcatattattagcattagtactataagtagtagtagggttagaaagggctatgtactctcccttgtatgcagtaggtactcaataaataaataggggtacttaatatttattgagatttcagattcaagtaagttaagatcatgtaacatgggttaaaactcatttagtctccccagtcactgcatggagtggcttattggggtatattattaccccatttttacagatgaggagctaaattccagaggggatggtaactctcccaaggtcacctgatccattagtggttagggcagtctatgaacgaggatgagctggctctagagaccatctcctgaaaccactgccacttaagtcagaggtgtctttgtattcgttctccttattactgatgagggttcagcatggggcgtggcacaccagcaggagctcaataaataggaattcatgggcttgctctctttcctcctcaaatctcccattgcatatgaggacactgaggctcagaggagtgagataagaatggtaagatccctccagggtgggccagtgggcaagctgaccccactgacctggggctccacccttggcctctgccctttgtaggtctcagtctccccatctgtagactaggtgggcaggacagctccttgtcccacgtgtgcatgtgtgtcagatgctttcatatagaaaaagtgctcaggttaggtacaagtctatgtgaggtctatgagacactgtggttgttgtcattaatatttggaggaggtggggcagggcaagagtgtggggactggggtgcggaggcctagccacattctggttgtcccctgctgagggctgagggcagagccacaggctacatcaatccacatcctcccatcctacctgcatgggcaccacatgcccagggtgtgatccagtctgcctggaccttcttctgagtctgtctctgaatatccctctgtctctgtctcccttctcagttctccacttctgtctttggcctctttccctttcaggttttatctgtcacttctgtccatctctgtctctcattctctctttgcctctctctatatgtctttaatggtctctggttctccccgggtgtctcgccctctttgtctctccttttcttttgtgccctctctctgcctctttccacgtctgtctccttctctattcatctctgtcactctctttctccccatttccatctctctccgcctatctctgtttttgtttgtctctctgcctctgtctctcccactccacccctttcctttcctaccctatcccactcctcgaggaatcatccctggctcccacctcagtttcccgcctccaaggcagcatggcgggcaagaagttgaggccactgtccctgggtgttcctacccccacaccctcaccccaagacagcctgttactgcggcgccaacagccacggtcgcctacatctgataagacttatctgctgccccagggcaggccggagctggcgtaagccccagtggggcgctaagtgagtgtgcccctgcctcccgccagcactggcctggcctgcaggcttagcctgggtcatcaaggtatcccacaggctctagttcaaatccagcagaacctctctgagcctcactcttctcacctgcaaaatgggtacagccacatcccttctctccctgcagccaggaagacgcacatacacaggagtctagcccacaccggccccgcacaaattaagggctttactctctgaaaagcccagtgaagtcatgaaaccatatctgctattttcatttatcttggtttcagcctattttgcttgtctggacactacagtccacgggagcctaggtcgagcgaggtccaagaatccccagggtgggcagggagggtggaagagggcctccagtgcccaagaggtgccccacaagcatgggacccgccccctcccctggactgccccacccactggggcaccagccactccctggggaggagggaggagggagaagggagggagggagggagggaggaagggagcctcaaaggccaaggccagccaggacaccccctgggatcacactgagcttgccacatccccaaggcggccgaaccctccgcaaccaccagcccaggtcagtctcagcccccagagagcccccaccaaggcaaccctgggcctgctgcccctacccttatgcttgctccaggctccccaacccacagctggtccccaaagtgtcagccagccctgaatccctttacagctcctccaacccacctgtctttccaactcccatttctaccccaaatctaccccctaaaccccacctctttctgccctctcatccactccgtccaagatatctatatcctctggatcccttcactttgctcgctatacccctaggtctgtctcccctaaacactaactctgtctcccaaaacatgactttatctccccaaatcctttccctgtcccatatctgatttccactcacccaaacttgtctctgtctccctgacttctcctccaaacctcacttttctgctcccaaaccccttatctgctctacaacgccttgtctttgccccactctctctgagcccccaaacctgtctctgatctgccaaaccctagctccatcctcttaccaccatctctgcctttcaaacccactctttgttcccaatgacttctctctgatctccgcaaaccatttatctctcccaactccctgcctgctcagtaaaatatctttgtcacttcaaacaccaagtcaactccccaaaatctgttctgccgcatgaaccctcatgtctgccttccccaaaccgtatctcagccctaaaacacatctcattgtctccctgaatctctccagctccaagcctttctctactccaattctatcttggcttctcaaactcccctttactagccacattctgtctgcccaaacagatctttgactcctaaactccatctctcctccagaaaaacccttgaactccccagacttttctatgaccctcagaatctgactcccacactacttctcaactttatttctgactctcaaacttcgccccgatcccccaacctcgtctgttttcacaacctattcctgagcccaaaatgtgtctctgaacttccaagctcgtctctgctccacaaccccgcccatatctgcctccccacaaactccatggctacaccccaaacctctctgacttaaccccatatctgaccttcaaattccacctctatctccccctaagccccatatctgccccctagaccttatatctgctcccttcagcccggtgagaccctcccttgagggctgggattggaacgttacctggggtgaggggctggggccgagggagagtggagggtgccagctgctgcctgctgccgccgttggggcaacacttactctagtggggcagctgataaggagctttcatatcccccagcctcgagataaactttatctctgtccggagagtgataactgggggtgaggaggctgggcccctgccatgggaggggtgggcagccctggactcaccaacgtgtgaggtgcaggggttgggggcagtggggctggagggagatcatggtgggtaaggtggagttgaggggatgagggaatagtggtgaaagagtgagcagaagacacacaatgagacagggaagagagggagaaacagggagagatgggaagagagagacagagacacagagacaaagagcaagagacaaaagagacatgaagagaaaggaaaaacagagagagagaaactcaacgagtaagagacagagacagacagatggccggagaaaaagaaggaaagacccgggagcagaaaaggagatagaaatgcagagatacacgcaggtagcactgtgaagaggcagagactaacacagaattagagacagagaggaaagagatggagaccaagatggggaagcaaaacactctcttcagagagcaacagcaggcaccctggggctgagaaggtgttggcggtgggcacacttgtggcccatctctttcctagcataactcccaagcctgggcctgccccttagcctgtctataccatgggtcatgtaagcaggagtgaggggcagtttgaagacagccttctagtctagccctgtcactccaccctacagacacagaaacagagcaggccagcacaatagggccagggccagcattccaggctccttatcctgagctgcatgtggctgggtacggtcaggggtatgggactagtaagaggcacgtggacataaggtcagagggcccaaagagagggaaacagagggaacagacaaacaagcaggaagagtgggagagatgcagagatgttcagagagataggagaggagagggagaaagcaagagtaacagaaagagagagccagagagagaaacatgggaagacagaaaagaagacagaaaatcatcaaacattacaaaagcacagaaagaggtcgggcgcagtggctcacgcctataacctcagcactgtgggaggccgaggtgggccgatcacttgaggtcaggagttcaagaccagcctggccaacatggcaaaacctcgtctttactaaaaatacaaaaattagctgggtgtggtggcatgtgcctgtaatcccagctactagggaggctgaggcacgagaatcacttgaacctgggaggctggggttgcagtgagctgagatcgcaccactgcacaccagcctgggtgacagagtgagactccgtctcaaaaaaaaaaaaaaaagaaaaagaaaaagcacagaaggagaagacaagctatatcatagaaacacagaaagctggggaagctacagagtcagacttgagagggaacagagagtcaggggaaagagccccaggggatagagaagtggagagctagatgacagacacacacaaggcaaaacaggcaaagggccatcccacaggtctcagctcagccccagcccatcaccacccccaatacagcagatggggaaactgaggcctgggaactgaaagagcctgaaagcagaactctggtgggcctctccaggggagagggtaccggtagaggtacctcccacctgccaccctcttcagaggaagtcagtggccttggggtgatttcaaaagttgggcggggaaggcagagataagcagtggggggtactgacccccccccaaccaagaagtagggaggaactaagggggccttctgtctgtagacgcaacagaggtggagggaggagggagtcaagcccggaaaccatggggtttctgagaaagttagagggcaagatacaacagatagggatgaagttggggagcagaggatggtgaaccccaaagtcctgggtgaagtgaccaagaggcaagggactctggtcctgcatgccatcccaccctcacccagactcttctagagggggagggaagaaaggacggggggacggggagaataagaggaagtggaggaggggaggagaggagatggggaaagggagaaaaggatgaacagaaaagggaggagaaggatgaagaaattggaggggaggagaaaatgagtagtaggagaaaggagtggagagtagatgtagacaggggaagagaggccggaagtggtggctcacacctgtaatcccagtactttgggaggctgaggtgggaggatcacttgaggccaggagttcaagaccagcctgggcaacagagtcataccccatttctacaaaaaaaaaacaaaaactagccaggcctggtggcacacacctgtagtcccagctactcaggaggctgaggcaggaggatcactgccgggaggcagtggttgcagtgagccgagatcgtgccactgcactccagcctggcaacagaggagaccctgcctcaaaaaaaagtgtgtgtggatgggggagagggagataaggtgtgtgagaaaggtagaaaaggagaatgaagacaaaaagagaaggaggacaaggaagaggggaaacaggaaaggagaaggaggaggtcaaggaggaaaagaagaaggtggaggagaaaaaggaagcaggagagaatgagaaaagagtggaaagagaaggaaatggggaagaggggggcaaagaagagatgggaagaagagagacgggagaaagacaggaggaaaagggaaggggggaagaagagagagaatggaaggaagaagggagaggtagaagcagatgagagtggaggaagagcgagaggagggaggagaggaaagacaaacggcaagagggggagaacgaggaggaagatgaaaggaggggcacacaggagtggaacggggagatgcaggagggaaaagagaggagagggaggaagagaaggaggggaaggagaggggagactaaggtgaggaggaggggggaatggggaggtgggaaggagaaatatggagactgaggtgatggagtgggaggagggggaaaggagggaagaggagcaggtgaaaggaggtgggggggaaggatttctgtgtctgaggaccccttctgtcctcgcaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccaggtaactccattgagtggctgtcttggcattggctgagtgctgttggggttgccatggagatccttggctaggtcagaataccactgtgaggatatctcagaaatggctggaagcttctcaaatggatgtgccgaccactttccctagttaagtgcagacctgggaattccaatgctcctcaacctgccatattggggcggccacactgagaggcaatactggaagtatgtggtggttgccctagttgtcgagtgatccgtggagctccaaatcccaacagtcatcctcaaaaacccacttggaaatggtcagaggttattgcagaggccacactgaccagtgggggtcaggatccaggaagcatccaatggccagcagctgttctggtagcctgtggaaaagctgggaacttggccaccatgttgggggtgctgggaaccactgcaccctgacgtgcgctgaccctagactgattttgcctcttctttcctccatccctacctgcccccaacagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtggtgagaaattcaaaaaaggacagggaagttgaggtgggaggggtggcccaaagtaaagctgagctgagcctagctccctcttctcctctccaccccaccagaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctggtaagaccacagacctgcttcaccttatacacaggaacccctgtcctcaccctgtacaagaagccacatcttcccattatataggaacgctgttctcatgattacaggaagctactgcaggccaccctgtatgggaacccctgtcccaatatcacatggaaacccttgccttcatcctacacaggaaaatctcctcatcccatatggaaatccttgccctcaccctgcatgagaactcctgccctttccttgtacaggaacccagatctatagaagctcctatcctcaacctacccttataagcttcaaacagaaacctttgtcctcaccctgcacaccagtgttttcgtccttggcttcacactggaatcaccccaggtcccttctcccagatgtgctgatggaattggactgggatgctgcttgggcatcaggatattttagctccccaagtgattccgatacgcagccaaagctgagaaccaccaatgtagtcccccatagaatacagaacaaaagaaacttataccagataggaacccctgtactggccccatacagaatcctcaggcatcaccctgtaaacaaagccctgccttcaacctgaccctcacttcttgggtcctcctgacatcccctgtgagccccttacccccacttccacatccccagggcactgatctcacatcctgtcgtcccctagattgtcagtaaacgggcaggtactcagtgcaccaactgccagacgaccaccacgacactgtggcggagaaatgccagtggggatcccgtgtgcaatgcctgcggcctctactacaagctacaccaggtgacgccctgccccttggagccacccctctgctttccctgtcttcatgccacactgccccccactctgttcctgttctacctctctcttcccccacaaccctctttcctctttcccctttccctccttcctcccccttcccccatctcttctactttcccccttcctccatctcttctactttcccccttctctgttattaccctccctccttccttctccattccctcctcctccgccctcctccttcctctcctctcccccacctccaggcatcagctaatgtccaaccccctgccctagaccttgggcagctcctatcagccttggaggctttcctaagctcagggcctcacagcctcaggattccttggacaatctcagcacccaaaaattatcttaccctgaaagaagtggggtagagagggtgtccctggttgacacagagaggcaaaggtctggagttggggacacccgcagcctcctttttggcaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaattgtgggtgtgtctatgtgtggctgaacagcagagctgagtggagtgtgtaacaatgcctgtggctctctgatgacagtgcatggctgcaatgtgtgaccatgtgaggctggctgaggcggcacatgtgacactttgtgaccaagggttatgttgtgtgattggaacaatctatgtgaaacttcttgtgaagtgtccaggtggttccatatgtcatggtaagaggccacgcagggcttgctgacggtgggggtggtgccgggtgactataagcacactggaagtgtgtgtgctggagcaggtgataaggaggtgtgcggggctgtggtcttgtggctgggcatgacgctgggggacctttgagacggcatgacgctgggggaccttttagacagcatgacagcatacgtggtgggcacagaatctggtaaagattcttggaatgttgaacaagaagtgtgtgtcaggatgtgtttgtgggtctggcgatggcaatatttcagtgcaagtccctgtgcatgggcatgggtgtgcgtgtgtgtgcattacgtgtggcatgtgccatgtcacagtgtctctgagtggctgacaacatgagcagctctgtgtacatttgtttgtggaggtctcaacagcagagtttcagagggtataagttagggactctcttccaagggacaaaagacacattcaggaaaggaacacggagaagggtggagctggaatggtagctggcaaggtcagaggccagtgctggggcgcagggttgtccgtgggtcttcctgtcggactggtcttatcttgctcagcccagctcagcctgcagccctgtgggaaatggtagagaatgagagggggagattagggggacaaagcagcccctggaggtggtttcaacctcagtaggtggggcgctccacacagtgccaaccccttccccaacattcccactcacctgggtgaactgctccccccacagcggagtctgttcctcaatttcacaaacacacaggagcataatctgagtcatgccttaagcatcctaaggcagactgcttaagtggctcaatggaggccacacagccagtggcaaggggcccagcggggcagtctggcctggtgtccatgtgctcagccacaccccacagccagcagcaccctttcctaagggctcactgtgggtcaggcggcaggctgggaggctccagttgctttagttcattagtgcctgaaataaatattctgaggaaaatatacccatactcatttcactaatggaagagtgaggcccagaactgatgagtaacttaccctgaccaccaagtttaaggagtggattttggatggggtgacacacccagcccagcaaataagtgctgctcacacttaaccgctctttatggcttcttccctagagccccggatatgggggttgcagggacccacaggtcctgaccatattataggtaagcagctgtcctccacagaacaccagcccatcagctagcgggcattccagctccactaagtagcctgctgcagaatcacaggagtctattatgctcactgtgggcattgtccacaacagccctgatcccataaaagacacgtgtctggcctcccctcagaagcccagccctcacaccctgcaggaggccccatcctctaaaaacccccttcagaacctgtgctggacacatgcctggccccaccttgttcaggagccccgggcctcacccccataagtatagctcccccagcctggtacagaagactagctctgaagctctaggggagcccttcatctaattatcgacaggaaacccatcctgatcctgtacaggaatgccagcgcttaccctgaataggaggaacctctgcctaaccccagctagggacatctggactaagctgtaaggaagcccctgcacaccctggacaggaacccttgtcctgaccatccacacaagcctcagtctccctatacgaatcctgtcttgacctcagacaggaacacctttgtactcacactgctgcagtcctgtcctccaggtagcattttaaaaacacctcactcacaataatctgagtagtaaaccatggacccagctctgtctttacagaaatccctgtcctcaacctcttcaaggaccctgactgtgtgtggaacctcttgccttcattgttgacaatgatccctgatgttgccctgcacaacaatccatgacctcacaccctatcccatagagtccacaggaacccatgatccaactctcaacatgaacctcagtctttaacttgtatagaaaaccacttcctgaccttatggcaggaatgcctgtcttgaccatttactttaagccctgacctcagcctatacaggcacctatggcctcacctgatacaggacccccccttctcactatataggtcgcatttattgatgctgcacgaggctcctgggccttaccttgtattagctccactaccctgaccctctacagcaggggttcccaacccccaggacacggactggtactggtccatggcctattaggaattggtccacacagcaggaggtgggcagcaggcaagcaagcattaccacctaagctccgcctcctgtcagatcagcagtggcattagattctcataggagcacgaaccttattgtgaactgtgcatgcaaggaatctaggttgcgtgctccttatgagaatctaactactgcctgatgagctgaggtggaacagtttcatccccaaaccatcccccaccatccgtggaaagactgtcttccacgaaaccggtccctggtgccaaaaaggttggggaccgctgctctacaggaagcctgaccctaaaactgttccaggacttctgactggtctctgcagaaagcctttgtcctgaacctcaacagaaatcctttacttttacagtaatttatttacaggaatctctgtaatttacaggaatctctgatctttataggaactcctagctttactctctggaaatacactgcttaccctgaacaggaagcttaatgtgattctctataacagccttttccctggccttgtcccagaagccccacctgcaccctgtacaggaaccactgccctgacccaacaaagaaacaccgacctgaatctctgaaggggcagtgtcctaactacacagaggatctttgtcctgaacccgcacaggaacctctattacccccagcaggaacctgtgccctgagctagcacagaaaatcctgcccttacactcaacaggaacctttgatttgcctctttagagtaatccaaagaatgaaccagtataaaaaacctctacactgtacaagaacctctgttctgtacttgttaaacaacccataatcagaatcaccatgaatacctgcctggagactgtacaggaacccctgacctaacccccaatggaatcacctgatctgtctgtctctagtaacacagctctgatcctggacagaaatacctggcctgagtacgctgtgatcctctggcctggccgtctacagaaaaccactctcctggcctcaaaaggaacacctaaccttaatctgtatgggaaaaaatgccttcacagttttccctctcactttacaatgtctccaacctttgtatttccctgcaaacctgccttaccaggtaacagaatcattctcctgaccccagacaggaaacactaacctgacccagagatgctcctacccctacacagtaagagtccctgtctcaatgctttaaagagaaatttctatagcagtgctgtccaatagaaatatgtgagtcacacgggtaattttatattttcaatgtagccacattaaaaagagaaaaaaaagataaaattattttcaataacatcaatatacttaactttacccaatatattcaaatattattttaacatgtaatcaatataaaaattactgagctattttaaactttttatactgagttttgtgatctggtgtacatttcacatttatagcacatcatctcaagttagactggccacatttcaagagcagtagccacacgtggctggtagctaccatataggacagcataggtctgtggagtctacggaaccctatagcagacactgctataagctcattgagacctgttcctgttcttcctgagctcactctacctattccagcctcctctgcagatagatgtgggcacatgacagagttctgaccaatggagtatgggcaaaagtgacatataccagttccaggcctgacccataaaaatctctcatgcaatcctccatttcctctctttccctgtctaccaactgaaaaccaactaactccaaggacctagaggaggacagagtcacaaaatagagtttgcctgggtccatgaatgaacagtagtaaatattcagattggcttttgaatgagcaagaaataaacatttattcgttaagcccctgaaattctgggttacagcagctaggataatttagcctaattaataataatctctccccctctctctctctccttttttttttttttttttttttttgagatggagtcgcccaggctggagtgcagtggtgcaatcttggttcactgcaacctccgcctcccagattctcctgcctcagcctcctgagtagctgggattacaggtgtattagcccggctaatttttgtagttttggtaaagatgggatttcaccatgttggccaagctggtctcaaattcctgacctcaaattatctgcccacctaggcctcccaaagtgctgagattacaggcgtgagccaccacgcctggccagtaattttttttttttttttttgagacaggatctcactctattacccaggatggagtacagtggcacaatctcggctcactgcaacctctgcctcccctcccaggctcaagcgatcctcacacctcagcctcccgagtagctgggactacagatgcacaccaccacacccagctaatttttgtgttttttattgagatggggttttgtaatgttgcccagctggtctcaaactcctgagctcaagcaatctgccctcctctgcctcccaaagtgctgggattacaagtgtgagccattctgcctggccaataataatctcttgaccgaaatctagacacctgatctcactgtctatatgaacacaagctctgaacctatacagaaacacctgtgacccagtactggcccacctgatctctttgtaggaagctgtcataacataggtctaagaagccccatcctggccacgaatggtggctcacacctgtaatcccagcactttgggaagctgaagcaggcagattgcttgagtccaggagtttgagaccagcttgggcaacatggcgagaccccatctctataaagaaaaaaaaattaggcaggcatggtggcatgcacttgtagtcccagctacttgggaggctgaggtaggaagacagcttgagcccaagaggttgaagcagcagtgagccgtgttcacaccactgcactccagcctaggcaacagagtgagaccctgtcccctgtatcaaaaaacaaaaacaaaaaaacaaaaaaacaaaaccttaatccttaacttgcacaggaacaggaacccatagtctggagctctctagaaacccctgcttgattcagtaaaggtacaatatagaaaccataggaatccctgtcctcattctgtccaggaacatttggaatgacccaccagaggtacactagaagtgacctgaccctgcccatgaatccctgtcctcacacacctcacacaaaaggaatacctctccttaggaaaaaaggcccctaccctcaatcctgcaaaagaataccagccagatagagaccaaggcctgacactacagcacagatcggcaaactatggcattcaagccaaagccagactgtgggctgttttacatttttaaagggttgttttttaaaaagagaaaaaaagaaaaatgccactgagaccgtatgtggcctgcaaagcctaagatgtttactctctgtccctttataaagtttgctgacccctgctcttcagaaacctctcttctgatccaacagaaaaatgggccttgaccctttgcaagactccctactctatcaggctgcaggtatcagaactctagaatttttttgtagtgtgttatcattgtatgtgttttctttggtgagtgtaggggtttaaaggtcttaggtctgcaactcttttgcgctgagacaaaagataggttcacgtaggaggggtgagagggaagaggcggcaggacatcttcaagaggatcagagggcaaagctactgggcggtgagaccgtcaatctgtcagtctgatgcagaacccccggactgcttatctctccggtcccagcttatagcccggtaggaaatggtggagaatgagacagggagattaggaggacaaaccggcctcctgcagagctgacatttagacatggagtgggagttgcgggggagagggggtgcctagggacagctccccagacgcacacacactttctattactgcttgggagcagtggttacccgttggagggggcagatagggagagctgctgcccatgagaactcccatcctcaaggccattctggccctgggcactattattatcacaactttccagatgaggaaacggagcacagaactgttcagcaacttgcccaaagtcacatggttaagtcccgtaacctcagtttccttatctgcaaagcagccttaataatgggaactacctcatagaattgtggtttacaacgatgcctgtcacataatacttgctatcattaccattccctgcccccactaagactccttccactcagaatattgcggcagaatattaatagctaatattcggccagtgtttcctgtgtaccaccatagtgaatattaactcggaaaatcctcacatttagcatcgtcaccacgcctattttggccgccaccaccaacgtccagtggcaacctcgctctcggcccagccacaaccagcccgcccgcgctacgtcatcacggcgcgtcgcgcgggaagtcgcggggaaaaggtaagatgccccttcctaattccctcgcttccttgcttgctctccagacaccgccgacccgaagggctcctaagtgactggacagggacggaggggcggcggctatggcatccgggacgacagcgacgatagccgaggcaagaaaaagcttgcaccgcagccctgtcgggaaccgccggcgcctgccttttacgtaggcgcagcacagctggcgtagcacgccgacgcaccgccccgtcgcctgtgagctcgcggtgtggctcagcccagctggcgtagcacgccgacgcaccgccccgccgcttgtgagctcgcgagaggtgtggctcgcgcgaggggcgcggccttgaggcacggtcccctctggaggcgggatctgggcgggcagtcgagagacgaggcccaatggaaaagaaaagcctgagcgctcgcgtccccacaggtcgccagaaacttggtggagcgagccaagggcggagtttgagaaaggggctgcgtccaatgagtggagcggtgagtacagcgcgtcgacggcggaggcgggaagggggcggaggccgaccgaaggcggctagggactggctgaagagggttagcgaaacgttagcggtcgggtctgggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagtagaaggggcggtgattggttggaaagggcaggccctaagacggactgtgtgagcccgggggctcattgctccgtgaaagggcaagaccagggaaagagaatcgtgtaaaaggggtggagtctagcgggccgggcggggccgggtagaatggccacctgagtggagggagaaggcctgagagaggcggagtttggaaggctgtggagaatcagatcgcgtaaggaatggaatctaatagagggggcggagcctggaaaagggcagagaggtggggtcctcagggcacactagccccctcacatacccacgctcctccccccacccccagaaccgcggcaggggccaagcctcctcaactatgacctcaaccggccaggattccaccacaaccaggcagcgaagaagtaggcagaacccccagtcgccccctcaggactccagtgtcacttcggtgaggccctagacccgccctgatgagggggagagggagcaagttggtcatgccctggactctgacccttctctctgattcacagaagcgaaatattaaaaagggagccgttccccgctctatccccaatctagcggaggtaaagaagaaaggcaaaatgaagaagctcggccaagcaatggaagaagacctaatcgtgggactgcaagggatggtgagcagggcctggctgcagtttagcctcgtatgacaatcaaaacccaaaggttccccaccctggacagttccctctgactcagggcctaaaatggatctgtgtctccttttttttttcctctgcaggatctgaaccttgaggctgaagcactggctggcactggcttggtgttggatgagcagttaaatgaattccattgcctctgggatgacaggtgaggctgggtcctccaggctgtctccaaaccacaaaaatacacacacttagagcccattagcaagaataaatcttttcttaccccagcctggatactggaagcagatgatttggggaggtagggctcacacttgaaagggttcttttatgtagctaacaaacatttattgagtgcctattgtgtgccaagagttggtgatacaaatgtaccaaacaacagacaggggtccttctctaggagcggattgatgagtaggagggcagatcattaaacagccaacagcagtatgaggtgtttaatgaagacagacttaagaccaggggattcaagggtgtataatagaggatcctaaactagtatccgggcttcccagaagcctttatagaggaagagacgtttgtactgaaacagaaggatgaaacctcccgtttgctttacttttcaaaaagaatcagcaaatccttttggctatatgttcaaaatatattcaccatctgacctctcctcaccacctccactgccaccatcatcatcactcacctagacttgcagaggcctcctccctggtcccctacttccaacctcacctctattatctgttcatgcagcaacctaaaaaaatatgtatgagttgatgtctttgttaaaatactttaaggaggccaggcatggtggctcacgcctataatcccagcactttgggggggccaaggcaggtggatcacttgaggtcaggagttcgagaccggtctgaccaacgcgatgaaacactgtctctactaaaaatacaaaaattagttgggcgtggtggcacacacctgtaatcctagctacttgggaggctgaggcaggagaatcgcttgatctgggaggcggaggttgcagtgagccgagattgtgccattgcaccccagcctgggcaacaagagcaaaactctgtctcaaaaagtaaaaataaaaaaaaaaaaagtactttaagggcaaactgttgccctcaaggtaaagtccaaatttttcatcctggcctcaaaggttccacatgatctggctccacatcactttgtgacctcatcagccaatccttctcgc

SEQ ID NO: 1089 - DNA, 1498 bp, Homo sapiens
gcaaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctg

SEQ ID NO: 1090 - DNA, 1242 bp, Homo sapiens
atggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatga

SEQ ID NO: 1091 - DNA, 61265 bp, Mus musculus
  misc_feature (653)..(807): "n" at positions 653 thru 807 can be any base
  misc_feature (47360)..(47753): "n" at positions 47360 thru 47753 can be any base
  misc_feature (59683)..(59755): "n" at positions 59683 thru 59755 can be any base
  misc_feature (60724)..(60922): "n" at positions 60724 thru 60922 can be any base
atagtgaaactgtctcaaaaacaaaaccagggctggagagatagctcagtggttaagagtattgactgctcttccagaggtcctgagttcaattcccagcaaccacatggtgactcacaaccatctgtaatgggatctgatgccctcttctgatgtgtctgacagcgacagtgtactcacatacatgaaataaataaataaatccaatttaaaacaaaacaaaacaaacccaaacaacaatatggcctaaagttatagattcattcctttgtctctgcccttaccaagtgtatgttttatgaagacacattttctagaacaatgcctgaagcagcacacttgtttactggattcccttccagggactcaaactagggcctcataaataaataaataaataaataaataaataaatggagttttataattttatgtgagtggatatttttcctgcatgtaaaccagggcatccctgagaccccagatggccaggaaaggtggaaggatcccctagacctgcagttccagatgggtgcttgggattggatccgggtcctctggaagagcagccagtgctgctaaccatgcagtcatctctgcagccctgaaggaagcttgagttaggaaggagagcactgagagtacccatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgctgaggctgagttaggctagcaagtaaggctccgcaggtggagggagaccagactcctggcaactgtcctgatcaccacatctgtgctatagcaggatcccctccttccccattaataaaccaactgtgatttgggtttaggttgggtttgtttttgagacagggtttctctgtgtagctgccagtcttgttatccagtggttctcacctgtttaccagtgtagtggggctctgcctgctgaggatctttgcagacattttagaatacatataagcaaatacatacacatttcttccaaaaacagaatcatgtcacaaattgatctacatgtgccattatcttttctaagaggatttgttggtgcctggtgtctggcacacatccctttaaagcaggcagatctctggtgaatttgaggccggcctattctacatagtgagttccaggacatccagggctatgtacagagaaaccctgtgtattagtgtatggggtggggacggtttggcagctttctagtttttgtttgtttggcttgtcagtattacaaggttgtttatctgcaatgggtaaagtttcacttgttccaggcagatggggtttgtagctgtcttaatcctaagggggagatggtaatgaaaacagacatttgacatttaggtgtcagcctgtgcagttgtaatcaggtataaactgtgtcaactgcagtcataatgacacattctgatgcatgccttctcatccgtaactcttcagtgtctagggggccaagtcatcactcatgccatagggacacgctggataacggcattcttcgtaatgcactttaatgaaagcaacagtgttctttttgaataaacatttacagatttcttccctagttaggtaacttaagtgttttttactgttagaggtaaaataatcttcaattggacatagatttagctcatctttttcacaactgtgacattcatatagtatgcatttccaaatgtttgcactttcatgattattcacttgaggaattgtttttttttttttaagattttatttatttatttattatatgtaagtacactgtagctgtcttcagacactccagaagagggagtcagatctcgtgatcggatggttgtgaaccaccttgtggttgctgggacctgaactcctgaccttcggaagagcagtcgggtgctcttacccactgagccatctcaccagcccgaggaattgtttttatttgtgactggagagattgctcagtaattgagagcactgactgctctttcaaaggatccaggttcagttcctagtgcccacaactatctgtaactccagtcttagaggaactctctggcctttgtaggcaccaggtatgcatctcgtatgcatatatacatcaggcaaacacctatgcatataaaataaaatcattttttaaaataagagcatatttttaaaagaaacatttttatttagccacactgttaatttagctctaccttatgcagcctgtggatatttgattcacagggagacctgtacgcctccgtttctgatcgcgacttttcattccttctggtggtttcccttatgaagtgaagcatgactggttctttgtacacttaaacctttccttccctctgctaaagcatttcatgtttccctctaaacccagctgcaaacgtcagactttccacctgtcaccttggcatctctatcgacccctctcctgcttcactttgaaactcaggacgcactgttattctctctctcccaatctttactgttgcccagtgcctctgaaaggcactagtgaacacgcagactcagcacttcatgtccgtcgtttcaaaacaacctttagccaaatactcattcttcagaaatgtcctctcttactctaagcagcatctgcagaagagtttgaagttatagtcacaaaattacagacaaagtactcagggaagtgagcaatcacataataaaagatggtgaaaaacactactaatgtctaaaaggtctctgtgacacactaaaatttgtccatagctgctgaccaaataatgacctagaaattccatcatcaaaaatctctcccaacgtagagtgaaaggacagtgatggaaaggagagaagcggtggctccagccacatctgctgcttgggagaccgtgcagtgtgctctgactcctggtgcctggatgctgactcatcctggccctctggttggagtcaggcacctacagcattttaaaagctctgtgggtgatcctaatgctggcagtgttaaaaaatgactaagaaacctgaacggtaagacaggtctgacatctctccaaccagacttcagggcagagggccagattactgcagtgtctgtgcggggagacctgtaaggatgggagacccatcggggctgagggaagacgataacacctgggtacctctctgcttactgtaattctgagaagcaaaaatacttttgtactttccatagggaaaatacaggagccacactaggagcaagagaagcctgactggtctatgggacccaacataggtcctgctcttggcccctgagttctctagtgaaccccaagtctagcgctgcacttgtaatgccctactccatggtcagggcaccagggaagtggtttgcttctctgttggatccattgatctcgtctgctttctattccccgacttctcacaatcagtgctgcatgcctaccttttgttgctgttttctggactattagggtattacagacttactggacctgagcttgtcatgtcccttcagtgcagaaaacagcttgtgtagtatgaccttgagaagcaaaagcttcaacctgcttgaagcccaggagggtaaaatagtaagaggtaaaatactttattcagatttttctttattgcataatgttaccattaggtagtataatattttctagggtttttgttgttgttgttgttttgttttgctagcaatacaaccctgtgcctcctgcttacttaatcattcagaccaaaatgatgacacacacctttaatcctactgctcaggaatcaagcaggaggatctctgtgagttctaggacagcctaggctacatagagagaccctatctcaaaacaaataattcacctggctaaaccgccccagcaaagcaaagctgcactgtgagaatgtgttgggggttctaggcaaggagcgtctactttatctcttcccaggagaacagtcccgtgttgctcaactctgctgtggtggacatggagctgtgagggaaggggaggctgcttcccttgccagccagctcagcaggtcaaccctcacaacaacggagtgacagacagagccacattaccttacatccaaggcgagtgaatgaagaatgagtcctccaaagcattgtgtatattgaagactagactgagtagtttcaggctgtgaggtagcagagcctctttcttaaactgtctccttactggacctctcagagcccttggctgagaggctgatggaatcactcccagaaatccagctgaggatcgaggaaggacactgcaactgaggaagggaggaagacctcagagggacttgggactcaggactcggaaaggtgactccagctggctggctgcccttggctggctggccgctccgatacatctgtctgatcaagctgtttctgttgatttttcacttcttataaaagtatacatgcatacgtgtatgataaaatatactgctttagacatttaaatgttcctaagtggcattaagtacactccctcccaatattgtgaaaccatcaccggtcattcttttcatcaccccaaacagaaactctgtaccttacaacaccccctagtaacctttaacctactttgattctgagtttgactctgtatgtgttgtatacatgtgtatgtgttggcatgtgtctgcacttgtgtacaggtctggggtcagcatccagtgttgtaaaatgtcttcgtattttatttatgattggtgtgtatgcatgtatatgccacagcatttgtgtagaggccagaggatacttttaggatatggttctttccttccatgtggaatccagggatcaaactccagatttcaggcatgtgtagcaagcgcttttactttctaagccatctctccaatcctgcaccaactctagactgtctggccagcaagcccctgagatccttctgtgtcagcccatgctaccctcacccagcatgcaccactgtactgggctacaaactcgggtcctcacatgttcagcttgtgctctgacactgagcaattaccgtcgaatccccaacacgtacactcttattttcccatgatatccattctgatgggtaggaaccggaatctcttacagtgcttctttccctttaactggtcactgttgatgtgaaacatcttgtcattttctgcatgaatgtgtatgtgtatatatatatattttgagagattgtgtgtgtgtgtgtctgtccagtcccaccacctcagtatagaagaaagacatttctttgggaaaagtagctgaataattgtagtgtgtaatttcacggagctgtgtagttgtttcctctacctgtgtagttagctctttttttttttttcttttttaaagtgtatttcttgtctgccaataaataactattactatctctagctctaggttggaatgtctgagagaggtcagaggttgaattttaagtgaggattttccagtccattcttataacaaaatgtcaaaattgaggtccacttagcatgccctgtgttctgaggttgaggtatgcttctgtgctgtgtcttttctcttgtgtggagctgaaagctatagacaacaaggccaggagttggcggggcttagaaacactcgctgtggttcctcagtgcttctaacaaagaagctagggatgtccgatgggacaccgtggaggaagagaagcaccggtcacatgcacagactctgcaaagctcagggtagcttcccacgtgagagaccgtagttacctgaagttgtcagtacctgttgatgagacactgtcttctcatgtctctgttgtgtctcgggtcattgccgactggtactttggagggtgagtgcctatctgccatgtccataacaggagcactgggtgttccccttctggagcactggggtgcagtttccctcccttagctggtgcagtacagtacgctttatcatggattagtaatagcgttaggtaaaggtgaccagaggaaacaagactctgttagaaaaatactgatatttccctagcttttcttaaagctttttaagaattgtctttttttatgtaataccataaagcaaaaaggctacttattttgtttgtttacttataaaaatttatacttctagtgacctacatgaatttaaggggaaatgtttagaaaataaaaggatttgggaagggagttgctttggtttttgtttgtttgtttgtttgtttgtattttctttgtttggcagcttagtttttgttttttcaaaacagtttctctgtgtctagccatggctgtcttagaacttgctctgtagaccagattgcactagaactcacagaaatctgcctgcctctgccaactgagtgctgggattaaagttgtacaggatcaccgaccaacttagtttatttctttattccttaagatttaaatggctttgaacctggaaaaaaaaaaggttgttttctggttttccagattcctggtgcttctcttcctgtggacttggcggttctgttccaagtcagtctcagatttgcacgctcgcatccttaagttgatgaagttccttggtcaagttgacacttagcagaagcgacaaatgggttgaagggagttaagacttacatgaatagcaagccaagttgttcttttcttcatctttatttttaatttatttatcttttgagaatttaatatatgaatactgattttacatcatttctcctttaattcctcccatatccccttctcaaatttgtgccttcttatttgttgattattgttacatgtgtgtgcattcatacacttgggcgtgtgtgtgtgtgtgtgtgtgtgtgtgtgtgtgtgtatgtttacctatgaatacagcctgttgaagtcttacagttttgcttgtatgggtttagagagggtcttgtgtagctaaggttaatgctcacccctgatcctcctgcctccacctcctgagtgctcgtattgcaggcagcatatgctgctgtcaccagcatgggcctggctgaaaaaaaactgtttttttctcttttttaaaaattaattttgtgttgtctgcatggatgtcttcgaatcatctgcatacagagggcagaagaaggtatcagatcttctagaactgtgtaacggacagtcgtgagcctccatgtgggtgctgggtatcaaacatcagttctctgcatgctcttaaccatggagtcatctctccagctttcccattaagtatttttggaagaaatagcacatagataaagtccgcctccccttacatcgccatgaggcagtttgtctaattgctgctgtcacaggtttggttatggcgcacagtgcctgttacaaggatagttcttagatcagccccttccaccttggagtttttgagacagggtattcctgtgactaggctggcctcaaactaagaaatccgcctgcctctgcctcccaagtgctgggatttaaggcatgcgccaacacacccagccctagatccagcttcttaaatgttcctactcctgtctcctttttgcccaagatattcctaagcaatcccagacatgtgggcatataaaatagacatacaaggagaacatttattgataataagtcatagtttattttaaaacaatctttgctgtgcagatatttttactatttattcgagataagcaaatatgcacaccaaaagatggatatgcttgtttgtctagtacagttgagtccaaagatagactgtgttttgatattacctgccgagaggtggcagtaggaaatattaggtccttgttgtatgtccctaaaccatggtgtttctataagagcagaaaccgttgtgcgtgcgtgcagcagaaacactgcgtagctcacaatagcctttggtgtgagctgaggggctgtgagcagcaccgtttagcattgcatgatgcagtggcatgcatggtgaattgcacgtgtgcgctcagccgagtcccacactgtggcatggccagcactgccagcacaccgtggattccttgtgaatttattcttgtttgggtttggggccagtgtgtattcagaaagcattgctgctgctcagctggtctccccgggtgtgggctcaccacttcctctttagttatggtgcacatcacctgctaaaggtttatattgctttgttggaaaggccctctcaccttttctggtgggtaacctgtgggtgaggctggtgaatatttctcaagaacttttcacctagtgcctttaatgtgctcagtgcttctgtcctgttgtgttgctagaggcccacgtgtctctgaaaacctaccgaacctttcccaaggataagtcgatgagcagctccctccagatagttaaagaccattccctgctgtttaggcgcttcctataagctcacgcaccagatatgtgtcaccaagtcctagaagctgggggtcggccccccggtctagtttccctgattatctagtccagcattgtgctgagctaggtacttaactttggttgtttgtttgagaacagcttgttctaggctttcccctaccctgagccaaacatgtggaccttttattctggtataaactgtgctaggaaatccacacaggggctgggccctgggattgtgctgctctcttcgaaaatctttcagcacaacaaacagctcaacctgaagaaaacttagcttgtttggaaatgagttaaaacactcatattttagttgcccaattctcagttctattagtaaagcgggttctttacaatactgggagctgttttgtgtttggtttgactgtaagcagagggcccaccaggtgacttgactgagcctggagtctgtccttaccctagtgtggaatagctttagaagtggcccacagtgagccggttttggtaatgtccttaactttcagtactcggaacgctgaggagagagaaatgtccagtttgaagccagcctgggctacataagaacctgattcagaaaataattggcattgttattaattcttcatttccctgctcagtcaaggagcagtagaagataatcccggcagtagacaagtgtgtttcgtttagcctattgatcactgatatgcagattggctttgcaggagaaaaggtaacagccctcaggaggcagacaggtggatctctgttagttcaaggccaggccagtcgatacatttgagttcaggacagtgggtctctgtgaagcagagtttgtattctgagtacactgctctgagtaacagtttagagtgcctgaagtaggagcgaaaggcagccctccagagttccctgctgaagactgtaatatgcaaagcacacatcccgtgttctacaagaccctttatctaccaggagtgcttcataaatatccacatccagctgagaagagctaaggaagggtaaaatggcaaaacgacttgcatgggcattgtggatctggctcatgagagaaagaagagagagtaatcaaatgggtgtggctggttatggaaagggagctggttggtttgaccagtgtgtgtgaaggagagtggcagaacaccagaggcctctgttctctctcaacaatatggctgtaggagaagacttgttttatggttctgagagggcagcttctccctgtgttgtcctgttaaggaatataattaccggcaggcctgacttatactgctctcatctaggaccgtggctagacgggaaattgaagaagtgggtgatgttttatttccttgtctgatggcatcaatgcatgcccacagcaaatgcttttgttattgtttctgtgttttaactctattagtcttatgtaagcttagttctcagggacttttcaggtgtgttaagaagtgatactttgattgaaggaaatgcatttctcttggcaggtcttctacttacaaaggacaatgactactgatgagggcaccagtaacaatggagagaacccagcagccaccatgactgagcagggtgaagatatcactacgaagaaagacagaggagtattaaaggtaaggccacagaagtgtgaagcagggaggtctctgtgtgggagcttgtgggtgctttatgcagcctgtcttgtggacgggatagggttaagtagcaaacactacagctcacttcccatctagcttcatagctgggcgtaatctcagattataaatggtgcagcttccgctgggctgggtaaattaactcacatcttaggccctgcagaacaagttccagttatgcgttccctcaaaagaacccctccttgtttcagagggtacatgtagattgcagtttaatatgccatcttagtgtgctaaagctatgcagtgactgcaaaagagtctgtagagaaaaaggagaggacttagtttttatatacaagtactgtttctatgtgtcatgatgtaaggacacagaatatatatttggatcatcttccctattaaagtgtgtgtgtgtgatgcatttgtgtacacatatgatgtatacttgctcctctgtcaggatatcttcctcagtcacttttctaccttatttctctgtgagacagagtctgtcaccaaacctagaaggaagcctgtttgagtaagactgggtagccagcaagcctctgggatccgtttgtctctgtcctccagcactggggttggagacacactctttcatgattatggttttacatgggtctaaggaatctaagctcggatcctccttggaccagctccatagacatttttttaatttgcgtcttagcaacagtgttatgagatagtaccttttgatcatggtgggactgggtatggttcctagggtctcactaagttgccaggctggccttgaattacagtgtaacccaggcaggtcttgaacctgccatcctcctcccttagtctcctgagtagttgggattacaggattgtgtccccaggatgggccaggttctcgtctgtggttctgttctgaatctccatgcattcctcttaccttgctctgtgctgtcagtccattgagatctctttttcctgcagcttcttagcctggtagctgtaattcctcacccagagctcctggaagcttctcaagacagtggagattcttcaggctgtccgcagcgtctcctacctcatctttttcagtgtgctgtgttcagagaactggtctcccaggtcctcagaccctgtgtattctgtaaccaagtactgagtgattcatgagggagaagtttattgtggctcacagtgctgtagtctgagaagtccaggaacagagcattcctgcatcaccttgcttctagtaaggactcattatagagtgaaagcagaaggcaggcaggcaggcaggcaggaagatctgagaggcacaaggacacgtggacagctttgtacaacttgtgcggtgagcctagtccctccacagggagctcacagaggcaagaccttgattccacctaacttccctcctaaaggcctcgtatcccagcactgtcctggtagcagttgatccagtgtaagcttttgagcggacaggtcatattcaaccctcactcagaccacagtatccctccatcgctgccgagcctgctcagagctcttggataggcagtatgctatagtctcctttgtcctagggagtaagtctaagaacaacaacagttaggtttattataactgtgtggtttgaagctctttaggttatgacacctgttactgtctagaaccttcaagtcacctcagggcctttggtaaagagtcagtatgtttcacagctgtggcccggagatttgtcagcctccctgggttaaggcttctacttataaaatgtgtaataataataataataataaaagttggttttacatttttcatataaattaaaactagatttttatcttttaggcaagttaagatttaagcacaagtttcatcttgctgggaagatagacacacacataagagggcactatcacgtgttagctgctgtcttctgcaccactgaaatggtcccattggcacagatgattgacagaccgaattgcaccaccacacgcctgggttacattttcttttccaagaattgaccaactgcattagtatcttgctctgccaagaataaaagaagtagtctggattttacagtggataaatgtttttcattttgaagttcttttcttcttttttttcccttttcctttttctttactagaaaacaagctacttggtatcgtctaagtctatattttacagattattcaaataatggatgtttaaactgttacatcagagcatacagcagagcgtttggaccctatctttagcaaaggagggaagtaaatatgcccccttgactctttgctgtttaggaagtccagcagtcctttggctagttcagtttgtgtacctttgcctgctcatgagtctgtgttttgagagattttagcatcttggctttcaaccaaccaagtgaggtttactggctaattctgttttgccttggtggagatagggtttcacaggataatctagctggcctggaacttactgtgtagaccaggctgtctccgcagtgatccttttgccttgctctggctttctattttgagagactaaatattgtggtgagctgtaataatagtcataacacaaagggttagtgaaaggcagttttctaagagcaggacaaagaaagctgtgaggaatggcggtgaatctgcccatctgtctgggtgctggggagtagtccttgtggcctttgtatccttttacaagtacaaagctctacactttttttcttatgtttgtctttcagattgtcaaaagagtggggactagtgacgaggccccaatgtttggtgacaaagtttatgtccactacaaagggatgttgtcagatggaaagaagtttgattccagtcatgacagaaagaagccatttgcctttagccttggccaaggtaagaggacaatattttcagggtttgtgtaggtttgattctgtttttattttttatttattttttatttttatttgttttttaagagttatttatttataaatacctaataaaaatgaaaaaaaaaaagaaagttctagagatagatgtgcaaagagaagccaggcaactgttggtcgcgactgtggaaataagagctaggttgtagctgacagtaacccattatgaatatacttcatataactgggcataagactggataagatgggaaatttcatgttacatatatcttattattaccttaaaaaatgggcagatgtaaacctaattctgtccacatatacttggaaaaaaaaagatattgtaaataagagtaaaaaaaaaaaagagttatttatttattatatgtaagtacactgtagttgtcttcagacaccccagaagagggtctcagatctcattataggtggttgtgagccaccatgtggttgctgggatttgaactcgggacctgcggaagagcagtcaatgctcttaaccactgagccatgtcaccagccccatgattctgtttttatatttcacaataaacatggcaaacatggtccatggatccctaggtgtctctgtggtccttttgggaccatagtgtaacttctttctgtagcagtgtgaaggtgatgccgctttcacttgctcacgctcacactggcaacctaaaatctgcagaggcacaaactgcagggaccctcgtgggcatcagtgacagtcatctctggagcccattgtgttgtcactgcctctcctgttggctgtcatctcagtgcttccaaagtcgccctcaggaagcctgctacactttcagttgggaactgagctagctcagtgttgccgtgaacaccattcttccttgcaaaggcagacgatgactgttcagacttgagaggtatttcctgaaggagaatgagataaacctgtcacttcaaggaaaacacccgacagatgttgttgccgttgcagcttcaggtggaaaaccagttttaaaatatttgtggctgtcccatgcttaacagcttcctgagccgtaagacttctctgtgagagcggtgggtactaatgagtgtgacttgacttctggacagtgaggttcgtcactgttagagtgtctgcctaactcagttagccagtattttcccagggaccagtgcaatacatacaccgtcaagtgtggacaagcagtccattcaggctagaccagtgctgtaggggctgtagtgtgagaagccctttgatgcagatgacctgctgaacctcttttgatagtcatctaggaattctgtgacgctgccctcctgccttttcccaggtccttgtgagtttgttcttttctacatcttcagtcagaagcaagcaaatgacttcctcttggcttatatcaagtcaaacatttcacttttgtaaaattaaaaatgacagctgaggactgactggggtggtgttctgtagtgagagtgcttccctggcatccacagagtgagtttgatcctcaggtgcagtttccgactgtaatgccagcacttggcagattggaagcagtggggtcagaagcacagaggtgttcagttgaccacagaacagagaaacataagccagcataatggcacacacctatcttctcagcagttgggaggtgtcctagttagagtttctattgctgtgatgaaacaccatgacccaaggcaagttggggaagaaaaggtttatttggcttacacttccacagcactgttcatcattgaaagaagtcaggacaggaactccaacagggcaggaagctgcaggcagaagctgatgcagaggtcagggaggagtgctgcttactggtttgctcatcatggcttgctcagccagctttcttatagaacccaggatcactagcccagggatggcagcatccacaatgattctccccaattaaccactaattaagaaaatgcctacagctagatttaccgatgcattttcctgttgagtgctctcctcaagttgatataaactaactaccacaggaggcaaaggagagggccaagttcaaagctgtgttgtatttcacagcaagaccctgtctcaggaaaagagaaaaaaaattagctaggccatttagattttatattaaatattataacagttgctgcttcatcaaaataaaaaaaaaaaaaaggaagaagtataaatactgtctcgtgagctctctagtcccttatagtatatgtctcccaaaggagtatatagaaatattccaaagagacgttccaggctaattttgggattctagtatgacttcagtgttttgttttgttttaagatatagtcttccctgcctatcttggaactcacgatgtagagtaggctggcctcgaactcaaaagaggtctacctacatctcctgagtgctggggctaaagatatgcaataccacacctgggctgattttagtattttaaataggactattatgagcctgactataaaaactttattgaaaaaacacatatacaatagagcactgcccctcctcctgctgtatgcccactgccttcctgtactgactgagctcatcccctacactgtaaatgactgttcttactaccaaccgctgtgcaatgttgggtgaagatagcacacaccactatgtacatcagcccagcatagtgcacacctgggtgttattgttattacagcaaaagattactggtggctttaaagtttttactgcagtcacagtaaaaaacgattgtaacttcttgtgtcgtaactctccttactgagcagtcatataaaccttttgaaacaatgcttagccagtctttttttttttgtctgaggaagttgggaaagagaaacagaatcagtctaagacctggttgttagcgcagaggactgtgtcccaggatagaaacaggatagttcccctcctgtgcttacgttacttttgtttgtggtgccattgtccaaattgattttttttctctgaagcacccttccttgattgtgaagtactaaatgatagaaaacttcaatgtccagttttccttttctaaggatgtctcttatctcccttgctgaaaattactgagtatacacttttaaatatatgcttacatttaaactctgagtatgtttagagtctgacagcttgaaagtgttttgtttgtacctgaggaggcagaggtacagagggtcacagtgtctgctcacttgtgcacagtgagtcagccaggactcacaccccaggttgtgttcctgaagtttcttcattcccaaggtgtgaaacagtccagtccaggtctaagaacagccgcagcctgctcacaccagctgctttcctttttgcagtgatgcattgctgtttgtaggacttatagactcagaatgcatgttcttgcttgatgatattgtgaagttaacgtgtactttaaaagaagtgtcatactttctcataatactaagcctaaaagacattttacatcacagttaatacacttattaaaagtactgaaacttggtgatggtggcacacgcctttaatcctccacataatccaccatgaggccatatcacattttgtttcagtcaggtgctgaaggacacttgagttgcttcacctctggatcacggtggctcacacttgctgtgagcgtgtgtataaacatgagaccctctacacagttctttttgatcaccatccagaagtggactgctggatcatagctgagtcttgtgtttaaattcctttttctctaacttttatttatttatttatttatttatttattcttattttatgtgcatcagtgttttgcctgcttggtggtagctggggattaaaactggggtcctgagggaagcagcctgtgctcttaactgttgagccgtctctccagctctaatatttcttttgtgtttcttttgagacagggtttctctgtgtagccctggctgtcctggaactcactctgtagaccaggctggccttgaactcacagatcctcctgcttctgcctcccgagtattgggattaaaggcatgctccatcacatggaccatattactcagtcttaaaggagaggaaaagtctggcacatgctatatcagtgatgagccccaatcctgaaccccaaagacatcctactaaatgaaataatccaacccaaaaatgaaagctgtgtgcctccacttgtattacatgtctgtagaaaaaagtctttgctggtggctgagaggaggaggaggaaataaggtgtgtgatcaggtataaagtttcagacgagtaaaaccagaacgttctggagataggtcgcacagcgtatacatgtagtcacatcaagtgcacactgaaaaatgcttaagatgataaactttgtttaaccccagcgaaacatgtttgaagtcagaggagttacacagtaaaaaaaacactagtcagttattaataaagtagtttttattatcaagggaagtattagcatatttaaactatatgttttttaaagtattgtgtgggttttttaaccagaaaatgtatatatcactacagaagaaaggaaaaaatatagtccattgtttttatcctgggctagtgtacattttacttacatatttatttgtgtgtgttgtgcagatgtgtgtcatgtttgtacgcatgtgtgtggagttcagccatgggagctgtccatgctgcttttgaggaaggagttctctttggacctaggacttccccattcggcgccactggctgtcccgagccttggggtcctcctctctctgcttcccagtgctggccttagcagcactgctgctgggcctggctttaagtggagctgggactctaactcagggccttacacttgaccgctgagctgtttgccaacattgcctttaaactcagattgcctgtgtctttgtaagtacaagaggtatgaatatgtattctttgatactttgttacaaaaagaatagaactaaaatggaaacattgtgtttgaggtagtaaaattgaggtccagacccagatcaaatgtaggactcaatttttaaaaaatttatttttggaatattctgtctgcaagataaagatcctgaagatgaaggctctttgcaacattgatgcttgtggcccactggttctccttctggggactagacctacaggagtcctgccatagtgtttaaccagctccagactagcttttgctctagttttgtttgcagatagcctgagtgatacaactagttcccatgagctgagcgatatttcacacactgtgcccatgagtgcccttggcattggccctctccagccacagaccgccaggagcacactacagttgaacaatctaggttcagccccttccagaaaggatgcatacagtgggcagtacagggttggagaatgcatgtcagaaaggatgttggggtgcatgtcagaaaggatggtgggtacgtgtcaggatgttggggtgcatgtcagaaaggatggtaggtacgtgtcaggatgttggggtgcgtgtcagaaaggatggtgggtacgtgtcaggatgttggggtgcatgtcagaaaggatagtgggtacatgtcaggatggtggggtgtgtggcagaaagaatgttggtagtgttgtgggctctcgtgtggtctgggagagttctgaagaagcagaagtttgctctggagtagaaaggatattgagtaatcctgtgctggagaatgaagacttgtgcctagagcagagtgagacgatattaatctatggtgaggtgcaacagttgcccagagcagccaggagagggggctctttgatattttgtagggtgtacagtgaccttatcttttatccaagcttagatgaaaatttgaagtgttcttgttttgtctgagtttctgatggttatgcagtgaccttgtctgctgttggtgttttataagcttgactgtgtgcagtcagagactgatgtggccttgctccgagcccaggctcgccccagacaacggagcctgcagcgagtgtcagcacctggccatggccaaggactatgctttatttctcttaggaagagtctttaacctaactacccatgtatactttttccaagtattttgtttcagtagacttagaaaacatcaagattaatggtaaaaaggaggaggagctgtctgagagacttgtaggatactcatacagacttgttacgagcagtgctgaaagcattcttgaaatgccattgacttagaggtggataaacagttaaagtaagtcgccttcagagcccgtcaccaggagagcctgcatattgatcacctgcattgttcggatcacgttaaaggagtttttctgtaaccaggattggccatactcactgacagagccttggccactaacatactatgaattaataagctggccatattttaaattttaaaatgaagtatatgttgttttgcatgattcctcgcttttagtttaaattaatgtatcagccagacctggtcctatcagttacaggctttcactatacaaagaacgttagacacacgattgttttctggactttgatggtagcacaggaaagcagcgacctggactagagctggaatactgtggttaataaagggcacgtgttcagacaaagtcaagaaaggggcttttataatgtaaactatgttgagaagctacggagccaaataatgaatcatctcagttctaagaataggcgtgtaaaggtttaaaatataacaaacaaaaattatgtgtataatttaaaggaaattaaccaggaaattgacaatttccttggttgcaaggattcagaagttttcaaatggtgttctctatgtttcaatgttttcttggtgttgcttttcagaaatttgatcggggaactggtaaggtggtccccacctataattccagcactagagggggagacaggggagagcaaaggagaaggaggtccagggttagccttggtgacagaggagttggaggtcagccttggagcacataagattgtctcaataatgacagcagtaacaatgccaggcccttctgtagcagcacttgtgcactgcaggctcctggaagggacaagagaagggtgtacttttatattacagtatcatttcctaccagttcttgtgactttcacatgcacacatacaataagtaaagtagtccattttaaaagaagagtcagatagatggggctggtaaggtggctgggtgacctcagccatgacccctggagccatgtgaagatggaaggagaaaccaactctaccaagttgtcttctggtgacctccacatgtgcaccagggcacaggcacacgtcatacacaggtcatacattaatcacacaggagtgagacagaggagcgctggctcatttttttttaaaagatttatttattattataaataagtctgtccccagatgtactagaagagggcatcagatctcattacgggtggttgtgagccaccatgtggttgctgggatttgaactcatgacctttagaagaacagtcagtgctcttacccactgagccatctcacagccccggctcatttcttaagatgaggtagaagattacgagttgagactagctggactgtgtaataagaccttatctcaaaaggccaaaagagagggagttatatgtggtggtgaatgtgagggcagcagcttttctttattttactaaataatttattctttactaaataccagactctttgtgtgtatatactgtgccatgcatttggggtgggggctgttattatgttgtctgggtcaggaaacagattaaacttgcacaggtttgcaaagcaaacctaaggttggaatctggtactttgaacccctacagtgcataatcctccctttagtaatcaagaaagaaagtgaagctattaaataaaaaggagttcagaattgaatgataatacgctgccatatattgaggtgttggtttgtattgttttgtttaggtttttcaagacagggtctcactatgtagtcctggctgtcttggcactctgtatggaccaggctggccttgatctacccacctctgcctcccaagtgctgggatcagtcccctagaactgaagttacagacagctgtgaactgccaggtggttgctgggaactgaacctgggtccttgggaagagtggccagtgctctccaccgctgagccatgtctccagcccctaaatgagacatagttcatgctgcacatgataagagtattactcaagcatggtgcacacacctgtctgtcatccaggagtcctagacccagacaccatctgccagaattcagagttctaggccaccttgtgctgcattatgaggctgtcttaaactttcagaacaaagacttgtaaatattgacactgaacaggttgcctgctacaggtccataagagagcagtaaagctgagtttctcaagttggcaagaaaggaaacttcccaaatgttacagttcttatgatttggcagatctggggtttgtttgaagattttctttgacagatttggtttttgtttttgttttcttgttttctcttaggccaggttatcaaagcctgggacattggggtgtctactatgaagaaaggcgagatctgccatttattatgtaaaccagaatatgcttatggctcggctggccacctccaaaaaattccatcaaatgcaactctcttttttgaggcaagtatgtgtagtgctgtgcatgtgcggccatgacacggagctgcgctggccgctggcagcctgctccagcttatttattttggagcttggcttcttgaattgtttcccacacatccagggggtgtgccagtgctttcttagaaatgtgtctggcacaaagtgggcatatccaaacaaacaaaagtcacagatgtggaagtaaaagttctggtcagtagaggaagtaagtcatatgcatcctgacaggctggaaatggtggtggggagtgtaaagttgtgaaggtttccgactgtctcctcatatccatcaggagctgtgagtcgtggtccattgtttactgcgctgaattaattacacataattggccaaactggatctttatctaacacggtgaaagcacttctcaagtcagttgaaggccagtttcttaaatcttaaggtggcaaggtcacaagtctggggtgggaagcggttgtcctcagagtcagccaagactgttttgcgccagcaccttgtcctcctggccttttgcccacaaggcagttgtcctactatttcctgtctgtctttgcacggcagtcccacaggatgcagtcctagacggtgtcattacacggagttccttccaagaactgcagagtacatcgctctcatgtcccacgttactcttatctaagctgtatagataaagatgtagcttaaagttttataaaaataactgttaaactggctttcatctttgcattctagattgagctccttgatttcaaaggtgaggatttatttgaagattcaggcgttatccgtagaatcaaacggaaaggcgagggatactcaaacccaaacgaaggagcaacggtaaaaggtgagtagtgagtactgccgggagccagccttccctgaggaaggagacatgcttctaagagaaaaagtcattaaactgtctataagaagaagaaaatctatctaaaacaactagaatgattttcttgattttagcatgtatataatatttagaccaatattttattacacaagtctagtttgggtttagttattttcttcttgcagtgttataggtaacatgtcattcaggattggttctaaacaaagaagctctcaaccaggaacaggaaattgggatctaaggctggctctgcacctctgggcctctcctgcgccctcacttcttccaagactgaggctgtgctgggcttcttggtctcaaaggctctgcgagccccaaaaacccacattgggagtcgtgcttatgaaagtcgaaaaggctagagacagctgtgacacagccacttaaaagcttactcataacatgttttcatcgtttattatgaaaaattcaaatctatacaccagggtttttcctgtgctgtgggaactcctccagagtcagtgattcataacaacttgttttgttttgatttagtttttgagacagggcatttgttgagaccaggaagttaatagggccatcccctgtcccactctcgttaccatactaacttcttttctagtctggatacaaattcaaaacctggagctgcatttagccctcatggctttattctattccaatgaattagtcttccatctttgtttcctgtgactttgacacttttttgtttttgtttgtttgtttgtttgtttttcgagacagggtttctctgtgtagccctggctgtcctgtagaccaggctggcctcaaactcagaaatctgctgcctctgcctcccgagtgctgggattaaaggcgtgtgccaccatcgcccagcaactttgacatttttgaagacaactttccatttgctagagaatcccatagttgttgtcttatgcccacagggactagattgagctattagaaaatgccctgtgcgtggcgctatgccctctttagctcatcattatcatcatcaccaccatcatcaccatccctgtcaagaggcatgtggtgacttggcactggtgactgagggctagggtagagcctcccatgcttctcttttgtcaagttattctttgttgtgagtgctgagtgcttcagaaacggaatgctgggaagcccccagcctctccacagcgtccacaatgcactgcgtccacaatgcactagtgaggtctctggacagcagttatcactgtgctgtgtgattggtggtaactttctcattttacattcattagttggaattctactgcaaggaagatctgtctctcttccctgtgttgattcagccttttactttgtcaccaagcacctaggggtattgtccccctcccataggatgctttcccttgctgctcagattgccccagtgttgactggtgggaacaccttccttcctggggttcaccacattgctgcctgtgctttgttgttgttgttgagaacatccttaactgtttttgctttgtcttcctcactttatggtgctgtgagatgttctgagatcatgcagtttccaacgagctctgttcccttccactggaaaatagcatctagaaacagtgccgcatgctcatgtgtgtgtgtgtggcgggacttcatgttcctagagcatcttagcagacagctcggtaggacacttccaaagtatagacaagcctctgcatctgcatggatctctgtgtcagacacatttgtatttaaagatttatttattattatatgtgagtacactgtagctgtcttcagacacttttttcttctctctttggcccgaagattgattgattgattgattgattgattgattgattatgtaagtacactgtagctgtcagacacactagaagagggcgtcagatctcattacaggtggttgtaagccaccatgtggttgctgggatttgaactcagaaccttcagaagagcattcagtgctcttaaccgctgagccatctctccagccccacatttgtatttaaaacatgagtactaggcatagcaggtaagagcactgcttgctttctcagagaacataggttcagttctcagtgtgtacatggcagcccacaattgtctataattccactcccagggaatctcaagccttgttctagcccctgagggcaacaggcacacatgtggtccacaaacatacacgcaagcaaatgacccatgcacgtaacaacttcttaaaagctgtgagtacacacggtgccgtacagcaccacacgtttgttctcctcccctcatccagaacttctctttcccatacagccacagtgtgtttacgtctgcagtcctagactgcatcaggccacacattctggtaaacacctaagagtgtctgggtacagtggatggtaagacatggggtacatagggactttggaggtcttagtctcaactattgaatcttgcaattactgcctaatttacatcttcagacaactttaacacccttgagcatcaagttttcttgtgtgtaaatggggctgatttttcctgtttgagttgtgatagttgtggcacaggcaggggaacctcttatacaatgggctttcccttctaaccctctctgctgtgtttacataacttgttttgcttcctttacctggatctatggaaggagttcttgactcttcatttcctacacctaatccttggttaatttgtctctagtgacagtcttcattttgattttatatcatcttaatagtggtaggctttgttctgagtgagtgggctacatggaaggcctgctacatcatggtcttctgtgctgcttttatatttgtgaaaatcatttttttctcaaaacagtgtgctatttactcttatcagaattctcactcttacaaatcagccatgggttctcccgtgctttttcttgccagataaaatgactgtcttgtcgtttgtatttcagtgttgtcctttttccatcagatagagaaccagtgtgtgctgagggttagggggattgactatgatgactgacaccttagtcgtcacacttgagcttaggtgctagccctggctgcattgcagtgcgaaagttttgctgtcatgggcagtcgtattacactgaagtagggctctgagtagcccccatccgtctggtacaaacttgcattttgggtttcagcttgttagtgttggtgatgggaactgactgtgggagcgcaggcttgtgggctcctttaccccaggctttctgctccatttgactgtagctgcagtgtgtggtgcagctccaactgtaatctccaggttcctattctgggaatttttcttccctctcacctcctaacccgatacagtggtataggtggagaagggagagatttactctgtaaaaagagaaggtcgtggtggtccacaccttagaacctagcactctggaggcagtggtaggaggacctctgtgagttcaaggccagcctggtctactatcgagttccagggtagctcgagctacatagtgagaccctgtctcaaaaaataaaaagaagagagagacagagagagatggattagaattgtgaacttatgaaatatataaagtagaccggctcggactgacggaaactggattctataaatccaacccaaagcaggtgttgagaagacctctgtagaggtacataccgttcttcccaaccagctctggcagaactccaagctcacagtcagctggtgcaagggagccacagcaggctctggggcaatcatcagacctgctataaagcaatatggggcagccagccgcaccaggaagcctctgctgcaagaaatctcagtcttggctagtggggacgatctcagtgcccaagcctccaacccattaaatatatctcaggggagaaactggcagaggcaaatagtttttaaactccccagtgactctagtgtgcagccaaggtctgaaaatggactgcctgagggtctatctcactgtgatctctgctcaaaagctaaagcctagttctagagtgcagcagggagcctcagaggctgcaggggtcagaggtagactgcagagcagaggagtgtgcagtgtcttggaaattcttaattatgtactgggcgtggcagaaccccacaatagtaatgttgtgaagggttctttctctaaaaggaatcttttccatacatcaacagtaaggcagggcatccccaaccttttatatatagctgcctaataatacataaggaatctgcacctatatccttcacaatcaccctgttgggaatggactgtcatgtggcctgcttagatatcagtgacaggtagctgcagtcatttgaacatctttaggtgtatgtgtgcagatggtgagcattggtcagcaagtatgagacggtgtaagggagatgaacagaaaactcagaagtcgtttaagagacaattcagaactaacaaaaccaaaaacccatccacacttctgaaaatggggaggataaggaagtctggaaattgatgttcagtaacattgacctccagagttagaggagaggcgtgcgcgggcaggtcctctagtccagactggtgatctgagcagtgggcaagggagcaaggcaagaagtgggggtggggaagagtaaggaaggaggaaaataagggttcatctcatcagtcacagacagaaagtgtgttaagacttagaaagggcaggtgacagtgacaagcaggaagaagtagcttttcattcagttatactcttgatgaaattgctaaattcttacaagatatagtagaatttgctagaaaaatatccgggccagcaaaagaacacttgagggctggagcccaatgcctgacaccatgttgggtgacacacaatacaactccagttgcaggacatctgatgccctcttaggcccctaaggcatctgtacatgtgtgcatatacacatacactgactgcacacaccatctttgtttaaagctgacttagggtggtgtggtagaacaggggagagaggcccttagagttcattggccatccagtctagtcaaatcaataaattttaggtcctgtgacagaccctgtttttaaaatactaaggtagagcctagcatagtggcatccgtctttaatgccagcacttgggaggcagaggcaggtggagctctgtgagtttgaggccagcctgagctacacagagaaaccctgtctcaaacaaaaggtggagaaccactgaggaaaatacccagcatcaaccactggccttcacatgacatgcatgcatggatgaatgacagctgccaaaggcaccaggactcagaatgtcgacatggtcaggctatttattccttgtacttgaagtaagaaaaacatatctaaaattaaaagtagagtagaggcttcatgtatgttcatgctaatgtctgagtgagctgtgtgttgttcacatgcctttcaaacattgagtgatggctagcaaatgaccacaggaagaaagcacagggttttctttgctttttatcttaggttttgttttgttttaagacaaggttcctctgtatagccctggccatcctggaactcactctgtaaaccagctgtcctcaaactcacagagatgcctccgcctctgcctccacctccacctcctgaacactgggattaaaggtgtgtgacaccactgcccagcaaaatcacaggtttttaaaactatttcattgtgtctcagaaaatagcagtatattcttttcaggtgttttagaggtagatagctcctttttctagaaagtatctccaggtcttcaagtggagtgaatcataatagaaaaaaaaaaaaaaagaaagcaaaacaaaacaaacaaaaatccaagccactaatgaagtgttcattttaggatttcgtacaggataaaagctctggggcagtgctgcattgacagcctcctggagcttgttaaaatcagagtactggacagacaaaacaaaagccagtgtggtggtagtgcacacatttcggcccagcgctcggaagcagaggctgctggatcacaaatttgaggctaacctggtttacagagggcgttccaggacagcaaggactatacagagaaaccctgtctcaaaaaaccaaaaataagtaaataaataaggatgttgactgatagattcagaaaggaaaaatcctataaattggtgtaaattgccactgttttctctgctttcagattagtcattaagtaaatacttatataggggtcctgagctgtgtgctaagtgttgtggcatacaaaggcagtgtggagctctgggctggcctgctgggactcttccttgtacttgacaactgtgtgggacaaaagtgcattcttacagggatcctaaagtgttcattggagggcacctccctactaatgtgaggaataaccctgtatgttgttccctgagttcatctccacacccacacgtaatgcactgcttgcctatgaacagatgaatgaatgaaatgccagctctgttcaaatgctttaatgtagcgcctgtcttcttttttctcttttacaattaaaaaaaaaaatcagttgtatgcttatgcatgctttacctgcgtgtatgtctgtgtaccatatgtatgactggtgcctgaggagggcagaagagggcatcctatcctctggaactggagtgataggtagttgtgagccacttgtggctgctaggaactgaacccaggccctctctacaagagcaacaagtgctaacagccaagccatctgtccagcccctttgttttcttcagagacaaggtctcctgtcactaaggctggccttgaaatactggtcctcttgcctctctctgcctcttgagttgagtgataatcccccaaagtgcccgtgccactatgcccactctaaactcttagttatttactttgtgtgggtctgggactcatacctcgtgcttcaagagtgcggagtaagcactctactctgagtcctatcaccaagctcctcagtacttaaaactccctgttgttgttgctgctatgtgtgtttgcttgagaacaggtctcaccaggtagctctcaacctcccagctctttatgaagccctagctgctctcaaacaggctgggatcctcttgcctctgcttgccagacgccactacacttagctttggaatgcttcgcttctgctagcagtttcaggctagccaggatcatctcaccaacggaggagagaccacagacagagttgttaggcggcagaatgacactggctaatgttgaggtgtgctcaagtcctctgctgttgtaaaaggaagagcagttaagatcataaaagccattccagtagtcaggacccgcgcctgccctgggctagggtctggctcgcagtgcacccttcccctgagttagagcaggaagggaggctgtgtggggggagtctgagcaccatgcctgacaggaatgatgtccttgtggtcagtggttaatgtacctcgctgctttacaagagtcccggcttgccttcttggggcataataacatccactctcctgggaacccttgcccagtgtcattgactggtcccaccctgggttctgctagccagatgaccagtctttcctagtagtgatgccattacaacactgccgttcagagcccatcacccagtctttggggacgagtgcagagctatcagacaccagctactataattagaaaagggaaagcaggcgctcaccgagctcacatcttaggctggggcatttacagcactttttttaaaaagttgcagcctcttcctcagttttgcttcctgaaatacaagctgtacagttttggggttctcacatttcagtttttgttactgctgtatgctccccacccccattttaatcggagaacaaattgctgtcagcacatcgagttcatgtgccagccacattcagaacagggtgttctgtgctcttcaaaacaaaattgctctagggcagtaagagaacaataagtcagagctcagtttaagtgatgtctgcagtgaccagactcacttgatgtgcttacactctggattgcacagctgaacttggctagtttggtttgctttgactttgtggggtttgttggagtaccccccttacaggttacatagacttttaagtcaagagaaaatattgccagttttaaacttgtttgtttctctttaccaaaaaaaaaaaaaaaaaaaatccctaagaaaagcctcctgtgtgcacttgtgttcacttggagaccattgtagatcatttgcttcctgtaaatcatgctggatgagattagcagcagacctcctgagccctagaggctgagctcccgagtgagtcatggtggcttgtattaaatatttatgaaatgagtatttgtgctatggaatacaaagtcaaaagcacccacaggtcttccagagtcagagcaggggaagtgggattactaggaaccgggcgcctctgcatggatccgctcagagcaagtccttactgtgcagaggcctgccagggccctggtgctgcgagctctcgtcagcaaccttgcaggacttgtcacaccagtgttcagaagccaaacaatccagcctgtggtgacctttctccatgtacatggagacaatcatgggctgtgtttaccagctctgacccttcatttttcctgacttaacattccatcatgtcctgaagtgattggtgcatgcatgtatgtgtgaggaatcgggaatgtcacctaagatctctaatttgtattattatgtatgtaagtgtgcacgtagagtgagaagaaatgattcccctcttctaccactgacgcccaggtaataagattgggacatcaggtgcaggcaaccttgggctagctgctgattttccagacacaattggacaacttaaaaaatccacgtaactccatgttctagggctctgatgccctcttctgacctctgtgggcacctgtacatgcatagcatatagtcaaacacacacgtatgtaaattaataaaacctttttttttcctttttagatttttatgtgtatatctttttttgtctgaatgtatccatgcagtgcccatggaagccagaagagggcattagaccccaggagctggaggcacagacagttattacagttactggcttccatacagatgctaggaatggaaccccagctctgtggcacaagcagcaggttctcttccccactgtctccagccccagcaattgccttcctgctctgcctttgtcacatcctgactttctggttactttttgctttcttctgacattcattcatctttcctgcacacagcgatgcttagcacacggaaagagaatgtctgaaattttttacagactctgggaatctcacttaggtctttggttttgttttgtttttttaagatttatttattatatgcagctgttttcagacacaccagaagagggtatgggatcccattacagatggttgtgaaccaccctgtggttgctgggaattgaactcaggacctctggaagagcagtcagtcagtctgctgagccctctctccagccccctgttgtggatagccctggggctaattatatttgttaattctgttctcctgtgagtagtttagaacaaggaatgagtcagcactcaggtgatttcctgtaaacctgcttcccaccttaatttgtaaaataaaggagagctgatgattgggcagataaagggaaggtggagaggaaggtgagaagagaagaaggagaaaatgggagagagagaggatgcagaggaggagaaagaagaaaagcggagtagaagcacatggtctggagaaaccgcaagttctttttttttttccactttttattaggtatttagctcatttacgtttccaatgctataccaaaagtcccccatacgcacccacccgaaaccgcaagttctaagggatctcttagatggagaagatggcagtgtagcggtagatctgcccaaactaggcacacatcatgtattcatattaattgagttgtgttttcattgccggagcatatttgggttagagaaatttaccgcaacagcccccctccccacacacttaagatttttaattacacttttatatattatgtagataagcttgtacatagaggtaagacattccactctgcaaatcaggaaactgattggggatcctttgcagaagtctggatttcctgttttgaaaacacattcagatttgatcaaccaaaagccacaacaaatgtagttataatttcctccgtgctgaaggcactccattgtagggaggaaggtgatggtgtgacagtagacctcagttctcttccctcgaaagtctgttcagttggcagtgcccagactgataaatctcagtaccaaagagctgcttccgtggctcggcaggagttcctgcactcacggacagcaccatccattagtctaaattcagttatctggacaaatttaaaaacagtagttacatgaacttatagttttgtttgattggttcttccatgtatatttatttattgtggttgttgggacggagctcaggctctgtacctgttaggcaggtccctagcaccaagctacacttctttccctgcctctccctttacctctcatccttaggtaggctatggctgtctgaagacctgggcctacaggcccaagtcaggctcagcttagacacctaacctaagaaccaggagacaccacctcttctccacagagaaccccataagcctcagggtgtgcccaagcctctgatgctcacactttacaatatggttaattctttgtttaaactagaagatgctgttgactgcatctgctgccacccagctgggtgcctctgtgctgtatgcagcctgccttggttttgttttttgtttttcctgttgtatgtgcactaaaagtgggggggggggggctgtaagttagctgttttatctagaacattccaaaagttaatataatatatagaagtcatcatataaatgagtatggctataaaacaagagacagtaggcgacatctgagagctaggctgctgtagcctttgtcttgtaggaactgacttaggatttgacttgacagcagtaagagcagccaagatggtgtctttcctagctttagtgcgactctgaggtcctgatgtatagcttacggctgtttatcttccaaattttctctcatttctcaggcctagactaatggtgatccgctcagatgattaattaattaatgtggaattagctttgaagctagtttccaggacgaaacagtcatagactttgagggcttttaacagactgttgagatcagatagtaaaagtagagtaagttgtaattggattgcttggaagatgatagtatggaactaatgtttaagagagggtggtttctcaagactaaggcaaattactggcccaaaataagttaagcggccttgtcaagaaatattttaggaaattactatatttgaggtagaaactactcttcttgtcaaagagagatcatggtgcctatcgaactatctcacaagccgtccatttttcttactgagtaaaaggcctaattgaaaaggcacatagcatgagtattacaagtagttgagctggggggtcacttagtgcttgagtgatggccttattgcacaagtccctggagtctccatgaccacacaagagaactggatacatgcctatagtactaatgcgcttggaatacaggggcaagagcaagaagagtttcaggccagcctgagcacgtgaccttcatctaacatgtatgcagtattggagagctagcatggagaccttcatctaacgtgtacagtattggagagctagcatggagtcctaggctttatttcttgcttatatactttttcccaagcatctcaaaccaaaatactgtcacagatggttaagccattgtatgtattcaatactagatatatggcattctcctaatggtgtgtttaaatgagctagtgtatcttgactctgtgtcacagataagaaaataagtatacatttaacttaaaatggaaaaacttttgttcttaaactttcagactaggtgggcaaagcttccagaagacactgtgtgtcttatgaactgcaggggaagtagtgttactgcactgtgggccagtcacttggcaggcagtgctgaggggtggcttgtgactgtcctgtgtcctcaccctcagtccacctggaaggctgctgtggtggaaggacatttgattgccgagatgtggtgttcgttgttggggaaggagaagaccacgaacattccgattgggatcgacaaagccctggtgaagatgcagagagaagaacagtgtattctatatcttggaccacggtaagacgtgagcgcccgtttcagtgcagtgcagcccggccgcctgaagaccaaggactgcttgctcactctcattctcactctctcagtgccttgttggcgcagggaagccattgcattgagttgtgtgatggttagtctgaaacttggggcctcacaccaccatagaagtttgcgagtgagttggctcagctggagtatatctaagaataggactatcagtgtagccttgattttgatttgtttagctgccaggatgccacatcagcaaagattgacttgatcctgtggctctcctgctctgcttttctctgaattcagcgagggctttgggaactgcagtagtgcatgatttactacacttgaatccatgccacgttcttctatggagtccctgaaggaagaaagagccagcttgttcttcctggacctaaaggcagcggagatgactcatttttgcctaactttttcccgtcataaggatagccattagcactgccaagcttagaaccatccggcatgacagtctcctgtgaaaacatgcttcctattatttttagatctaaaattataccataaattcatctcttctatcttgagaaatgggcccctgaggatgcaggagtgctgcctgtgtgcaatggcatctgcttgttgccactgctaagactgagactctgtgggctgccctcaccaaagggaacacagtgcttttgtcctgtctcttgccttggaggggttttgctataattcactctccaataaagctatttcatttttattgaaagagctttccccccttacagagtaggttcttcataacctacagtcactaatctgttttttgtttgtttatgagatgtattcttttatgttgtagccctgactgccctaaaactcagtatgtagaccaagctggccttgaactcacagagatccacctccttctggctcccaagtgctgggattaaagttctctgattatgtttaatctaccattccaaaattatagtagctctacactcaggtatctcacgtatggtcttacagttcagttctttaaagatggctctgtaaagtctgagcattcagaaacacatagcccagatctaagttttaaccttgcggtagatgctttggagagcagacttaccaaacttaacagcagagtgaatcaaactgcctctgtttattagtgcagctagttctctgcaggtgtacagttcctggctgaacgactctctgcagcctaccagtggtggcacctgggcaagtcacctaactccccaagccttgcaaggttgcagaggcccacatggagtaatgaggcagatcacttagcacaccgccccaccctgcccattagctgttactgtctcagcgatggctttcattcattttccccttagaccacgagaaaatagaaatctctgcaacaaatggtatttttcaaatcttttcaggcataaaaagaacgtcaagttctcctacgttgtatataaaggggttcctcccctcattgggggtggggggtgtgagtgcatatgttagtacatctccagggcgtttgctggtacatggagttctgccaatacattctatgtaatgctctccatactgtctccatgtgtgtgtgtcacactgcccatgtaggtagagcatccctaagcagattggcttgtcctagtcagagtccaccgagtctgggttgcttataaaatgcagatggaattcgtactcagtgtcttctgcatttcccttctaccctaccccaacctcacccccaccttgacatctgtaggctccttggcaggacgttttcataagaaactaataaagcattcaagtttctctctctctggaacactatcttttcttggtagtgttctttagaatattgtggcaagggtgtaccctatttgagacattgcaccctcagattttttttctcaatttttaaaaatttgctgttctcctcaaatagataattaaatattgtgactgatttctatgtaggctaagtatagatgactactttttccttcctttttctttatacctgttttgtaacagtcccagacaaaccataggctgttgagagtggtcagtgtgtgtcagccttagttatcttaggacaggaaggtctgaatgtggttctgcctctatatcacctctcagaaagcacatgtctctggcctccgctctctcacctgtaagaagtagctggcgagggcattcacaatgctgtgttctgcagggttggctgtccctccacgcccttagtgtatcttccctccaaggcagctgccgtccagaggccttgactctggacttccatttctgatggttgtgagccaccatgtagttgctggaaattgaactcaggacctctgaaagaggtcagtgctcttaacaactggcccatctctccagcctgtaagtttcttttagacaggttttcatgtcctcagtactatggatgtttgtggtggatcccagttgtggcagaagagggttgtccttgtcccataaggtgtgcagtaatatgtctgacacctacctgccatccaatagcaactctaggcattgcttaatgttcctctgacaaagaagggttaaacatcaatccaggtaagtgacatggttccaaagtgatgccaggtcatctgtcatattctttcctccctggtaaagactgccaatcatagcatgctctcagcaacagacttgagaagtacccatctgtatgccttctttgcagcgaagagagggacagaccttaccacaggcaacacacacacattcatactccagggaaaaaaccctggctacgtttccaacattgccactggccattgctcccttttcgagtgatgccctctgcacggtgttaaggctgccacccagttcttccccagctctgtgtgcctctgctccagctgtgccttttcttttcttttttttttttttttttttttttttcgagaccgggtttctctgtatagccctggctgtcctggaactcacaactcactttgtagaccaggctggccttgaactcacagagatccatccatctgcctctgtcccccaagtgctgggatcgaagatgtgtgccaccaccttgtatttgtgccttttaaagtctttaatgccacgagactttaggatcatgagagctgttgtctctgctaatgtgttgccccctgcagtttttctgattggaggtagtactcttggaagttgacccttccttaaagtgaaaagcttgttttgagtacacatggacatgtgggaaagagttcctgtgggggagggagtggtgagggagctggggtaaaatgagaaattctatatacaagtacgaaactgtaacagaacagtaaaaacaattgtaataaaatagcaaaaatgttaaaagtattcaaacagaattatagtgatttttactactataataattatagtaatagactcttctgtcctttctgctcataaagcttaaaggaaaaaagtccttgtaaccaaacagaaaagaataaagtctaaaaccaggcatcgatattgaacagcatgctaagcacactgtcctagggagtacaggaactgtgcgcctgcgctaagagagcatgcgctaagagaacacgatgcagcaggtctcaggaaaccacagcagggattccacacagaaaaccaaagaagtataccagtcctcctgagtcttgttttttcctctccgtttcagctatggttttggagaagccgggaagcctaagtttggcattgaccccaatgctgagcttatgtacgaggtcacccttaagagcttcgagaaggtgagcaaacccaacttcgctaaagctgtggtgtggggtcttctcatcctgtgcctgtaactgtgcggtagatgacttggctaaatagtgtttgtttctgtgtttgcttttcttcatccatgactcttgtcccccacacttctgctccgagcgtgggaagctgacacaacacagttgatacaggagaggagctggtgttcttattttttactgtgtgttagcctctttttttcttttaacttttgggtagaatccaagacttgttcctgtatttgttcctaggcttgttctttttgtacttttttttcctgagttgaggacaaaaaagttcacgtactgccaagcagctccttaggggagttggggtgcagcctttcagtgctgaaggaattgcacactccacaggagttacaaagaggcctccgctggggctccaggttacaatcccagtgtctcagcctcgggaccagcagctgcaaccaaggagaagaaacaaacgtacccaggctgtttctcatacgtgtccaagaacaggagagggaacttgccgtggccttcaggctggtgtacctcctcggacagcctccaactctgggctgtctttgcaggctcccacctgtactgcacggtgtccccataagctgagtaagctgtcatcctcagctgtggctcccctcagagaccgcctttcttattacgattttattcctctgaaatgaccccatgctctgtccacgctggactatcggggcctcgagtttccctgccctttccatagtggaacctctacccttctccgtgctttgtgacaacatggcatgcctgccatctaatcctgtcactcgggaggatcagaagtcagtctcagctacgtagtaaatggaggcttgcctgagatacatgcagtgctgtctggaaaaaagaaaagaaaaagttccccaggtccacacctgcaaactgatcctgttagaggccatactgcatctggttctgtgaattcggagacagctgcctgaactgggattttagaagtgctccatgcacgtgcagcttggcctggaccataagtagcaatctcacttccaagctggaaagcaagcctgacagaaacagcctgctaacgtgacagcagcccatagtgagggagctttggggctccaggttacgatcccagtgtctctaaggagggaggcttgctttgtcaccctcaaaatgcagtctgtgagagtgctccgtgcttgtgttccttggacaacacaggtcagaccacagcttgctatggcatgtgctcttagtggaacaccggtgcattggcctgctggtatcccagcagcggcccacagttgctggggtctcatagagatcgctgctgtcccccaggcatgaactgctgcgtttcctcctctcctcagctaactgacgccacaaatctctacacaggccaaagaatcttgggagatggacaccaaagaaaagctgacgcaggctgccatcgtgaaagagaagggaactgtgtacttcaaggtgtgtgagtctctaagtcctttccatgtggggatacctacccagtatccatcagcaccctgtgctgagacgcaccctcagttctcacaggcctgctgtgctctgtaggaggattagtgagcagagtgagttcgtgtgcaggaggtaatgcagaggcctcttctgtgtgctgtgagcaggtggagcttcctcaggagcaggcgaggtggaccagacctggctcgctcgagtgtgtgtgtcccaggtcagagttcacaggggcggctccagcccgctcccccctgacaggtgagacaggaaaggccttgcagatcccccagttcactttggatgatctctctcaggttgccgtgctgtggctgcttttatgtaactacaatgaaggcaagtctcctcctgattgttttaattataattttcaattgaaattttttttaggctggagagatggctcagcagttaagagcattggctgcttttccaaaggttctgagttaaattcccagcacctacatggtggctcacagccatctgtacagggatccgatgctctcttctgacatgcacgtgcgcatgtgcagagtactcataaataaaataagtaaataaaaaataaaaacaaatcttaaaaatgttttaaaacattttcgctctttaaattaaaacagcagctttcacagcaaatatcctcaaaataaatgtttaatatttaaggttttatcaagaaatatatcattacttatcagtaccactattaactgagcaacaagataaagatgccattaatgatactggctgaggggctggcgagatggttcatcgggtaagagcactgactgctcttccagaggtcctgagttcaaatcccagcaactacatggtggttcacaaccacccataatgagatctgatgccctcttctggtgcgtctgaagtcagctacagtgtacttacatataataataaataaatctaaaaaaaaaaaaaaatgatactggctgggtaccaaaaaggccctgcagaccggcatggatgaccaggctcggccctcccaagaacctgatgaggagaaaacactgagccttgtggccacagtgataagatgtcacttacagctgccccagggaattactgcctctccagagccctgtctcctcaggacccaggaaccagtgctttatcccccagggctgacacccacactcattaagtgaaatttcggagtgctgtgcccattgcttgccagcccacttccaaattcctgctgtctccacatcaagtgaagggcttctcgatgagtgttcagagcgggcagtcttctgctgggccaagtgatgctgtgcaagtggctgactcctgtctctgccttgtagtgtggagacccaagccagaagccagctttgttggcacacctttaagcacagggctctggaggcaagtgtatgtatgtgagtttgaggctagcctggcctacagagcaaattccaaacaactagggcaacacagtgaagccctgcctcaaaaaaaaaaaaaaaaggacttggagggaacccaagttttctttgctttttctttcttttaccagcagtctttaaacacaattattggggtttttgtttgttgtttgggtttttttttttttttaagattttatttatatgtaagtacactgtagctatcttcagacactccagaagagggagtcagatctcattacggatggttgtgagccaccatgtggttgctgggatttgaacttcagaccttttgaactctggaccttcggaagagcagtcgggtgctctaatccactgagccatctcaccagccccctgggttttgttttgttttgttttgttttgttttttatagcactataaagcagagacctgaggctactcttcatgagcctctgtactgagaaatgctgtcacatctactactgacttacattagggggttggaacaagaacaccatgtgggacaactgcagaactatggggccatagtcacctcaaaagaaacactggcagagacagtgtgtatttgtaacaaagttataaactaacgtatgactcatgggcagccaagcagatggcgataggagccctgagcagggatctggaaatggagctgtcccttccatgtcattgaggccaatcacctgtgttgcagggagcctttcaggggtgataagtatatttcaacatgtttcaaatcttcctaaaatgaccaatctggataaaatctggatcactagtcacacatacggaacacattatttttaacatgtaatctgatagacaggatctttcaaaacatcagtctgttggggggaaaaaaattaatgaaaggttcaaaatcactgacctaagacttaccccagaatgtctctgaacattttgtctcaccaagcacttcctggaggctccttcctcattctaggtgaggagcaagggcaccgcccaccgccgccccacccccccacccccccagtcaggctgtctgcttcagaggctggaggactgccttctgtctgcttgtcccttctcccttcaaagtttaaggagcctttcttttggctgtgctgctctggccagcgtcatcttcccagagtatctgacgtgatgtgtgccatgtgcagagtgtgggtgactgtagggatgggctggactacagttctatgtcccttaatatctgcatgatctattcacctgccaggccagtttcagctgtgggcagagagggactgaatgtggtatttagactgatgttgaaacttcctttcaacctctgaacactcatgcagagacacagaaagcactgtcctcatccggttctgaaagttactgtcaggcactgtagcactgtcactgcacaaaggaaggctaaggacgctctgctgtgtgcgggcatcttgcgccccctagtgctccttgggaaggaagtgtggccgcggctggctgattgtgcttgagagctggagtgttgtaggaagagctctacatcgtcatggctccctctcccgagtgcagtcaggtctgccatcccttgtacagtcgtacaggaagggtcctctgtattcaagcttgtaattactgtgcagaaaagaactgtcacctatattccaggtttactcgtgttgttacaagctgccattccgtggtgcagctgtacctacagtagtcagcacgctgtctccaccccacagtttgttgtttagggcatgtgctatgtacaacattcagtgtttacaactctcagaactcagtagtaagcaggaccatatctagagtctggttactctgaaacagcgcctcacaggggtcacatatcagatatcaggtgtctacgttctgattcataacagtagcaaaattacagttatgaagtagcaacagaaaacgtttcatggttgggagttttatggttatgagaaagggggtcatagcgttaggaaggctgagaagcactgcctgggagctgaggcaggaagactgagtttggcactagacttgtcaatttagcaaggccttttctgtgtgaaataaaaacatcagcctagaaatagagcagggatggtgcttgcttagtatgcatgaggccttggtacggcggaggaggctgctagaccagacaagagcaggacagtctctcacacggtaagcttgctctttagggttatgtacactgtgtgctatcaatggccgtggtcagcacagggcattctggcccacccactcttaacaatcacatggtgccggggtagagccccggcactgcagctctgccgtgctgcctctgctttcactgctactgagagccgagcgtttgcacaatctgctttagacaggcctgctgtgtggggactgccagttaccatattgcagtatttactatcagtgctgaatgccaagagaaaagaggaaagtcacctcctcttccataagccaaatggctcaccatccttttgaaagactgaggaatgttggttccaaacagtgtaacctcctgctgccaggctgaaagaacactgaagcagccatgcggtggcattaccctggtccaggccacctcacaggccagcagagcttccgcagaactagggagggacaggagatagagtggggctgacatgcagaactattccgtgtgagcactcggctagggcaggccacgctcacacttcactgcatcctttccagatggatacaagttgttgggggcttttttctcctagggaggcaagtacacgcaggccgtgattcagtacaggaagatagtgtcctggctggagatggaatacggcctgtcagagaaggagtccaaagcctcagagtcgttcctcctcgcagccttcctgaacctggccatgtgctacctgaagctccgagagtacaacaaagccgtggagtgctgcgacaaggtgggtgagccgtacttcactctccgtttatctgtgtggcacctctgcccccttcaggctgttcctctatggtcagcatgagctgggacgccataaaggatggggctttttgtgcactacttttatcctgcattttacataaagccattaacagaattgataagagtcttcatctgtggtcttccttaccctggtcctttgtgggagaggagacaaagagccttgaggttccctctttattgttttgtttgcaaggctggggattgaacccagggcactgtgcatgctaggcaaacactttaccactgagccatacagcctacccccagtgacacacttcctccaacaagccacacttcctaatttctaatccttctaatcctttgaaacaattccattccctggtgatgatgtattcaaatatataagcctgggggggggggggggagacattcttattcagagcatttaccaccatggttaatgcctatggtctcagcatttgagaggcaaaacagaagaattgagagttcaaggctggcctgggctacatgagttcttgtctcaaaaaataactattatcaagatagctcagctggtaaaggcacttgctgtcaagcctgatgacaggagtttgattcctaggaccttgtgggaaagaaagaacaactttgtcatatgtcctctggcctcttcctcattcatagtattacatgtgcatacacaaaggtaataataatatattattttagagatttattgatgtgtatgaggactctgtacctgcccaccagaagagggcatcagtcctcattacagatggttatgagccatcatgtgtttgctgggacttgaactcagaatccctggaagagcagtcagtgttcttaactgctgagccatctttctagcacaataatacattttttaaaaacaacaaaaaatagatataaagtggcaaaaaagacattttatataagagtttagttggcttgttttgccttgagagaggaatattattgttaattatactttttaaagtttgtgctgttttttttttaaatatatagctgttacaaagttcagaatttaagcacacaagaaagcccagctatcaaaaaaaaaaaaaaaaaaaaaaaaaaaaaaaaaaaaaagccaggcagttggggctcatgctttttttttttttttttttttttttttttttttttttggggtttttgaaacagggtttctttgtatagctctggctgtcctggaactcactttgtaaaccaggctgtcctcaaactcaaaaatctgcctgcctttgcctccgagggctgggattaaaggggggccccacacaaaaaaaccctgactcgaaaaaacaaaaacaaagaaaaagaaaaaaagcccagctataaaattcccatcaactttctctcccaaagccactcatttaaagatttactttatctttaaaatatttgtacatgtacagataatatttgtgttatctgtatgtggcgcgcgcacgcgtgtgtgtgtgtgtgtgtgtgtgtgtgtgtgtgtgtgtatgcgcaggtgctccctgggtccagcagagggagtctgatcgttagagcttgagtcccaggcagctgtgatagggttgctgggctgctgggaactgaactcgaggcttctgcaagagccatgctcttagcccgggaatggcttctccaatcctttagacatttactatggtaggagaggttgtctgcatgtgcgtgtgcacatggtacacacatgggcggcctgggggtagttctccttcccccatgctgaaggaccaagctcactgaagctcatcagcaggtgcccttcccactgagtgtctctctcccctcccagagcatctttctctatagagtcctagtttttccaaatgaagaataactgctttatttttttcagtcaaactctcatatcccagtttgacttaagacttgctttgtagctgaacttctggtcctcctgcctccacctcctgttggtggtttgttttatttgtttgtttgtttttgtttttggtggtggttttttgagagagggtttctctgtgtagccctggctgtcctggaactcactttgtagatacggctggcctcaaactcagaaattcacctgcctccacctcccgagtgctgggattaaaggcgtgtgccaccaccgcccggctgttttgtttttaagatagggataaaattcagtattttgtatatactaggcaagctaagataaaccccagactttgcatatgtattcttaaaatatgtagatttaggactggaaaggtggtcagaggctgtaagagtactcactgtgcaagcatatagggcccgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatacactaaatagagaaagatttggacatagttattatgtgaaagcagcagtctttccacgtcagatgagtgcattctacacttgtccctcactgagcttggtgtgaaaagactcacctctttagatccattctgtgaaccatggggtttcacttaactgatcctcacaggaagattttcagggcttgtttttattataagggtcataataataaccataataataataaaggcagtggtggtgcaagcctttaatcccagcacttgggaggcagaggcaggcggatttctgagttcgagggcagcctggtctacagagtgaggtccagtcaaagctctcagcaccatcaggggctcaagcttcacccccgagctggagacattttatactaaaatactgacaagtgggtggaccgtggttgattgttgcgtgactcttgtgcatagttctgctcacctccgtgtgattgcgctgcctcagcactgaggtgacaggagcggcagttgtcccttccaacctgtgacctgcccacctgtccttctgttcttaggcccttggactggacagtgccaatgagaaaggcttgtacagaaggggcgaggcccagctgctcatgaatgactttgagtcggccaagggcgacttcgagaaggtgttggcagtcaatcctcagaacagggccgctcgcctgcagatctccatgtgccagaggaaggcgaaggagcacaacgagcgggaccgcagggtgtacgccaacatgttcaagaagttcgcagagcgggacgcaaaggtagtgtgcccacagccccaggcttgtaaggacgctagcctagggacaaggttgggcagcctggctggaagaaataagacttaggaagggactccatgtgggcagagacacaggtgggaggccctggcgtgtccctgagagctgagggctgactcctgaggtggagcagtgctcttcttgttctctgttttgttcttaaaatggtttctctttgtggacccagctagctcatctcagagatcctcctgcctctggcgatgagcgttaggattataggcatctgccaccaaaccaagttctcttgttatttttaaaaaataaataaggagttacagagacaaagtgtggagcagagactgaaagaatgaccatccagagactgccccacctggggatccatcccataaaccaccaccaaacccactatggcagattccaacaagagcttgctgacaggagcctgatatagctgtctcctgagaggctctgccagtacctgactaatacagaagtggatgctcacagccatccattagacggagcacagggcccccaatgaaggagctagagaaagtacccaaggagctgaaggggtttacagccccctgggaggaacaacaatatgaactaaccagtacccccagagctccctgggactaaaccaccaatcaaagaaaacacacggagggactcatggctctagctgcatatgtagcagaggatggcctagtcagtcatcaatgggaggagagacccttggtcctgtgaaggctctatgccccagtatcggggactgccagggccaggaataggagttaggtgggttggggagcagggggaggggagagggataagggaattttcagaggggaaactaggaaaggagataaaatttgaaatgtaaataaagaaaatatctaataatgaattagttaaaaataaataaatgcagccaggcagtggtggcgcacagctttgatcccagtgcctgagaaacagaggccaaggtaggcagttgtctgaacaggaggccacatacacagagaaaccctgtctggaaaaaatgacaacagccctaagcccttcagtgttgtttctctggggagacttcctagtaaagtccaggttggattggaaacgggtgtgcctgtggtggcctttactgtattctctgctgtcatcgggagcctcgctggcagtgggtgtgtctgaacacaggtcaacttcctgccccatggccaccctgtggtcccaggtctgtcctccatcttcagctatgagtagcataaggacttgagctactcagcagctgcctgaggtaggcagctcctcattgcttgccacccctacttacccagtgtgcaccccagatccaagcgtacacacttgctgcagacctgatggaccatctcgggaaggcagtggttgagtgagctcctcttctcctttcacctcaggaggaagccagcaaagctgggagcaagaaggctgtagaaggagccgctggcaaacaacacgagagtcaggccatggaagaaggaaaggccaaaggccatgtatgacgctgcgccacggagggaagagagtcctaatgaactcggccctcctcgctgggctcgcctccaactcaggactgaacagtgtttagtgtaaggtttgttacagtctctgtgattctggaagcaaatggcataccagtagcttcccaaatgaccacctgctgctgcgggggggtgggggtgggggacatgccaggaaacagcagagaaggccgctggtgtgaagagaccaggccagcagctcagtccagcccatttcagtttgtcacctttcagtgtccagcacagcatccctgtgaacctagggcccagctgctgtgggttctacatcggcactagggtcacactgcagaaaccgttgataaaacaaactcagtgatctctgctttcctattggtgggcatggcaggggcgggtgatgagatttgcttagcactgactgactggcctgctaagaacacaagcccacagccaggggctccctggtccacagctgggtctcaggccccttacctgccttccaagtcctttcgcagactcttgagtgtggctttctgtcctagccagcatgtcccacagactctgttgttcctccaacgcccgtcattagtgacagctttctctctgagtttctgtggtgtggagagtgggtagaagtaggtttatctttcccgctgtctgccccactcaaggacgatgttagcgctcagccatccctgcccagcacagctgctcagcctcatgctcccacccgcacccttgctgtgcagaacctaaggcttgctcccgtcccagactcgagtggacggacatccatgtccacccaggattgacgaaggaaggaacttcacactcctctatcatgcaaaaatagttttcaatttttactttttagcttgggttttgaaaggcaaactctaggaggcttaaaacgggcagttactcttaaggcgaggtagatacctcatcctgcaccgcagcctctgtattctggtgggagctgtaagggttgcgggcttccggtgtcccatgcatcaagccaaagtctccaaaacttgggcattgaattagggcaaatcttaaatagttttggggttggattttagtcctacaggtgatgattgaacgtggctggcttctccacagcctaaggaacccccatggggacacacccaccacccaatgacccatgcacctctgcctggacagctcacttccagccctaaggaccactgtgctcaagatgtgtggctgtagtaagacagtctcatgtcaggcattaagtcaaggccttccttcacacctgcgggacagcgcttctgaggctccagttctgctctgctcgaagcaggagggatgggttgtgaaggagtctgggatgtgactgggaccctcgcatctcacactcggcactctgcctctttccatccatgtttgagagccctggtctcaccaggaagtgcagagcaggagccgactgtgtgtgtaatgctctagtgtttgtagttctcttcactagccttgcagcgccagggaggccgggctggaatttgagcctaacatgttaggtttttacgggaaagctctttttccagctgtctcccaagtgcgtattgtgggccaaggagactggtatgggaaggggggatggtcaaggttccaagccagaaatggaaggtgcccagcacccctggattttacatgttcttgtattcagtaatctcagacgatttacacggaaatcagaagatgtcttcaaatacccttagactggatagagtgatggggaagcagatgatgcattgaaattttggtttttaaaaaatcacttagatgctgggagtaatggtgacacacacccttggtcccgtgacctgggaggccctgtctcaaaacaaaacaaaaaatcatttagatgcattttgtgttccttaaataaattttttaaaaagtggtttttcattgttcatggctttttgtttttgttgtttgtttgatttttgaagtttacttttatctttgtctgctagagttttgtgtccagctgcccttggggaccagaaagggactttgaatctccttgaaatgaagatacagttgttagccagatgtgggtgttgagaactgaacccaagtcctctgaaaagcaggaagtgctcttaactgctgggctgcccctctcccacccctccattgtttgggtttgacttaaacacttgattttttttatgatttttttaaacagatttatttattgtatgtatgtgaatacgctgttgttgtcttcaggcacagcagaagaaggcattggatcccattacagatggttgtgagccaccatgtgggtgctgggaattgaactcaggccctctggaagatcagtcagtgctcttatccactgagccatctctccagcccctttttatgattttattttatgtgtatgcacacttttttgtgatgctttattgagttcctatggaacccttctaaccccctacctcaggtaggggagaaagaaggttagaggggggaagggggcatagatcttttcagactgcttcttgctgattaggggcatcgagttccttgggtcaacttcaaacttcattgtcagaatatccaatctactcgtctctttgctcacagccttgtgacaagccacagcagcaacagacacagtagcctcctctgcagagcgcactcccacctgatagcccctctcagagctcggcatttataccctatgagaagttcccagaatcccagagttcacagaaactgtctgcagctggcaaaaccacgcctctgccagagcacgaggcaaatgatagtcagctgctgtgaagcagtcacctatctcacaacatagtcacatgacatacctgggttttttaggaaaccgaaattctcacatgtttacctgcatgcatatacatacatcatgtgcatgtagtgcccagggaaggtagaagaaggcatcagagtccatggaactggagttacaagatggttgtaagctgccgtatggttcttggaactgaacccacatcctatgcaagagcagccagtgtttttaaccactgagccatctctccagcccctgattaaatagtataaaaaggaaaaaaaggtctacagccatcatgccctaaacccactgaatctccactgatctcagaagctaaacagactggccttagtctattgctgtgataacacaccatgaccaaggtaataatataaggaaaagattatttggagcttgctgtttcaaagttaagagaacccatgtagggggctggagagatggctcagaggtggagagcactgactgctctttcagaggtcctgagttcaattcccagcagccacatggtgactcacaaccatctgtaatggaatctaatgccctcttctggcatgaaggcatatatgtaggcaggcagactattgtgtacataattaataaataatctctcttttcttaaagagtacatggtgacaggcaaagtggaagaaatgtcagagagagctatctgggaataacatgagtttgtcaaaccttgaagcctattcctaggaacacctctaacaagccacacctcctaatctttcccaagaagttccaccaactagagaccaagtattgaagcccataagcctttggggaccattatcatttaaaccacctcagatgcagaaaagctgttgggttgaagaactctagtagaattcaattgaagaatgtggttgaggggctggagagatggctcagcaaaggttaagagcactagctgctcttccagaggtcctgagttcaattcccggaaaacacacggtggctcacgaccatttgtaatgggatctgatgccctcttctgctgtctctgaagagagctacaatgtactcatatacaataaataaataaacaaacaaacagacaaacagaccagttctccaactgaaccaaagtgcatccattttgctgggctgtctggccaataaggttcagggacctacctatctacatagccccagttccccagttccagatgtggtgccctctgtacccagctgtgtgtgccactatgccgtggatgctggggatccaaactcgggtccgtagtgtaaagtaggagctttcccagctgagccatctcccctgttccttaaagcctttttgacagacagtctccacatttgtctgagtttccactctccagactttgcctcctgtttgccaaaccacctggttctcttgggagacatattgaagggcttacaatttgcataatgagatgaaacctatctaccctcaacaagcataccagttaagcattgctgagccacactgccccaaccagtggagacacatgctcatggttgttgggaactgctggaaatagaagggtactgaaccacaaatgccccatctccttgtgtgcacaaagagcaaacatttggcttcataaattgattttggtttagtttggttttgcgtttgcacttgaaattaagaactaatccctctttttggcacgtgtgtgtgtgtgtgtgtgtgcctggtacggaggtgcatttgcacaggtgtgcttgggagtagagatcagaagttcacatcagggctggaaagatggctcagcggttaagggcactagctgtttgctcttccagaggtcctgagttcaattcccagcaaccacatggtggctcacaaccatctgtaacgggatccgatgccttcttctggtgtgtctgaagagagcaacagtgtacttacaaacattaaacaagtaaattgttaaaagaagaaaggagggaaggaaaagaaagaaggaatgtctgcctttttctttgttcccagcttatacatggagacagagcctctccccctgaatccagaacttgtcaagtgagctcaaactagccatcttgctcggaggtcccctgtccccacctcacaagcactggggtcacaaggtgggcacccttgcactttcttcagtattttcgtttttagttccaattggacatgagtagcctctctgttttcttcaatgcaaatactgctgcctggtgtaaaaggcacttcctgtgcccttggaggcacagctttcttccctgaaatcccagacgctgccagagacagacagacagagagaacgctcgcacacatgatcacacatgcacacgagtgagtgcaggtgtccccaggggccaacagagagcatgcgattccccggggttacaggcagttgtgagctgccatgtgtgcttgcttgggaaatgaatgtggatcctttgaaagagtaataccagctctccattgctgaaccattttcctgtggggccgtggtccgcgagaggaagtctggtaaggtcgagctgggcttgaagctccagggacccagaagggacagtaggagcttcacctgctcccaacatcaggcccctgtcactgtcacagccacccatagagagaattgtggccatcagtcacataggcgcagcaccccccaaacccctccacatgtagatgaggcatccctaacatctcagaccaagccaataggaagcacctgctgtcagaccccacccccaccccaaaacggtgcataatatcctatccagaggaataaaggtgtgtgtgagagttactccatcatctgggagcatctgtcttagaagagctgctgttacactgcctgggaagaacagcagcagccaaggcagcagcagcagcagcagcagcgcatcggtggtggctgcgggccagaggtctctgcagatagacttaggtacgcagaccagcagttccctagccccaagatcttgtctctttttaatacagacttatcggccctaacttcccttctggcttgccacagcacatatgcattggtatggcgatttttgttttgcctgcacgtgttgatgtatttaaaaaaagatagagagagaggggaatatggtctatggagatgtgatgaggtataggggaggggggtgcctcctccagcccatgtcaaggcatcccttccaactgagtgaccagccacatgatggtatagtatagaatagagtttattcagggcatggggaggggagttaaaagggtagtagaggcagagaaaggcagagagagggagaagagtaatagggagaagtagaatagaggccggccatgaacacatggacaaatggggaagggactagggaagggaggggaggagggaaacgcctacgagggcaagagagaaacaagagaacaaggagggggcaagcagctccttttatagtgagccagccctacctggctattgccaggtaactgtggggtggagtttagacagaatgctaacacgtacgcctgtgcaccacgtctgtggaccacatgtgtacccagtgcctgtggagggcagaagggagtcagatgccccagagctggagtcacaggcagttgtgaaatgccacatgggtgccaggaattgaacccgcgtcctttgcgagagcagctggtgcttgtaagcaatgagcggggtctccaggctgcattttttgtcttgattcatcccaaggtattttctaatttccttcataattttttctttgaccctcagcttgctaaagagtcggcttccttcccacatatttgtatccttttccaactgcctgcctcccttctgttattaatctgatttcattccactgtggtgagagtgcacaccatgtacattctttgtttgacttacgttattttaaatatattgagactttttgcggccacatatggtcacccccaccctccccccggagaatccgtcctgcttttaagaagatctcatacatgtttttgcttggcattttaaaaagcttttagtttcacattttatattgcttgcggatatacatgtgtgggtgtgcctgtcagcagacatgtgtaggtcagaggacaacttggggaatccaccccctggcccagggtggcattaatcgcgtgtgaggtcggctgggtttccagtgcatgtggctcgggcttgtctggttcctttgtggacgtatggtatttgcagcctctgtcctgactgatgaactagcttgcatttgcctttgcattctccagcttggcttcctatattttggggcttggtgtgcacacgtgtttctaataatatctttctcatgggttaacccatttctttttcttttcttttttttttaaagatgtatttattattatacataagtacactgtagctgtcttcagacacaccagaagagggtgtcagatcttgttatggatggttgtgagccaccctgtggttgctgggatttgaactcaggaccttcgtaagagcgatcagtgctcttacccgctgagccttttcatggtgagatcttgggttcatccttcaagagtgcttgctgctcttccagcagacccatgttcaggtcccagcatgccacatccacaccttacgctgccatctgaactgctcccccgactccagtttgcacgtgttctgtctcactgctctgccctgtttgtcattcttggccaccgccttagtttgtgttacataaatattttccagtgtgtcattccaatttccttatcttttaacatcttaaattttttttaaagatttatttatcttatatatgtaagtacactgtagctgtcttcagacacaccagaagagagcatcagatcccattacagatggctgtgagccaccatgtgattgctgggaattgaactcagggcctctgaaaaagcggccagtgctcctaactgctgagccatctctccaacccttaacatcataatttaataggatataatttgagcccataccgatgtaatttcaatagccaagcatggggggcaatgatggtgcacgctcttaatcccactgcagagtcagaagtaggcagatctctgaattccaggccaggtctgtgtagtgagttccaggacagttggggctacacagagaaaccctgtctggaagaaaacaaaccaaacaaacaatcacacacacacacacacacacaaattgttagccaaacatagtagcaagttccagtccttcagataagaaagcaggagggttagaatttcaagaccaacctgggctgcatgaaaccctatcttagaaaaaaataaatctatttctctatcactcctttctccctatcgccccctctgacaccgtgagccggccagagcatagtttttcctttgtttgtttgggtacatatgctgctagctcctagctaatgagccatctctctattcctctctctgtctgtacacctggatttgaatttctgtctttggtgttcctgccccccttctacccttccccccagctatggggtttgggttgggggggtgttttttattttattttttaaggtttatttaatatgaatacactgtagctgtcttcagacacaccagaagagggcgtcagatctcattacaggtggttgtgagtcaccaaatgcttgctgggaattgaactcagtacctctggaagagcagttagtgctcttaacctctgaaccatctctccaggccccttgtgtttttttgtttttaactgaatttcaacagtgatcaaatcatttgctcctttttatggagtttagatccttgcaaaagatctgggggcaggagggttttattaccataaggccttgctgggggacaccaggaaagagctttgttttctctcggagcagctgctcactctgactcccctgcccatgtacatgggttgcttacagcagctctcctctgctccaggattccgtgctccggaaaccgcagggagggcccaggcagccatagacatggggtcagcttcaccaagttaatgcaggaacccaagagtctcagaagcgcggctgtgcctcccccccccccccccgcctcgctcccctccaccccccagggtgatttcagctgccagcagtgagcctctgggcagctggtgaggcttcaccaagtcaatggagcctcagccactgtccacctggacgggaagagggtccccacctctctctgcccttcagcgagatcagttccaccactctgccctctgccgcagcggcaggcgcgcgcccaccagtagccaccacgtgaggcccgggctctaaagtatctttctggacttgcagctcagtcctccctgccctcccctgcgtgcctggcagcttcctgtaattccaggtaagcaccctccacgaagccgcggtgtgcaagcctgctgcgtgatctggtgactggctaggacgtgggtggaagtctggaaggaacctgggccctttggttcagcacagcaaggtgccactgagcagcgtgctaggggtggggacatcagagaagatgcagagtcacctctgccaccctcttcaattcggacaccattgcagccatgtgcaggagggggacagggcagagatgcaccagaacctggctttaggaaagaaaacaaaacaaacaaacaaaaccaaaccaaccagcccagctgnnnnnnnnnnnnnnnnnnnnnnnnnnnnnnnnnnnnnnnnnnnnnnnnnnnnnnnnnnnnnnnnnnnnnnnnnctgagccgggcagtggtggcgcacgcctttaatcccagcacttgggtaggcagagacaggcggatttctgagttcgaggccagcctggtctatagagtgagttccaggacagccaagactatacagagaaaccctgtctcgaaaaaccaaaaaaaaaaaaaaaaaaaaaaaaaaaaaaaaaaatcaagctgtatagtgctggtgagatggctcagcggttaagagcaccgactgctcttccagaggtcctgagttcaaatcccagcacccacatggtgcctcacagccatctataatggggtctgactccctcttctggtgtgtctgaagtcagctacagagtactcacataaataaataaacaaacaaacagacaagtaaataaatatcagcctccagggatgccagctctggaggaaaacctgacacagggcagaggctgcagctcagttctcagtgtgcgaccaggaagcacaaagccctgacttccacccctatcctcaggaggtggaggcaggaggatcagtggccatcttcaactacattgcttcttagagcctgctcgccttgagaccccatctcaaaaataaatcactataaaaagaaaagccagaggctggtgagatggctcagtgggtaagagcaccgactgctcttctaaaggttcaaatcccagcaaccacatggtggctcacaaccatctgtaacaagtatctgactccctcttctggagtgtctgaagacagctacagtgtacttacatataataaataaataaatctttaaaaaaaaaaaaagaaagaaagaaaagaaaagccagccgggtgtggtggcacatgcctttaatcccagaggcaagcggatttctgagttcaagaccagaatggtctacagagtgagttccagggaagaagaagaagaagaagaagaagaagaagaagaagaggaggaggaggaggaggaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgaatagggcgggcagaacctggagccctctgggctgaagattgagcgggattttggtggatgggttttgtggtctgaagggaccctgctggccggtcctggcctgccctaaaggtgaggggaagagaaaggaagagttggggaacagttggggtgggggggatagtaggtagagaagctaactgagccctggaggatttgctgttgatcctggcaccttccctttcccccaggctgagctctgccctgcagcctcttgccccagtgacctggttctagaactaacctggcaggtggtccatcctgtagtgagggaggcccagcttggaggccatgcctg

SEQ ID NO: 1092 - DNA, 2643 bp, Mus musculus
gtccggcgcgcggctgagcgaccgagcgtgcggacggagcggcggcctgctgggcgggctgagcggcgcgcgcggcggcggagagacgcggagcgagggacgcggcggcggcggacgcggcgacaggtcttctacttacaaaggacaatgactactgatgagggcaccagtaacaatggagagaacccagcagccaccatgactgagcagggtgaagatatcactacgaagaaagacagaggagtattaaagattgtcaaaagagtggggactagtgacgaggccccaatgtttggtgacaaagtttatgtccactacaaagggatgttgtcagatggaaagaagtttgattccagtcatgacagaaagaagccatttgcctttagccttggccaaggccaggttatcaaagcctgggacattggggtgtctactatgaagaaaggcgagatctgccatttattatgtaaaccagaatatgcttatggctcggctggccacctccaaaaaattccatcaaatgcaactctcttttttgagattgagctccttgatttcaaaggtgaggatttatttgaagattcaggcgttatccgtagaatcaaacggaaaggcgagggatactcaaacccaaacgaaggagcaacggtaaaagtccacctggaaggctgctgtggtggaaggacatttgattgccgagatgtggtgttcgttgttggggaaggagaagaccacgacattccgattgggatcgacaaagccctggtgaagatgcagagagaagaacagtgtattctatatcttggaccacgctatggttttggagaagccgggaagcctaagtttggcattgaccccaatgctgagcttatgtacgaggtcacccttaagagcttcgagaaggccaaagaatcttgggagatggacaccaaagaaaagctgacgcaggctgccatcgtgaaagagaagggaactgtgtacttcaagggaggcaagtacacgcaggccgtgattcagtacaggaagatagtgtcctggctggagatggaatacggcctgtcagagaaggagtccaaagcctcagagtcgttcctcctcgcagccttcctgaacctggccatgtgctacctgaagctccgagagtacaacaaagccgtggagtgctgcgacaaggcccttggactggacagtgccaatgagaaaggcttgtacagaaggggcgaggcccagctgctcatgaatgactttgagtcggccaagggcgacttcgagaaggtgttggcagtcaatcctcagaacagggccgctcgcctgcagatctccatgtgccagaggaaggcgaaggagcacaacgagcgggaccgcagggtgtacgccaacatgttcaagaagttcgcagagcgggacgcaaaggaggaagccagcaaagctgggagcaagaaggctgtagaaggagccgctggcaaacaacacgagagtcaggccatggaagaaggaaaggccaaaggccatgtatgacgctgcgccacggagggaagagagtcctaatgaactcggccctcctcgctgggctcgcctccaactcaggactgaacagtgtttagtgtaaggtttgttacagtctctgtgattctggaagcaaatggcataccagtagcttcccaaatgaccacctgctgctgcgggggggtgggggtgggggacatgccaggaaacagcagagaaggccgctggtgtgaagagaccaggccagcagctcagtccagcccatttcagtttgtcacctttcagtgtccagcacagcatccctgtgaacctagggcccagctgctgtgggttctacatcggcactagggtcacactgcagaaaccgttgataaaacaaactcagtgatctctgctttcctattggtgggcatggcaggggcgggtgatgagatttgcttagcactgactgactggcctgctaagaacacaagcccacagccaggggctccctggtccacagctgggtctcaggccccttacctgccttccaagtcctttcgcagactcttgagtgtggctttctgtcctagccagcatgtcccacagactctgttgttcctccaacgcccgtcattagtgacagctttctctctgagtttctgtggtgtggagagtgggtagaagtaggtttatctttcccgctgtctgccccactcaaggacgatgttagcgctcagccatccctgcccagcacagctgctcagcctcatgctcccacccgcacccttgctgtgcagaacctaaggcttgctcccgtcccagactcgagtggacggacatccatgtccacccaggattgacgaaggaaggaacttcacactcctctatcatgcaaaaatagttttcaatttttactttttagcttgggttttgaaaggcaaactctaggaggcttaaaacgggcagttactcttaaggcgaggtagatacctcatcctgcaccgcagcctctgtattctggtgggagctgtaagggttgcgggcttccggtgtccatgcatcaagccaaagtctccaaaacttgggcattgaattagggcaaatcttaaatagttttggggttggattttagtcctacaggtgatgattgaacgt

SEQ ID NO: 1093 - DNA, 1371 bp, Mus musculus
atgactactgatgagggcaccagtaacaatggagagaacccagcagccaccatgactgagcagggtgaagatatcactacgaagaaagacagaggagtattaaagattgtcaaaagagtggggactagtgacgaggccccaatgtttggtgacaaagtttatgtccactacaaagggatgttgtcagatggaaagaagtttgattccagtcatgacagaaagaagccatttgcctttagccttggccaaggccaggttatcaaagcctgggacattggggtgtctactatgaagaaaggcgagatctgccatttattatgtaaaccagaatatgcttatggctcggctggccacctccaaaaaattccatcaaatgcaactctcttttttgagattgagctccttgatttcaaaggtgaggatttatttgaagattcaggcgttatccgtagaatcaaacggaaaggcgagggatactcaaacccaaacgaaggagcaacggtaaaagtccacctggaaggctgctgtggtggaaggacatttgattgccgagatgtggtgttcgttgttggggaaggagaagaccacgacattccgattgggatcgacaaagccctggtgaagatgcagagagaagaacagtgtattctatatcttggaccacgctatggttttggagaagccgggaagcctaagtttggcattgaccccaatgctgagcttatgtacgaggtcacccttaagagcttcgagaaggccaaagaatcttgggagatggacaccaaagaaaagctgacgcaggctgccatcgtgaaagagaagggaactgtgtacttcaagggaggcaagtacacgcaggccgtgattcagtacaggaagatagtgtcctggctggagatggaatacggcctgtcagagaaggagtccaaagcctcagagtcgttcctcctcgcagccttcctgaacctggccatgtgctacctgaagctccgagagtacaacaaagccgtggagtgctgcgacaaggcccttggactggacagtgccaatgagaaaggcttgtacagaaggggcgaggcccagctgctcatgaatgactttgagtcggccaagggcgacttcgagaaggtgttggcagtcaatcctcagaacagggccgctcgcctgcagatctccatgtgccagaggaaggcgaaggagcacaacgagcgggaccgcagggtgtacgccaacatgttcaagaagttcgcagagcgggacgcaaaggaggaagccagcaaagctgggagcaagaaggctgtagaaggagccgctggcaaacaacacgagagtcaggccatggaagaaggaaaggccaaaggccatgtatga

SEQ ID NO: 1094 - DNA, 87878 bp, Homo sapiens
caaaaaccagcaagtttttattagggattttcaaaaggggagggagtgtgtgaatagttgtgggtgacagacatcaagtacttaacagggtaatagaatatcacaaagcaagtggaggcagggcgagatcacaggaccacaggacagaggcgaaattaaaattgctaataaagtttcgggcaccattgtcattgataacatcttatcaggagacagggttttgagatcaactagtctgaccaaagtttattaggcgggaatttcctcttcctaataagcctgggagcgctatgggagactggagtttatttcacctctgcaatctcgaccataagagacaggtatgccccgggggggccagttcagagacctacccctaggtgcgcattctcttttctcagggactttccatgctgagaaaaggaattcagtaatatttctcccatttgcttttgaaagaagagaaatatggctctgttctgcccggctcaccggcggtcagagtttaaggttatctctcttattccctgaacaattgctgttatcctgttcttttttcagggtgcccacatttcatattgctcaaacacacatgctgtacaatttgtgtacttaacgcaattattacagggtcctgagacgatatacatccttctcggctgacaggattaagagattaaagtaaagacaggcataggaaatcacaagggtattgattggggaagtgataagtgtccatgaaatctttacaatttatgtttagagagtgcagtaaagacaggcataagaaattacaaaaatattaatttggggaactaataaatgtccataaaatcttcataatccacgttcttctgtcatggcttcagccggttcctccgtttggggtccctgacttcctgcaacaccttcttatatgtatcaaaactcatactgaacaatgagttctgggttgcaaaagaggatttattttttgcacctaaccataagtctttgtccacaagttaaacaaaaacagtgtagtatacagtatttttaataattttgtgcattaaataaaatttgtgtaccttgaatcattagaaaacaagtattaggtgtggagtttttcacttgtggcatcatgttagaattcaaaaagtttcagagtttggagcatcttggatttcggatttttccaattaggaatgctcaacctaatcagaagtaagacttggatattaaaagtttgaaagccacggttttatttgcttagtagtatataactgcaacagtactttttatcttaattattgtgtagaatctgatgactccccaacatataactgtcacccacacttctctcctgagctcaggccttatctctgataaccttctggacatcgcacaagcaccccttgctcaacataccccagccagagttctcttgctctccataaaaagcaatctgaaatgttcgaattaaattgaagagaaagaataaaaagtcctgatgagtggaaccatgaaatgtttcatcttttttccctaagtttaaaaagatcatgaaagtaatacatgtttaatgttaaactatttaaataatataaaaataaaatctaagaagtgaaaattccttcttatcttcccaaatctcattctccagaggtaacactgtttgagcagtttggtaagttatctttccaaacttcttctatatataagcaaatatacaaacacatatatacttttttcctcttggaaataggatcatgttacaaatcattctgcaactcaccattcacttaatagtacatcttgaaaatccatctgtcttttcatgtgagtattagaagattgtttatgtggaatgggtaagacgtcacctgctccatattagtgatattttcagagattagctgtcttaaagggaaaacagtgaaaaagacattttggcatgtaatgaacaatatttgcataattgtaatccagtgctctaaaatgatcatacccacccacccaccaaaatctacaaacaactgggaaccatggttggtggctgcaaatatattggtataaattacactgtttgtgccaggtgcggtggctcatgtctgtgatcccagcactttgggaggctgaggcgggcgggtcacttgagctgaaggagttcgagaccagcatggctaacatggcgaaaccccatctctactaaaaatacaaaaattagccgggcattggtggcgcacacctgtaatcccagctactcaggaggctgaggcaggagtatcatttgaacctaggaggcggagattgcagtgagccaagatcaggccactgcactccagcctgggcaacagagcaagagtctgtctcaaaaaatttaaaaaaataaaaaataaattacactgtttgtgttacatgtattagcccattgtggcatcatcaactgacttttttttttttcaatggtccagataaccaaatcatcactgggcactatgcaccattaacaatacacttcatttactacaatgctattcttttttccttttttttttttttttggacaatatcttgctctgttgcccaggctgcagtgcagtggtgcaaccatggcgtgatactcctgcctcagcctctccagtagctgggaccacaggcgtgtattttttatttttagcagagatcgggtctcactgtgttgcccaagctggtctcaaactcctgggctcaagccttgacatcccaaagtactgggattacaggtgtgagccactgcgcctggcattcttttataatggatgaacatttacaaaatattttcccaatttagttgtttggatgtttttgtttagactcttagctaaatgattctctactgtatagatttatctcatgcttttcaaaaactgtatatttttatagtatgcatttgccaaattttagtctaacattcccatgaccatccttttaaggaaaaactttgaaatacttttatttagccatacggttaaaatttagctggaactaagtgatctgtgtttagttgatgaactgatccatgctattcttgcatcatgactttttcatcttcccttgattcttttccctatatgcatttaagcctgtctggttcttttctcaagcctttgctctctactcccctttcactcaaagcatttcatgtttcgcctttataaccctagtataagtatcaaacttctcacctgtgacttttgcctctctctacatctctcttctacttttaactttcatgtttacaataagctacctttctcttattttcagttcttaccttctcaaacttcagagaatccccactgcttagtgttcttgggagatgctagaggttacacaaaatgccacctcccagaaggtcgaggcattttttttctttaaaaaaaaaaaaaccttttagccaaatacttactcataagaaatgctccattttattctcagtagtatcttcagaaagatttcagaggtaattgcatctacaaaataaagacttagtgctaagaaaatgagcaatccgataagaatatgtaaaataaaaaacattattactaaattcttttttttttttttttttttagacagagtcttgctctgtcgcccaggctggagtgcagtggtgcgatcttggctcactgcaagctctgcctcccgggttcacgccattcttctgcctcagcctcccaagtagctggaactacaggcgctcgccaccacgcccggctaatattttgtatttttagtagagacagggtttcaccatattagccaggatggtctcgatctcctgactttgtgatccgtctgccttggcctcccaaagtgctgggattacagatgtgagccatcccgcctggcctttttttatttttattttttgagatggagtttcactcttatcctccaggctggagtgcaatggcacaatctccactcactacaacctccgtctccagggttcaagcgattctcctgtctcagccacctgaatagctggaattacaggtgcccgccaccatgcccagccagtttttgtattttcagtagagatggggtttttccatattagccaggcttgtctcaaactcctgacctcaagtcatctggctgctctggcctcccaaattgctaggattacaggcttgagccacctcacctggccactaaattcttttaaaaatctcttgagcacactaaatgatatattgaatatagctgatgaccaaatggtgttgtaaaaattccatcaggccaggtgtggtggctcactcttaataatcctagcactttgagaggacgaagtgggaggatcacttgagcccaggatcacttcaagaccagcctgggcaacatagtgagaccctgtctcttctgaaaaaaataataaaaaaaaaacattaggtgtggtggcacatgtctatagtttgaactactagggtggctgaaggggaggattgcttgagcccaggaattcaaggctgcagtgagctatgacggtaccactgcactccagcctgggcaacagagcaagaccctgtctcttaagagacaataagaaataaataaaaattccatcaaagaatttctcttagggtataaagccagagacaaagatgaaaaatgggagaaatgtccagtggttctcaaccatgtctgactgcacattaggatcatctaacatggtttttgaaaacaccattaccctggccccaccacagaccaattaaatccagactctctgggctggagtccagacatcagtagcttttttaagctcctcaggtgattctgttgtttagcccaggtttagaaaaatacttaagaaacctgaagaataataccaaaatgtccgaagtctatctaataatacttctagaagtagaggacagagacatcaaaggaaaagaaataatgctagaaaatttttctggagattctgcaaagacttgtcttcagcagttaagggccagaatatcaaggcccctgcaggaattaaggaaagaagacaagtaccttgacatatcctttcgatgggtctgaactccaaaaataaggattattatgtcttccagagaagaaaagatgggagccacagtgtgcactctggaaggaaagaaacctacctggcctaactgatccaaacacagtttctgctttttcccccagatgctgctctccagtgcattcccctagctcactcctgctttctggggctgaccccagacctagagcttctccaggctccctgggaagagctgctcttaacagttggtgtttgggaggcaactttctcttctttgctctctccttcggtctgacctcatctgctgtgtagtgttcagaaattcccccaaagttctggttcagttaggaacatgtcttgttttccacctcagagttttgcagattttaaaaactttttcttgtcatcccagcatcttcctggggagaggaagttgatgacttagtcctgtcgttcaacctttttgaggccaaatagggtaaaatcatattaaggggaataatcctgtattcaggttcatcctttagtatataatggtaacatttggatagtctaatattttctggggtttttttgtttgttttaatataatcctttgctttctgcttacttgaaaacagtaatttatccaactcagcactcagagtcaggggaagtgtggtctcttagctttgttttcttcagtaattatttgttccgagaagaaaaataagtttaccaaagaaatatctttctgaaaactctcctgttagtagcataatctgaggcaagacactgatattttaacaaagagaacaatacagtaatttacataatatacatagggaattggtagatatggctttaaaatgacttctcatttgggggacctgatagtttagttatgttaactgaaatttttagtacactgttgataaaatattaagtgtattctcatttttctgttatgtctcaggtgtttgctgactagcactttggagagtgtatgcttatctgccatgtccataacagaacgaactgtgttccctttctgatgcattgggtagcaattttccgcctttggacagttcagcacagtaagctttatcatagattaatatccatagctacatagtgattttaaatccagaataaatctagggtgagggaaagaagaaaagtctctcttataaaaatggtgaaactgtctcagtgtgtcattacagtttttaggaattgtctgtccttactgtcttttttatataacattcaatcaaggaaaaagttttatttgttttgttagcttacaaaaacctatactcctaatggcttaactggaattaaggggaaatacttggaaaattcagtttatgtctttattcttccagctttatctgcttttgaaagttcaaaagtttgttttcttgttgtttttatctttgtgttttaattattcatagtacttctcttcatatggactcagtactactgacaagagccatcctctgagattactaagatgacttgcatcccttgaagtgttggagccaaaacatgaagagctaattcctttatcagatgggatttagaaagctagtaaatcagcttatacaggttgcctatttactcgaatttaaacaagccattgttttcaaaatagcaaggtgagaaccaaaagaaaatgtttctttttttcctctctcttttttttgagaaagagtcttgctctgtcacccaggctagagtgcagtggcatgacctcggctcactgcaacttctgcctcccaggttcaagtgattcttgtgcctcagccacccgagtagctgggattacaggcgtgtgccaccacgcctggctaatttttgtatttttagtagagacggggtttcatcatgttggccaggctggtctcaaactcctggcctcaagtgatcccacccgcctcagcctcccaaagtgttgagattacaggcgtaagccactgttcccagcctgaaaacatttcttcattgacagtattttcatttaaaaatttagctgaactccaaatgatgaacattcaaaagaaagcattgtctttggatgatttgaaagcaagtggcagatatcatgacacctcacccctaaatactacagcatgtgtctcctatgaacaaggatattactctgcataaaaccataatactatatcacattccaaaaggctgacatatagtagtaataagctaatatgcagtctcctgttccaagttcttatattttgtcccctaatccaggatccagccaaggatcactgattacacttggttgtcatatctctatagtctcctttaatctggaacagacctcccgtctctccctctctctctttctctctctttttttatcttttaagagatggggtctcacccttcggcccaggctggagtacagtggcatgatcacagttcactgcagtctcaaactcctgagctcaatcaatagtccttccatctcagccacctgagtagttgggactacaggtgcacgccacctttttggttctttatgttgttaacattttttcaggagtgtaggccaatggtcttgtagagtgctccacaatctgtttttgtcttttcttcctggttagtttcaggttaaacatttttgatagggatagcacataggtgatagcacatctaaatcacatcactacatcatattaggagacagagtaatagcactttttttcattattggtgatgcagagtttggttatgatgcagatcatttgttaaagtgttatcagtcagattgttttacttgaaaggtctttttccttttttaataataagtaatctgtggggtactttcccaataacctctcacctggtggttttcatttgttcagtgctttacacccagagatctattgatggatgtcagcatctctgtgaatccccaggaaatttttttgtgtgcatatattttcccaggcatacagtccaggaccctccaaatatttaagagatcttttccctctgttatcaaggtgccttttacaagtttctgtgcatcacagaagcatattataagcagtgggtttctagaagctgggaaccaatcccgttcttctgattttcctgattatctagctcacctcatgtagagctaggtacataatttttgttgtttgtttgagaacgattgttctggcctttcgcttatcctgagccaaacatttggatctttcatgtttggtataaagcgtactagaaactagagcagagagacttagcccctggtttttggtgttctcatttgaagattttggggcacaacaattggatttgtgtctctgttgaactgaatagtggtcatttggaaatgagttaaaacactacagtatatgttttagttgtctaattatagttgtatcaataagacattttctgcaagtgcagaaagactctttgactctgtagacaagaaggctcaggagatgagtttagggggcattaagtttgttattagcctaatgtgtaatagctgtaggagtgattccttcttgattttccctgcccaaacagggagcagtgtggaattcatcatggcagtggttaggtgtgttttgcttagcctatgattagcctgttggttacattggcttgccttgcatgaaaaaatgtctgtcaggtgactaccaataacaataagagctaacatttgaatagtataccttaaaaatacacattataccacttcagaagattatctgtgaaaacagatatttttattctaatcacataggtaaggaaaaaatcttagagaagttaaggtagccaacatcaaacagcttgtaaggagcagaggaagaacacccccaaattccattacaaattccttgcactttttgtcttaccattctcaaaggtagaggcattctagggaatctaaatatgaacaaagcatggaccttgctctgaaggatcttttaaacctaacaggcgcatagtcttatgaatctcttacagacaacaaatcgagagaagagctaaggaagtacgtaaaagggcaaaatggcctacaaatagagggtcaaggttggtatgacagaagtaggatttgagagaggtggatgttttggaaacaagaaagggagtgaccagaagaatgactatgggaaagcactgggtttgttgtagaggtggaattggcctagtttggctggagcatgagctgcatgaaagaaagtaaaataaaataatggcagctagaactcaaagatagattagggccagattgtgaagggccttgaatgccacatggaagaacattctgtaggtattttgggcaggagatgaaaaatgaccctacagaaggcccaaaaatgatgataaatggttaaatatgtttaagttaccaatctatgctaatcttttaagaaatgttatctcactgtaactatgaatagtgtactgtgtccattttgcagatgaaaaatgaaggctcagcaagattaaggaaactggaaatgtcaagagctgcagctaggacccagacttgggtctgttggattctaaatcctgttctgtgtctcactgtgattgatatattgtcacttcttttattaagaactgataaggtcttaatcctctgtcaagaatatggctgtagaaaaaggatgttttcaaagttgtgaagggactgcttctcaccatgttatgttaaggaatgtaatcactacccaacttgacttgtactgttctctgttttgagaccagagctagatgggaaattaaagaattggatgatgttttatttacatgcctgatgacatcaatacatgctcatagcaaatgcctttgttttcattttcagtatctaagcttattggccctaagtaaatcttaggttaggtagagctcagttcccaggggcattcaagattcataaagaagtgatatttttcccagctaaaatatttttcttcttaccaggttctctacttaaaagacaatgactactgatgaaggtgccaagaacaatgaagaaagccccacagccactgttgctgagcagggagaggatattacctccaaaaaagacaggggagtattaaaggtgaggccacaaagctgagtgacatacaaggaaacctgctgtctggaaagattatagcatctctttctgaggggggctggggtggataatgtttattgatggttactaagtgccaaacactagagctagattctcattttgtcttcataacttcaaggttttttttaagagttgagtctcgttatgttgcccaggctggtcttgagctcctgggttcaagtgatcttcccatctcagcttcctgagtagctgggattttctttttaaattaattaattaaatttttgagagagggcatctcattatgttgctcaggcaagtcttgaaatcctggcctcaagcaatcctcccacctcagccttctgagtagctgggattataggcacgagccactgtgcccagctagagattttaatttttaatcccagattatagatgttgaaattgagactgggctaggtaaattaacttgcctaatatcatatatcttagtaatgcagatttacctggggttcaggtccaagttatatctcactctaaagggctatatttccctattctcagagtatacaaataggttactattttaatgtatccttttagtacactaaagctagctaatgacaattttgaagactttttaaggaaagaaaagctaacttgaaaaattcaaaggggttttattttattttattttattttattttattttattttattttattttgagacagagtctccctctgttgcctgggctagagtgcagtggtatgatctcagctcactgcaacctccgcctcctggattcaagcaattctgcctcagcctcccgagtagctgggattacaggcgcctgctaccatgcctcgctaatttttgtagagacagggtttcaccatgttggccaggctggtcttgaactcctgacctcaggtgatccgcctgccttggcctcgcaaagtgttgggattacaggcatgagccaccgtgcccggcccaaaggggtttatttttatatataaatattgttcctgtgtacagtgaagatatcttttgcgatttcctcttagaatatatcttacttttgaattagctttcctacttattaaagcactatacagtcattcaccatataatgacatttcagtcagtgacagactgcaccttcagcagtggtcccataagattataatggggccgaaaagttcctatggcctagtggtgccatagctgttgtagcatgggtagtacagtgtattatgtgtttgtggtgatgtgggtgtaaacaaacctactgcactgcagtcacagttatgtatagtacataatacttgataataaatgtttatattactggtttatgtgtttactatactttctatcattattttagagtgtgcttcttattttttaaaaagttaactgtaaaacacccttggctgagtgcagtggctcatgcctgtaatcccagcaccctgggaggccaaagcaagaggatcacttgaggccaggagttcaagaccagcctgggcaacatagtaagacccctatctgtagaaaaaaaattaaaaaaattagccaggcatagtggcatgtacctgtagtttctactactcaggagactgaggcaggaggatcatgtaagcctgggagttccaagctgcagtgaactatgatcataccactgcattctagcctgggtgagagtgagatcctgtctcaaaaacaaatgaacaaacaaaaaacagccttgggcaggtccctcaggaggtattcaagaagaaggcattgttattataggagacagcagctccatgcatgttactgtcctgaagaccttccagtgggacaagatgtgttggtggaagacagtgatactgatgatcctgaccctctgtaggcctaggtttatgtatgtgtttgtgtcttagttttaaacaaaaaaaagtttaaaaagtaaaagaataaaaaatttaaaaaacagaaaaatgcttatagaataaggatataaagaaagaaaatatttttgtacagctgtacagtgtttgtgttctaagtgtcattacaagagtcaaagctaaaaaaaaagtttacacagtaaaaatgttatagtaagctaagattgatttattattaaagaaagaagaaaaattttaaaataaatgtagtctaggtgtccagtgtttataaagtctacggtagtgtatggtaatatcctaggccttcatgttcactcactgctcactcgctgactcatccagaacaacttccagtcctgcaagttccattcatggtaagtgttctgtataggtgtaccattttttttcttgtataccttttattactgtacctttttctatgttgagatatgcttagatacacaaataccactgttttacaattgcctgcagtattcagtgcagtaacacaatgtacaggtttgtagccttggagcagtaggccaaaccacctaacgtgggtgtgtacaagtaggccaggccatctaggtttgtgtaagtacactctgcgatgttcacataaggatgaaatcatctaagaacacatttctcagaacatatccctgtccttaagcgatgcatgactgtgtgtgtttcttcactctatagttaatcattttcacgtgcatttcttttgttttgtttcttacaacaatgtggtgagacaatcagagcatctcttgattcttccatcttataagtgaataaactgaatctgagaaaggttaagtggctttagtcacattaaatagttatttctcctacaccattgttaacacatgtaagttttgtatagttaagttttgtttttcctgaaaagattatctgatgcattctgaatattaccaggatgctgagttttaatatctcttgtgccagcagtagcaagtaagaatttttgttttgtgtaactttgcttatgtgaaagccttctgtgcctggatctcttctgaatatatgtgaattgctattatgtgctaagtcaaattttggggacttgcagctatagaataagggctttatgctatagatttacatcctattgtctttttttagaaggcttctcaaccttgtagctatagttactcatcctaaattccaggaagcttctagaaacagtggagactttgcaggctgtcctcagcatctccctgcctctgtttacgacttaccctttcatcttttcagagtgcccatgcccagagaacatgatccccaacttgcctcagaccctgttctgttctagggagtaaatctaattgcaagatttttaggcttattaagaaacatttgagatttgaagccctttaaattatatcatttatcattgtctagagcctcggatttcaccatgaggcttttggttaagatttaaataggtctagtaactgtgcaagctagggcaatttagttaacctctctgtgattaagttcctgtttgtaaaattagaataataatgccatcaacctcatagagttattaggattaggtgaagcacttagcatagtgcctgtcctatagtaatctatcttattaactattacgtatttttaaaaaaagaaccagtgctggtttggaaattcagtaactatctgaggaagataaaagatggatttatattttaaaaatgaatagaacctagattgtgttcttaaggcaactctagatttaggtacaaattcatcttgctagggaagcctgaagtgataccatagtaccacttgctggtgtggatggctctctgactctctggtagccattcatcccacatgcccagttactgtttatagtcctagaaatgcagattccttccacgtgaggcttacagttgagcatagcctcccaaataccacatgcagttcgtgaacatgagcacttgtagaatattgtgtaatatcttttagattaatgttttgagactttttttttcttttgaagtcctagaagggcagtagtgtttctttgcctttaaagaatatttggggctgggtgcgatagcttataccagtaatctcagcactttaggaggctgaggcgggagaatcattggaactcaggagttccaaaccagcctgggcaatgtagcaagatctcatctctactaaaaataaaaaaatttgccaggcgtggtggcatgtgcctgtagtctctgctactcgggaggctgaggtgggatgatcacttgagctgagtgatagaggctacagtgagctatgattgtaccaccgcatgcactctagcctgggtaaaagagcaagaccctgtctcaaaaaataaaataaagatgtttgggcttttgagttaagaaagctgtggaatttaagttcacagtgtttatgtgatatttatgttaggtggacggtatacttgtaaaaaaagaatttaggagcaaataatcgaattatttaaataaaactcaaagcaaactccttccccaaaaagatgttcatcagatgttagctaccatcctctgttatctaccaaaaatgattaatttggcatagattacaaattaacaaattacaccatcacacacctgggtttgattttcttttcccagaactgaccaaatacattagcagcttgctctgccaagaacaaaataaatacactggattttacagtagttaaatactttactagaaaacaagttattcagtatcatatcaagcagtgcaatgatactcatgttttttacagatagactatgtttcaaataataggaaatgtaacctgttttaccaggaaattgggctttctgaaaataaacaagcagaatctagtcaggagctaatgtttttagcaaaggagggaaataaaattacacctttgaagctttgcttaagcttctttttgaatattttaaaagtccaccattctttctggtctaagtccgtgtgtatatggactagctcacaagcctgtgttagagagtttagtgtcgggcgcggtggctcatgcttgtaatcccagcactttgggaggctgaggcgggtggatcacgaggtcaggagttcgagaccagcctggccaacatggtgaaaccccatctctactaaaaatacaaaaattagctgagcacggaggcgcacgcctgtaatcccagctactcgggaggctgaggcaggagaattgcttcaacctgggaggcagaggttgcagtgagccgagatcgtgccattgcactccagcctgggcgacagggcaagactccgtctcaaaaaaaaaaaaaaaaaaaaaaaagagtttactgtcaaaatatagggcattaaaccaatgaacaggatttattggttaattctttgaaggaataaatagtgcgattagcaataaaagtagatataacataaaagacaagttggtaaaggacagttttctaacaatgagttattgtgaggaatgaagggaggcattagaaagaatggataatagtatatttgcatatctgcctggatgtcttgggatggactgtgtgacctttttattctctgattacaagtaaaaagtttgacctcctttttcttaatgtttgtcttttctagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggtaagagggtatttttttgagttgtgttttacttagctttattactatttgtaatatataggagcagaggattctatcctttctaaaagtaaagaaattttagagtagtagtactcaaagaatggtctgagaatccctagggctccctgagatctttttagggggtcccaaatgtcatttattttcataacaatactaagatattatttgccattttactgtattgacatttatttgcactgatggtacaaaagctgcagttgtaaaaaaactgctggttccttaacacaaatcaaggcagtggtaaccagctgttccagtagtcatggtattttccactgccactccttcactatttacataagggaaaaagctagtttcacgtaaaaatgtcctgataaagcagtaaaaattattagttttattgaaacccaatctttgagtttcacatcactttgatattctgtgacagaaagggaagcacgtgtagagcacttctgtcccccaaagtatgatggttgtctcaaggaaaagtacttgtgctcttgttttagttgagatctgaactaactgcatttatttcatgagataccatttttacttgaaagggcaaatctgattatgcagacttgattcagtatttggcaggtgtttttctgagaatgaatggagtaagtctgtcatttcaaggaaaaacaactgacaatgttttttgccattaagttttcaagtaaaaattatagtttaggagaactcctatttgccactgtgggcttatttgccactgtgggcttgacagcttccgaagacttttctgatgagattggtgggtattaatgaatgtggttttaaatatacaatgaaatgtgtccacatttggaagatctgtataactaagaatgaatattttctcagtgaccaatgcaagatgttacaagatcatgtgtgaataaacaattcattcaaagttagaccaacagattttaatgtaacagtatgaaaagttcactgatacactttcagtttccacattgtaattgacttttatgaatcttacaagttgtacagttttgatgtagtatcagataattatattcacaattatctaaaaggttgttaaagggctcctacccttttcaactatctatctttgtgggtttggattttcttctctatgtacttcaaccaaaattgcaacagatgaatgcagaaataggagaatctggttgtctcgtgttacaagtcaaacacatttccacatgtataacattctaaaacaatgacactcgtctcactaattttttttttattttggaaaatacaaaatatacaaatactttgtacaaaattaaattacttatattaacatggggttattctaaaatgaattattaaataactacttttttactaaatctcagtagatatgtcaaataaacaagttctttggagtcctcaatttttaagatgttaaggggtcctgaggaaaaaaggttgagaactactattttcaagtattaagtatgatttttactaaattattttcaaatgccttttttttttgagacagggtctcgatctgtcacccgggccggctcactgtagcctcaacctctcaggctcaagtgatcctcccaactcagccccgcaaatagctgggaatacaggtgcgtgccaccatgtctggctcgctctgttgcccaggctggagtgtagtagcaccatctcggcccactgcagcctccacttccgaggttcaagcaagattatcatgcctaagccccccaagtagctgggactacaggcgtacaccaccacacctggctaatttttgtgttttttgtagagatggggctttgccatgttggccaggctagccatgaactcctcacctcaagtgatccgcccacctcagcccacccaaacacctgggattacaggcatgagccaccatgcccagcctaatttttttttttttttttttttgtagagacagggtttcaccatgttgcccaggctagtcttgaactcctgggctcaagcaatctgcccgcctcagcctcccaaagtgctaggattataggcatgagccaccacacctggcctcaaatgctgttaaatgtctttagttcatttaatgttcttattttttaatcttgtaggaataatagcccatacatcaaattaaactttgtagaacatgtggcttattggaagttggtggctgagttacatcttttattcttgtctgccacagacaagcaactgtagtttgttcctagattagggaaaaaagtattccccctattcaccaccatggctatgtgtggacttcattcccttgtccttcagctctgtatctagttgaattgctaactaagcatggatctggaaaggaaatatagtaagcagaaactgaggagttactttctgtctcttgccactcagccttccctgcttcctgtatcatttgtgtgcctggtgaattctgcttcccgtccagctgtgctctttccaagctccagttctggccacgcccctgctctcttctcctttgggtctttagtaggttaatggctcatgagatattaattttttgtttgaataagatagcagtaaaaatcaaatacagtcttgtggcagataattatgacagttattttagaattttgttgttgttgttgttgttgatttaggcatatgaacctccagggctgccagaatgggtgtggcatcattatttaggtgacctaagagtgactgaccttgtcagacccccttgttcctgccacctgctaaatccttactctatccttagaattcctgtcttaaagaagctgagagttaagataacaggtccttttagcagttatcttggtgagcagaattaagaattgttgagaatttatattggtatcttctctactgagattttctcagtaaaacactatggtgaatgagtttcctggaattttaagcagagtaagaagattttctgagttatttttttaaaatacaagttgggagaaaaaaagaggcaactttcagttgactttgtacctctgacacacctgtctagagtcagtgcggtctcatggaaaaagcttccagccgggcattaggaagccagggttcctgtcttccctgttccttgtggtgtgttaacatgagtaagccacttaatcttacctgcttctgtaaaaagaagtctgtggagagcttatgtgattccattcttgttccttctgtaaagaatgcgggaacaaaaaccataaaagactaataccaacacaaagagacccttagaggcctccttaagatggtaattggaaatactaggatagagcaatatacctctggtaaaacatctataacataacgtatttagttgcctacaaaacaagaaacattggttaggcagtttatagttttgtggggttttttttttcctttttttttttttttttgagatggaatctcactctgtagcccaagctgaagtgcagtggcgtgatcttggctcactgcaacgtctgcctctggggctcaagtgattctcgtgcctcagcctccccagtatctgggacttcaggcgcgccccaccacgcttggctaattttttgtgttttagtagagacagggtttcaccatgttgcccagggtggtctcgaacttttgagctcaggtgatccgcctgccttatcctcccaaagtgctgggattacaggcatgagccactgtgcccagactatagttttatacttatattttatagcattaggtagtttatcaaaatgaagaaaataatataaatggacagtagtataaatattattcattgaactccattgatcccttatattgtacctctcccaagggaataaatagaaatatttcaatggaaagtcatcctaatttggggattctagtatgacttcagtatttaacatagaactataagagcctatctgtaaaaatcccattgaaaagataaacatatcataaaatacacaaattcaagctatacctacacttgctttgtatatgtcttttgctttgtgtatgtctgttgcttttatcataccatctttttctcttttctttttttttttttctttctgagacggagttttactcttgttgcccaagctggagtgcaatggcatgatctcagctcactgtgacctccacctcccaggttcaagcaattctcctgcctcagcctcccaagtagctgggattacaggcatgcgccaccacacctggctaattttgtatttttagtagagacggactttcaccatgttggccaggctggttttgaactcctgacctcaggtgatccacccgttttggcctcccaacgtgctgggattacaggcatgagctaccgcgcctggctagccgtaccatcttttaaactctattctttactttcttcatctaaggttatgataatcatatatactacatatattatatatgattatataagtatatattattatgttgaggattaagataatgtacaccatcgcctagcattcagcctaacaaatggtaagcactcagatgttgattattattgtggcagtgttaggatttttcactggttttataatggaatggtaaaagctgtgttataacatcttgggtcctgacttcatctgttgactatgcatgcgtacaaaccttggaaacaatgctcagccatcttgcttagccccaggaagttgggaaagacagaatcaatctaagggaactgattattactactgtggaatatgttacagaaattagagtgaagaggtgatgatttctcttactaggttttcttaactaaatattagaggttgtgaattattagaactggtcatagcccatttaaaaagaagctgaattaagaacaaggattttcatacatacttctataataggggttctgttcttttaccctactccccccagcaaatatattttcactaaaatggaagagggcaatagatttggaggatgaaagaattatttctaccctttttttttttttttttttttgagacagagtcttgctgtgtcgcccaggctggagtgcagtggcgtgatctccgctcattgcaacctccgcctcccggattcaagcgattctcttgcctcagcctcctgagtagctgggactacaggtgcatactaccatgcctggctaatttttgtatttttagtagagatggggtttcaccatgttggccaggatggtcttgatctcctgacctcgtgatccacccacctcggcctcccaaagtgctgagattacaggcgtgagccaccacacccagcctcaatcttactattttttggattctttgtacaattagtataatttaggtgacaatcatattaatatttgtgtcgaagccactttggtttttttattgaggtattatttacgtataataaagtttacccttttaagtatatagtttgatgaattttgataatatttctgtaactaccaccacaatcaaaatataaaacaatttctttaccctaaaaagtatttttatgtccttttgcagtcactttccttcctggaccctgagccccaggcagtcactaacttggtttctgttactataattttgccttttgtagaatttcatataaacagaatcttgtattatctttggtgttgacttctttcacttaacataatgactttgggattcatgcatgttgaattcctgagaagtattccacaatttgggaatgccacagtttgttcacccattcaaaaataggacatttggttgtttgcaatttggggctattcagtttttcatatccttattaacacgtagtattgtcgatctttttaactttagccattctagtaagtatgaagtagtatctcaccttggtttttgtttgcatttccctgatgactagtgatgattgagggtctctcttcttgtgcctagtgggcatttgtatgttttcttttgtaaagtgtctgttcagatcttctgcccattttaaaacatcagttgtttgtcttactgagttgtacttaaaaggacaagcactttggcaaatatgatctcccagtctatcttgcctttttattttcttaattggtcttcggaaaagtaaaagtttttacttctgattaagtcagctttatcagttttttcttttatggtttggttacctactgttattaaccatttttggtttgatgtgattttttgtttactatattacagactaaggtacagagaagctcggtaaattgcccaaggctatacagtaagtggcagagccaggattcaaatccaggtagtctttcttaagttatgttagatcttaaggtttaaaacatagcccaaaccaggtacagaaatgaagtaggtcctggttagcagtatttatcgagtgcctgatatacagtagaaatttctctttttttttgagacggagtctcgctctcactcaggctggagtgcagtggcacgatctcggctcactgcaacctctgcctcccgggttcaagtgattctcctgcctcagcctcctgagtagctgggattacaggcatgcaccaccatgcctggctaatttttatatttttagtagagacggggtttcaccatgttggcgaggatggtctcaatctccagacctcgtgatccgcctgccttggcccccaaagtgctggtattacaggggtgagccactgcacccagccacagtagacatttcttaccagtaatgatatgtcatagtaaggtttatcaaaagcactggcgcttgtgttcgctcgctctctctctctctctctctctttcttcctcctcctccctctttctctctctctttctctccagagacttgctctgttattggggctggaatgcaatggcaccatcataactcactacagcattgaactcctaggcttcagtgatcctcctgcctcagcctcccagagtgctgggattacaagcatgagtcactgcactcagccaatatattcttagtatctgtttacttttttttacatgcagtttaggagcattcaggagatttttaaggaaagcttttaggctaaaatatttaatttttttaattgtccccaaaagtgtgagccagaaagacagcaaactttaagaaagtacttactttggtttttcctggtactttgcgatagaggaggaatgcttccaatttccactgctgagtggatatcagggaggagctgatttaggctgtggaaagctgagcaaatttctcactccatttaaattcgatattacatcatgcctttgttctctttttgagtacagtgttgtggtgctatagttctttgcaaagagtaattaaaacatgacccctaccttcaagtatgtaacaatttagtctggcagagttgatccttaaggctgtcccaggacagataatgctaccatatctgttttctttccctgtttgtttgtttgtttgttttaattataagccatgaaggtggggagggattatcctgtgattagttctcttagtagttagagaaatgacaaaaatacaatgtaacataagatatgaacactttaaaagagtcttaaacataaattactgtaatctcagcagtttgggaggccaaggcaggaggatcagttgaacccaagggttcaagaccagcctggacaacatggtgaaaccccatctctacaaaaaatacaaaaattagccaggcgtggtggtgcacgcctatagtcccagctttctcaggaggctgagatgggaggatcactggagcccaggaggtccaggctgcagtgagctatgatcacatgccttcactccagcctgggtgacagagcgagacactgactcaaaacaaaatacataaattaatttgtttaattcatgattagttactattggtagggagtagggatgattattagagcccttttatagctattttaaaataaaactaggccaggcgtggtggctcatgcctgtaatcccggcactttgggaggccgaggcgggcagatcacctgagtttagaagttcaagaccagcctggccaacatagtgaaaccctgtctctactacaaatacaaaaattagctggtgtggtggcacatgcctataatcccagctactggggaggctgaggcaggagaatcacttgagcctgggagtggaggttgcagtaagccgagattgtgccattgcactccagcctgggcgacagagcaagattccatctcaaaaaaacaaaaacaaaaaaacctaaaatatatgaggaaaaggtatacaggaaaaataatttgctttatttagtataaaaagaagaaaggatttctgtattatctgttatatgaggtttttcttatttttaacataaaaattagcagaatatgcaagtagttaaaatagagatcagaaattggtactgagtcctaggaatccctcaaggaaggtgaagcaggaatgaatcagatgcatttttattacctgaagcttattagtgattaaccttgtttgtcagcttttatattttgaaaggaaatcttttacagttaaaatatttacctttcttgttcttttctactcccatatgaaaaagtaattttttttctgtatgatatggtgtagctttcatcctatagtgtgttcaagatgctcatattcaaatgtaaatgtacatttaaaaggtagtgatttttcaacaagggtgccaagaccattcagtgggagaaagaacagtcttttcaacaaatggtgttggaaaagctagatatccacatgtaaaagaatgaaattgggtccttatcttacaccatctgcaaaaattaactcaaaatggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactaaaaaaaaaaaaaaaaaaaaaaattagctgggcatggtggcgcatgcctataatcccagctacttgggaggtggaggcaggagaatcgcttgaacccgggaggcagaagttgcagtgagccaagatcacaccattgcactccagcctaggcaacaagaacgaaactatgtctcaaaaaaaagaaaaaagaaaagataaagaatatggaggaaaggcttcatgacattggattttgcagtggtttcttggcatgacatcaaaagtacaggcaacaaaagtaaaacaattaaacataaattactgtacatcataaattaaacataaattagaatacatcaaaattaaaaacttttgtgcatcaaacagtaacagaatgaaaggcagcctatggaatgggagaaaaatgtttgcaaatcttatatctgataagggattaatacccagaatacacaaacaactcctataactcaacaaaaacaacaaaatagcccaatttaaaaatgggtaaaggaccagttgcagtggccatacctgtaatcccagcattttgggagacctaggtgggagggtcacttagacgccaggagttcaagaccagtctgggcaacatagcgataccctgtctctaaaaactttttaaaaactgggcaaagggcttgaaatttctccaaagaagatataaaaatggacaacaagcatatgaaaagatgttcaacatcactaatcattagggaaatgcaagtcaaaaccacagtgaagtattaccctcataccggttagaatgggtactgttaaaaaaagagaaaacaacaagtgttgatgaggatgtagagaaattggaacccttatgcgctgttggtgggaatgtaaaatagtgcagctgctgtggaaaacggtatggaagttcctcaaaaaattaaaaatagagttaccatgttgatctagcagttctacttgtgggcatataaccaacagaattgaaagcagggtcttgaagagatatttgtacactcatgtttgtagcagcattattaacagcaaccaaaaggtggaagcaactcaagtgtccttcaatagatgaatagataaacaaaatgtgatataaacgtacagtggaatatttacgttttaaagaaaaattctggcagatgctacaacatggacgaaccttgagggcattatactaagtgaagtaatccagtgacaaaaagaaaagtactgtctgattccacttatatgagttatctatccagagtagtcaaattcataaaaacaaagtagaatagaagttgccaaagattagggaaggaggaaatgcttaatgggtataaaattttagttttgcaagatgaaaaagttctggagattggttgcacaacaatgtgaatatacttaaaaatagtgaactgtgcactttaaaatagctaagatggtaaatgcttttttttatccccccacaattaagcgttttttttaaaactcaaggagaaaacattatgtagtcagaatgttctgaagtggtcactatagtctttactataaatgaaactgttaagtgattaaaatgttgtatcttaaaatatgttatataatttttttaaaccagaaaaaagtgtaacattacagaaggaagaaaaagtataatgcattgcttttatactgggctttgtatgcttttaaactttttcacctgcctatagttacatacgtataaaaagcatttaaatttagtaatagctatattatacatttgtatacatatatattcttgttttatattttattacaaatggaataagactcctgaaattgataaattgtgtataagctagtaaaactgaagtccagatcaagtgtaagaataaattgacgtggccaggcacggtggctcacgcctgtaatcccagcactttgggaggctgaggcaggcggatcacgaggtcaggagatcgagaccatcctggctaacacgatgaaactccatctctactaaaaatacaaaaaattagccaggagtggtggctagcgcctgtagtcccagctactcgggaggctgaggcaggagaatggcgtgaacccgggaggcggagcttgcggtgagcagagatagcgccactgcaccccagcctgggcgacagagcgagactccatctcaaaaataaataaataaataaataaataaattgacattatgtattcttggtgtgtttttttttgagacggagtcttgctctgtcgcccaggctggagtgcagtggcgcaatctcggctcactgaaagctccgcctcccgggttcacgccattctcctgcctcagcctcccgagtagctgggactacaggcactcaccaccacgcccggctaattttttgtatttttagtagagacgggatttcaccgtgttagccaggatggtctcaatcctctgacctcgtgatctgcccacctcatcctcccaaagtgctgagattacaggcgtgagccactgcaccggcctattcttggtgtatgttacctatgactgagatcctgaagatgaagaatctttaaaatgtttatgctttgggggttgggcatggtgactcacacctgtaatcccagcacttcgggaggccgaggtgggcagaccacttgaggtcaggagtttgagaccagcctgaccaacgtggtgaaaccctgtctctaccaaaaaatacaaaaattacctaagcgtagtggcacgtgcctgtaatcccagctacttgggagtctgaggcacgagaattgcttgaacccaggaggcagaggttgcaatgagccaagatcgtgccactgcactccagcctgggcaacaaagtgagaccgtgtctcaaaaagaagaaaatatttatgtttttggtccagtaattctacatctaggaatttaacctaaggaaatgtgtagaagcttgcttaaccctctccagactaattgatgctctccattctgtttgcatatatactgagtgatacaactggtttcttgttctgtggtgtggtctcacacattgctcccgtcagtgagtgggccttgtcagtgccctgcagccacagaccactaggaacacacctatagttgaacacgttggttcattacttgtgagggaggatgcacaccatgcgaactgtggagtatctcagtaagagtgttaggaggaatattttataggacttgtgcttgtattaggtgattttggggagtttaagaaagcagagctttctcgattggatgctgttaggatgtggggtgattgatgtttgggtatcttaataaatcttattaggacgtgggccaactagagtagagtgagaccaaagctagaactggtagagaagcagcagtcactcatattagccaggagagggggatgtttggtattttgtgaaaatgctcagtgaccttgtttttttcctctgggcttagacaaaaaaaaatttttttttcttttttgaaatggagctggggtgcagtggcgtgatctcagctcactgcaacctccagctcccaggttcaagcaattcttctgcctcagcctcccaagtagctgggattacaggcgtgagccaccgtgcccggccagacaaaattttgaagtatttttgttttgtctcacttgaacacagtctcagagtgaccttgtctcatgttgatattttgcgagattgtttatgtcccacaggagaataatatggcctccctatgatccctaggccagcttcaaacagcactgaggtccagctgtaagtgttcaagcagtttccagacgttggggaggctttttctttctcaaactcttgttaagaatcagttgaagccaggtgcctgtagtctcagccactcagaagctgaggtgggaggatcacttgagccaggagtttgagtccagcctgagcaacatagcaagaccctgtctcttaaaaaggaaaaaaactgggctgatgcaatggctcacacctgtaatcccagcactctggaaagctgaagcagaagtatcacttgaggctaggagttcaagaccgacctgggcaatgtagcaagactccatatctacagaaaatcatggtggtattcacctgtagtcctagctactagggaggcagaggcaggagattctcttgagcccaggagctcaagaccagcctgggcaacatggtgagactgtctacaaaaaaaaaaaaaagaagaagaaaagaaaattagcccaatgtggtggtacatgtctgtggtcccagctacttgggaggctaaggtgggaggaccgcttgagcctgggaggttgaggctgcagtaagctatactcacatcattgcactccagtctgtgtgacagagcaagaccctgtctcttaaaaaaaaaaaaagtgatgtagccatttcgtaaagacagttgggcaataactatcaaatttaaaatgcatatcacctttgcacttccaggaatttacattccaaatatacttatgcaaagtaggcaaacatacatggacaagtagtctcattagattactgttggtaatatatgcatcaatagaagattgtagtattatacacccattaagaatgaggtaggtctatttgcatttattatgatgatgatgtctttcctttatcaaatacatattatgtgccgggcaccgtgccatgcatttgatgtgttttatctaataactctttatttatttatttatttttgagacggagtctcgctctttcgcccaggctggagtgcagtggcgctatctcggctcaccgaaagctcctccttctgggttcacgccattctcctgcctcagcctcccgagtagctgggactacaggcgctagccaccacgcctggctaattttttgtatttttagtggagatggggtttcaccgtgtgagccaggatggtttcgatctcctgactttgtgatccgcccgcctcagcctcccaaagtgctgggattacaggcgtgagccaccacgcccggccttatctaataattcttaaaacaactattaatatatggcaagtactgttattatttacattttgcaggtgaggagactaagcacagagattaaataacttgcacaagtttacacagatagtaaagggcaaacttggtattcaaatccaggtattctgaagttagagtatgctgcatttttgacctctaaaatgtacatcctcctttctactgatggagaaagaggatgaagatatataataaatgaaaaagtagtttagaactgaatgtctagtttgctgtcatttgtattttaaatttttttaaaaagtgacagcacacagtaggataccaaagaaacgtaacagttacttataaggagcagatggatggcctttcagctttcactttccatctctttcatgggtgttttaataataggcatgtattacttgatttttttttttttttaagagacagggtctcgctctgtcacctagtctggagtgcagtgacataatcattgctcactgtagcctcttactcctaggctcaagctcttctcctgtcttaacctccaaagtagctggagctacaagcatatgccaccatgccgcactaattttttaaatttttgtagagatggagtttcactatgttgccctggccggtcttaaaactcttgggctcaagtggatgctcctgctttggccttccaaaatgctgagatgagaggtatgagccactattcctggccacttacatatatttttaactgaaataaatgtagctgacattttgaaaagttgtaatatttaatgaagattaagctaaagtcatgaataaaaaatggtttatctatccctgcttacatactgttatgtagggtttcccttgtcctaatatcctaccaccagctcacttcaaattcacttcctctggggttcatctcttatctgatcctacttttgaatacttacatttttgtttttgttttttgagacaggacagggtctccactctgctgcccaggctggagtgcagtggcatgatctcagctcactgcagccttgacctcctggactcaagtagtcctctctcctcagcctgctgagtagctggcaagcaccaccacgcctggctcattttttaaatatatttttttgtggagatggggtttcaccatgttgcctgggctggtctcaaactcctaagctcaagggatctgcccgccttggcctcccaaagtgctgggattacagctgggattacaggcgcgagccaacgtgcccagcccccagatacttaatatttctgattgacagagtacctcatttgtcatttagcctttttttttttttttttggagacagagtcttgctgtgtcgcccaggctggagtgcagtggcatgatctctactcactgcaacctccgcctcccaggttcaagcaattctcctgcctcagcctcctaagtagctgggattacaggcacgcactaccatgcctggctaatttttgtatttttagtagagacggggtttcaccatgttggccaggcttgaattcctggcctcaagtgatccgcctgtcttggcctcccaaagttctgggattacaggcgtgagccaccatgccccaccaaaatgtaatttagccttttaaatggcctaaattttctattgtttccgaaaggacttgatactgcttacagtaagataatgatgcacatcataggaactataaacattgagattacaattatatagcctaatatagttctacaattgagcagtaaatttaacttagtttcctggaagtaggcaaaaaataaaatattttaagttctgtagttgtggtttgacaaaaagacacatatgtttttgtttaaaggaacatttttctgattctaaattttgagaagaaatgtgtttcatggacccttttatgcaatttatcctgttctggttacttcttgttttgttgttttttttgtctacccaactaaattataagcttccttaggacacactctatttttcaatactatttttgttctatctctgcctagaaaatttgcgcttattatagttgaaatgataaattaggcaacaattgcaacatagccatatttcatggataatgttaccaccagttttcaaagacttaatttttgagtagtttaggaatttatattactttcatccctttcagcagggaatcctttttgagacagggtctcactctgtcacccaggctagagtgcagtggcataatcatgactcactgaagcctcaatctcctgggctcccaggcttaagctgtcctcccaccacagcctccggagtagctgggactacaggtgtgcaccatacccagctgtgttctttggttctttggggtgttttttttttttttttagagatgaggtcttgctgtgttgcccaggctggtgtcaaattcctggactcaagcagtcctcccacctcagcctcccaaagtgctgggccgatcaacagggaatcttttgtgatagccttcaaaaaaaataatttatttatttgtatgtagcactctgtcatcttgtagcccatactttctagctgagtatgtagtatgaaaaactggaaattagaactttggttttatgaaagttaaatctttttaaatagggcttatagctttcaactaccttttcctttcccttaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgaggcaagtatgtgtgtgatgttgccttgtcagcatctgctctacaataggaatggctttgaagcaacaggcagtgggaaaaggagctaagcttgctatagagaatcagatccaacttacttattttggagcatggcttcttgaattgtttcccacaaacccaagggtgcgcgtgccagtgctttcttagaaacgtgtttctagcacaaaaaggtcatatccaaataaacaaaagacgctacacttagaaataaagattctggtccatggtgtgagtgtgacatactcaaaattgaccagagtacaggatggaaatgttggcgataaatgttgaaatatgcctatgtcacgttgcggggtatttacatattataaaaatttatgtgtcacagatctcacttctctagaagccgttggtggtgataaaacattattcatcctatgttgaattacatatatttggcaaaacttgatttttaagaaccaccccagctaggtaaaatacacctttaatcagtcgtaggtcacatccatgagatttattcttacattttgagaagggaactccataaacccaggatgggaaagttgtggcctcaaacaaaatagttctacaccagcaccttgtagctctggctttttgcccacagggtagttttcctagtatttcctatctttgcactgcagtcccttaggatatagttctagacattagcattacatgaaattctttccaagtatggaaaagtatagtgggtttttttttttttgctacttttccaataattaagatgcataaatgaatgtatatattttaaaacagctttattttgtaaaatgaaataattggttgcccttgccttcacatatgttcagttggctttatttggtcttttctcagctgaattccttttttctttctagattgagctccttgatttcaaaggagaggatttatttgaagatggaggcattatccggagaaccaaacggaaaggagagggatattcaaatccaaacgaaggagcaacagtagaaagtaagtattaaagtaagagggaactagtccttaaaagttgggccatttatgtggacgaaatggagacttaaaaaaaaatgtttgtagaaatgaatatatcggctgtgcgcagtgactcacgcctgtaatcccagcactttgggaggtcgaggcgggtggattgcctgagctcaggagtttgagaccagcctggccagcatggcgaaaccccatctctactaaaaatacaaaaaactagccaggtgtggtggtgcacgcctgtattcccagctactcgggaggctgaggcatgagaatcacttgaacccgggaggcaggggttgcagtgagtcgagatggtgctactgcactccagcctggatgacaaagcaagactctgtctcaaaaaaaaagtattgaatatatctcaaagatagtcttagctgggcacagtggctcatgcctgtaattccagcactttgggaggccgaggcaggaggatctcttgagcttaggaattcgagaccagccaggacagcatagtgaggccccatctctactaaaaagcatcaagagaattagtcaagtgtggtgtcacgtccctgtagtcccagctacttgggaggctgaggtggaagaatcacttgagctctggagatgaatgctacagcagagagccgtgattgtgccattgtgcttcagcctggacaacagcaagattctgtccaaaaaaaaaatagtttcaggttcaacatttatttaataattttatttagtaaatattaattcaacatctacgtgtcaggcatgctaccagcctctacaaactcaaaaatgaatacaaagtaattccatccacaagaaattctcaatctgtggactctctggtgtgccaacaactatattagttgcctgatatgtttgttcatttatttctcacaaccttaagaggtaaaatttcttgtccccagatgagaaaagttaattcagagatgttaaataaattgcccagggttacagagttactaaacagagcagtagattataatcccttttaggactcaaatacatctcatcagctgtcatcaagattaaaaaatagttcatcatttagatcaatattggataataatgttcattctattccatatcaggagacctaggttcaagtcctgctttggtgtttattgagtaacctgaagctattccgtttcttcatttgctaagtgggagtaggggcagctctgaggactgagatagctaactcttcttccctcccagagcaaattatatgtaccactgtgtatactacttgtcactttacattgtaatcagtatttgcccatttctcccagtatactttgagtgcttgaggaccagaatctttcttcatccttttgtgttcagcatttcctgcagtgcgtgacacacatttggtgttcagtaaaggctttctgcatggataagtgcttgagaagtgtcattagtgagctgaaatccttcaaaagagagttgtgagaaaacagagaaatacttccattaagaacaaaaatcaaatcattcaacaaggatgggaacatgaactattattataaaaggtctgtttaaaataattatttcaaaagccaggtgtaatggtgtgcacctgtagtcccagctacttgggaggctgagataggaggatcactagaggccaggagttcgaggctatagcgtgctatggttacaccagtgaatagccagtgcactctagcctaggtaccatagtgagaccttgtctccttaaaaaaaaaaagtaaagagttcatttaaacagaaaacaagaatagctgagtttctttcttttaaagtatatactattttcaacccatatttcatttctacgagtctggcaaatcagtttaaattctgttgttttgggaagcagttacaaatattatttatcccaaattgccatttgggataagtttttgaatacatgaagagctttaaatgtagaataccagggaaatagctccagactaggagttgggagatagggttccagcctcagccctggcctcaggctggcttcaactagacttcacctctgggcgttagcttccttcctatgcagtgaggcaagcttgaacctcttgatttttaaggtcctactagccctaaaactccatcatagaattctaaatatttacaaaagttgtaggaatgatagaaaatcatcttcactatattagtaagcacttaagcttgtctataatgtgtattttaaatttttcttatgaaaaatttcaaatgtatgtacaaaggtagaggtttactcctatggatacaggcacaccctagattcagtaatttataatatatatttttaaactggagggttttgtcaactaagaggaaaaacttttcccaattatagacaatatcacaaaattaccgctgtggagatgactttagagcagactaaattaaatcagatcttgcttttggtaatacttgcgatgggagtcaatttttttttaactttttgttttgaaataattttagaattacagaaaagttgcaaaactagtatagcgcgttcccttatatgctttacacagcttcctctaaatgttaacatcttacctaatcacagtacatttatcaaaatcaggaagttaacattgatgtagtaccagtaactgttttccagatcttatttgaatttcaccagttactacactactgtcgttttctggtctaagatcaaactcaggatccagcattgtatttactttttttttttttttttttttttttgagatggagtcttgctctgtcatccaggctagagtgcagtgatgctatcgcagctcactgcaacctccacctcctgggttcaagcaattctcctgtctcagcctcccaagtagctgggactataggcgcacgccaccatgcccgactaatttttgtatttttattagagacagggtttctaacatgttggtcaggctggtcctcaagctcctgaccttgggtgatacacccgcctcagcctcccaaaatgctgggattacaggcatgagccaccgcacccagcctactctactattttgaatacaactgaccgttttgtagaatatccctcaatttgggtttctgggatgtttttagattgaggttatgcattttttgaaaataccactgaagtgatgtgcctttcatcattatcaagaggtatatgatattgatgtctcattactggtgatgttaccttcgaacactgggttaaggtgggaaaccatgtttcactactgcaacgttactattttccctttgtaattaaaaagtattaggagtgaagtactatcttgttttgtatcacaactttacacactcattttgacatttgttgatttttgcttgcaacagttattactgtggcatttgactaatggtaaattttctattgctgttattctctctacattaatttgaatcctactgtatatttattcagtttatttatatcattatggatctgtgtatatttattccataagttattattcattactattcttatttattttgttgttcacattgtcccagatttgaccattggaaactcctttaagtttgtttttgtgtcctttcaatattatccccattttttttaagtgcttccttattttctggtaccacaagacactcatggctcatcttaaaattttcctgccctagacctggaaccaaccatttctccaaagagccctgattccttttattggagaaaggcatttagaaaccaagatctgagtgctaggtttgctcctgctatgggatatcatcattcctagacccacttagcagacagagagatagagaatatatggacctcaacatacatacgtatacatctatatgtatttctacatcagcctctgtgtgtgtgtgtgtgtgtgtgtgtgtgtgtgtagttgttgttgttgttgttgttgttgttgtttgcgacagagtctcactctgtcgcccaggctggagtacagtggtgcaatctcagctcgctgcaacttccgcctcccaggttcaagtggttctcctgtctcagtctccggagtagctgggatttacaggtgcctgccaccacgcccagctattttttgtattttcagtagagatgggatttcaccatgttggccaggctggtctcgaactcctgacctcgtgatctgcctgccttggcctcccaaagtgctggaattacaggaatgagccaccgtgcccggccagcctgtatgtatatgttaaaaaccagggatactcactggcagttgcagttccagttccaatccaacaccacaagtttatttgccctttgctcatttgaaactccattctccagaagtgagaaaatgctctcattctccacagcatactcattgctcccatcctagtgtatatgtaagatggttttagaattgctaacctagacccctgtgacaaactgactttaggaaatatttgtttatagtaccttttgtcatcagtcttatagtgtatattcaaaacacttgctttccaactgaggtaacttctttcttcctcacccccttcaatgtgattatgttactcaattgtaacaaattattcatttgttaccctgtatattccattttgggttcctgccatgctctggttaattttaattattcgttttattttggatatgtgaaacattaccatgattttaaactatataaaaaacgatatactcaaaagtgtcatttccccctcatccttattaacctgttcccacttccccattatttccaccctattccagtctcattagttatatcattagatcctggtttttcttcctgtattttattacgttttatgtcattttatttttttctgtttctgttaacaaagggagccagtcgtggtggctcacacctgtaatcccagcactttgggaggctgaggcaggaggatggcttgacctcaggaatttgagaccatcctgagcaacatagagaccttgtctctgcaaaaagtttaacatttagccacatgtgatggcacatgcctctagtcccagctacccagaagactgaggtaggaggatctcttgagcccaggagttcaaggctgcagagagttgtgatcatgccactgtactccagcctgggcaacagaacaaggctctgtctcagtttgaaaaaaagagagaaagaacaaaagaaagggcaatgactaatcttttgtctttcatcttgttagaatgtactttcctgggaaattttagattaaatggttgattttactttttcactcaaaagaccgtcttggttttctggaacaaatctatttcatagaaatttattgtgttatactttcatttatcaaggttaaaatgtcctggtttttcctcctttaaacaagttagctatctgggggaggagaaaaaagattaccctaaaggtggtcctgttcaaaaccaagatcaccttgttctttttgaaatcttctcagtctttactggtttgccttttctttatagcatcaccaaatacacttagatgtgaaaccagatataaaacctggaactaggccaggtgcggtggctcacgcctgtaatcccagcactttgggaggccgaggtgggcagatcacgtgaggtcaggaatttgagaccagtctggccaacatggcaaaaccccatctctactaaaaatacaaacaattagctgggagtggttgtgggcacctgtaatcccagctacttgggagggtgaggcaggagaattgcttgatcctgggaggtggaggttgcagtgagcagagattacgccactacactccagcctgggtgacagagggaaactccgtctcaaaaaaataaataaataaaataaataaaacctggaactaaagccggctatagagtgaacaagaacaatagacactgatcacccattacaatatgttgttatagatacgtgatttactaaatttctgtcatttctgtgtaaagagacaatgaagtggtatggaggaggggacagatagactttgtaagtgatggacttgatttttgaatcttggaattgctacctgatacttttatgactttagacaagttacttaactacgtggagcattcagtttttttaatctgtcaaatgggaatagttttcactcccacaggttgtgtgacagtgataacggtttggctgtgtgcctacccaaatctcgtcttgaattgtagttcccacaatccccacgtgtcgtgggaaggacccactgggaggtaactgaatcgggggggcattttctcccatgctgttctcatgatagagtgagttgtcacgagatctgatggttttataagggtctggcagggaaaccctgctggctcttccctcttctgccgccatgtgaagaagggtgtgtttgcttccccttctgccatgattgtaagtttcctgaggcttccccagccatgtgaaactgtaagtcaattaaacctcttttctttataaattacccagtctcaggcagttcttcatggcagcgtgagaatggactaatacaaacagttacaaagaagagtgtcagacatttagtggacacttaatttcttctaccctatatattgtgtttcactaatttgttttgcttccttttaattgatctaaggaaaaagatccttgactcctctttttctttttctgttgcccaagctggagtgcagtgggccaggctggagtgcaatggcgcatcttagctcactgcaactgctgccttccgggttcaggtgattctcccacctcatcctcccaagtagctaggactacaggcacgtgccaccacacccagctaatttttgtatttttagcaaagacggggtttcgtcatgttagccagactggtcttgaactcctgacctcaggtgatccacctaccttggcctccctaagtgctgggattacaggcgtgagccactgtgcctggctgactcctctttttcttatctcctacatgtcatccatcagcaaatcctcttggctctacctaccatggttattagagacctaaaattgtctctaataacagtcttcaaattaatgatatatcttaatagtaatcttatctaaatcacatttctcaaggttccggggaaagaataacattatggactcaaaaaggtttttactgaattgtaaacttttacttccttttcataatttgtctctgtgtggaagagaaaacttaggttagtttgatgggatttattctttctcaaggaaattttgatttttactctttatatgaggatcctaatggttacaaatcagtttttagaatctgtccccctacgctttttcttgtgtcagttaagatgaccatcttgtaatttttattcaaagtttttctttcatttaaaaagttactgtgttctaaggtactctaattgatatgattatgatgactgatacttcagtctttaagtttaattgcaggtcttggctacattgctacttttcagctttgctttcttagaaaatcaaatctgacttacataaggttctaaatagctaccagttactcttcccccatcccccagtctctcacatcgtctgatttgtcaactttagtggttggaagaggcccatcaaaatgctggctgtatgtggttctctcgcctctcagtactttcagccacatttgaatgcaaagaatgcagacagtcagcagtatttttaaatgtgaaattttcaacagagtgttctacaggttccagttgttggcgtacctcctttccctctccaaatctcactgaaatgatagatggagggaacaaagattttcaaaagaagaagaagagatcaataatagtgctggaaaggagaggaatgtaagagtggatcagaaattatggagaatttctggaatatgtaaagttgatgaagttgaaccaatggaaactagtctcagcaaatccaacccgagacaggtgtaaagaggacttaagcagaggtacacactgttcttctcaacaggcttaggcggaactccaagctcatggtcatctggtgtgagggagcccaagcaggctatgcagcaatcatcagggttgttataaaacaagatggaacagcggggccagtaaacctccagtgcagtagttctcaacttttcctgaatttagaattacctagggagcttttaaaaattctgacacccagaccagttaaataagaatctcacatctcagaagatggaactccaggcacaagtatttttttttaaactcccagattattctagtttgcaggcaaggactgaaaactactagactacggtctgactgtgactttttctcccaagctaaaaccagtaaggccaggttctaaaataaaatagaaaaataataaaataaatttaaaaataaataataaaacaaaatgtgcctcaaaagactccaagtgttaggacttcgactagggaaaatgaatgtattttttgaaacttttttttttttttttttttttttgagacggagtcttgctctgtcactcaggctatagtgcagtggcgcggtcttggctcactgcaagctccgcctctcgggttcacgccattctcctgcctcagcctcctgagtagctgggactacaggcacctgccaccacgcccagctgattttttttgtatttttagtagagacggggtttcaccgtgttagccaggatggtctcgatctcctgacctcgtgatccacctgcctcagcctcccaaagtgctgagattataggtgtgaaccaccacgcccggccttttttgaacttttaaaacaaatttaaaggggaaaaaagtgtaaagacagcttttcacagtaaataatactaaagtgttctgctcctaaagtcaactttcctgtgcccatcatgcccagctcatagtaaatgcttaataaatatttgtgaaatcttcacccttagatccccgcaatcagcccatccttttgcagaaaggcctgccatggaaacatatccaactgcttagaaaaatggtgccagctaactatagtcatttgatcatccagaatccttcctttataatacggccagacagcaaagaatcatcagcaaatatcacgaaaaaagcagcactaaaatggactaacagaagaagtagaagagaaccttaaaaatactaattattgtcttcagaaattgttaacaggacatcagattcataagtcaaaaagccaacttccctgaaaaaggaaagggaggacaagaaagtttctggaagttagagcatgattaatcaaaactgaaactcagaggaagggttgaagagcaaaatggacagtccctgaaatcaggtgatctgaaagatagccaaggatttctcagaacacaagaaaaaagagggatgaaaagtgaaaaagaaattagaagatatggataataaatccaggagaggtaatatgcatccaatcaaacatctaatagaaaatttcctacagggaataaaagaaaaagattcttaagatcgaaagggccagttgatagtggtacccaggaggaaggagtggtttttcacccagatatatcctggtgaaatttctgaattctgcagcttacaagaaaattctgaactcttccagggaagaacaagctatgtacaaaggaataagaatcttattcattacactaaagacaatgcttttgatcattgtctatagctatgtgtattttgaacctagaattccgtactcagcccaactgtcatttatgtatgagaacaaaattaactttttggaatttgcagactcatattcttttcgaaaaaaatactgtgggatgtaccaaaacaaaaaaataagtcaagaagcaacaactcaaggcataagaaacagtagcgagaaaaaaaaaataatttccatattggatacatttatcctgaaagatctctgaagcagtagagctgtaatgttagaagtaatattaataatgaaacagtctggcctgggcacagtggcccacacctgtaatccctacactttgggagggcgtcacttgaggccaggagttcaagaccagcctggccaacatggcaaaaccccatctctagtaaaaatacaagatttagccaggcatgatggcacatgcctataatcccagctactcaagaggctgaggcaggagaatcacttgaacccaggagacagaggtggcagtgagccaagattgtaccactgcctaggtgacagagggagactctgtgtcaaaataataataataataataaaacaataataacagtctggattctgggttattttaacaaaaggtggtgaggataggaaatgaagaggggaaggcaaaattgtctaagattattttcttttttaaaacattttttggagatgaggtcttgctctgttgcccaggctggcatgcagtggcacagttgtggctcactgcagcctcaaattcctgccctcaagccatcctcccacctcagccaccggagtagctggaactgcaggtgcacacccagctaactttttttatccttttagagacggggtcttgctatattgctcaagctggtcttgaactccagggcataagcgatcagcctgcttcagcctcccaagtagttgagattacaggctcgtgtactaccacaaccagctgccttaatttcttgttccaggggagattatgctgattaattcttttattttaagattcaggggggacatgtgccagtttggtacatggatatattgtctgtaatgccgaggtttgggcttctattgaacccatcatccagatagtgaacatagaatatagcccttgtacccctccatccttttttgcttttggagtccccagtgtctcttgtcctcatctttatgtctgtgtatactcagggtttagctcctacttataagtgagaacatgcagtatttggttttctgtttctgtgttaattcacttaggttactggcctccagctgcatctgtgttgctgtaggggacatcctttcattcttttttatggctgcatagtatttcatggtatatatgtaccacattttctttttttttttttatttcaagtctgtcaagctattctttatttcggagagagggcagggcagagtgctcagtccttggcagcggcttttgtcatggtggccaggacattgctcagctcctcctgcttcctcttggtgcatccccacccttgtcttgatgaacttgagggcccatttgtccttggagaccttcagtaactccatggtgcaccgctcgtatggggtgaagccacacagctctcagatcatgtccggcacgaacttggtatatttggtcaggtgcctgcagcagtggctgtgcctgggcgtcctcatgttctcggtcaccttgtggcccttgttgaggcccatggccatagggcagcacagagccatggccgctgctctccaatggtggccgtggcagaaggaagcccacatttttatccaatccaccattgatggacacctaggttgactccgtgtctttgctattaagaatataactgtgcttaagagtaagtgctgtgtgtggctcatgcctgtaatcccagcactttgggaggccaaggtgggatggtcacttgagcccaggagtttaagaccaaactgggcaacatagtaagaccccatttctacagaaaaaaaaaaaaggccaagcatggtggtgcatgcctgtagtgccggctactcaggaggctgtagtgggaggatcatttgagtcacatttataccactgcagtctaacctgggcaacaaagcgagaccctgtctcaaaacaaaacaggctgggcgtggtggcacatgcctgtaatcctagcactttgggaggctgaggtgggtggatcatttgaggtcaggagttcaagaccagcctggccaacatggtgaaaccctgcctctactaaaaatacaaaaattagctgggtgtggtggtgggcgcctgtagtcccagctacttgggaggctgaggcagaattgcttgaacctgggaggtggaggttgtagtcagctgagattctgccactgcagtccagcctgggcaacagagtgagactctgtctcaaaaaacaaacaaacacacaaacaatgctgcagtaaacatgtcagtgtaaatgccagctatctttctgatagaacgatttattttcctttggttgtatacccagtaatgggattgctgggtcaaatggtactttgatttttagttcttcgagaaatttccaaaactgctttccacaggagctgaactaatttccattctcatcaacactgtttaagcattcccttttctccacaaccttgccaacatctgttcttttttgactttttttttttttttttttttttttttttttttttttgagacggagtctcattctgttgcccaggctggagtgcagtggcgcgatcttggctcactgcaactcccgcctcccaggttcacgccattctcctgcctcagcctcccgagtagctgggactacaggcgcccaccaccacgcccggctaattttttaaaatatttttagtggagacggggtttcaccgtgttagacaggatggtctcgatctcctgacctcatgatctgcctgcctcggcctcccaaagtgctgggattaaaggcatgagtcacagcgcccggccttgactttttattaatagtcattctgactcagttgtgagatggtatctcattgtggttttgatttgcatttctctgatgattagtgatgttcggcattttttcatgttcgttggctgcttcttcgtgtcctttgcctactttttaatggggctatttgcttttttcttgttgatttgtttaagttcttttctggatattagtcctttgtcagatgcataatttgcaaatgttttctcccattctgtagtttgtccatctgcttcgttgatagcttattttgctgtgctgaagctctttaattaggtcccaactgtcagtttttctttttgttgcatttgattttggggacttaatcataaattatttgcctaggcaatgtccagaagagtattttctagcttttcttctaggatttatatagtttcaggccttacatttaagcctttaatccatcttgagtttgtttttgtatatggtgagaggtagacgtctggtttcctatttggatgccttttatttctttctcttgcctgattgctcaggctaggacttgccgcatactgattgctgtggctcagtaccatgctgaataggagttgttaagagtggacaccctgtttttttccagttcttaggcggaatgcttccaacttttgcccgttcagtatgatattgacggctgggtgcagtggttcacacctgtaatcccaagactttggaaggccgaggcaggaggattgcatgagcctaggagttcaagaccagcctgggcagcatagtgaaaccttgtctctactaaaaataaaaaaaattagccacacatagtggcatgcacctgtagtcccagcttacttgggaggctgatgcaggaggatcacttgagcctgggtgatacaggcttcggtgagttatggttgcaccactgcactccagcctgggcaatggaataagaccttgtctcaaaaaaaaaaaaaaaaaaaaaaaaaaaaaagatattgtcataggtggctcttattattttgaagtatgttcctttgatgcttagtttattgagggttttttataatgaagggatgttggattttattgaatgctttatgctgattgattctgaacattgataaagaggtatatatatatatctttaaatgatttgttcagactttaatggaaagtactagtaagaatagcatgtagaatttccaaatcaccccatgtggagtggggaaatagaggaacaaggaaaacttcatcaattgagcaaaaattgttttaaaaaataagaaaacacgggccgggcacggtggctcacgcctgtaatcccagcactttgggaggccgaggcacgtggatcacgaggtcaggaatcgagaccatcctggctaacatggtgaaaccccatctctactaaaaatacaaaaaattagctgggcatggtggcgggcgcctgtagtcccagctacttgggaggcaggagaatggcgtgaacccgggaggtggaggttgtagtgagccgagatcacaccactgcactccagcctgggcaacagagcgagactccatctcaaaaaaaaaaagaaaacactgtgtagaaaaccaaagacaagaataaaaccactcatatcagtgattacaaaaaatatgaatgggataaagtcacctattaaaggcaaaaggtctcataaagtgagaacaacaacagtatctagctatgtgttctttataaatgaaacactaaaatcaaaaaggtaccaaaaattgaaaatagaggaaagattacgtctgcccatattgagatctgatggagctgtgagactttacatttttgtttttcatatgcttttgaagtatttatgaatgtcctgggatataagtctaggaataggagcaaattcttgaaaccattttattatatgttttcacaaaataatgtaatatggtacttggtctaaagtggccagtgtttattctttcaaatattttggatttatataatttctttcttccaaaaagttatcttcaagtcttcaggtagaataaaatcatagtagaaaataagtctttctggccagccatggtggctcacgcttgtaatcccaacacttcgggaagccaaggtgggagggttgcttgaggccaggagtacaagaccagcctggcaacatggtgagaccccattcttaacaacaacaacaacaaaatagccaggcgtggtggtgtgtgcctgtagtcccagctactagggaggctgaggaaggagagtagcttgagtccaggagtgtgaggctgcagtgagccatgatcacaccactgcactccaggctgggcaacaaagtgagacccccaactcaaaacaaaaacaataaagaggccgggcacggtggctcacacctgtaatcccagcactctgggaggccaaggctggaggatcacttgaggtcgggagttcaagaccagcctggccaacatggcgaaaccccatctctactaaaaacacaaaaattagctgggcatggtggtgcgggcctgtagtcccagctacttgggagtctgaggcacaagaagtccttgaactcgggaggcagatggttgcagtaagtgaaggttgtagtgaggcaagatcacgccactacactccagcctgggcaacagaacgagactctgtctcaaaaaaagaaagaaaacagtcttttgttgctgctgctgctgttgttgttgttacaaaaaaaaaaaaaattccagccaattggccatttattttagaatagtattaaaaaacaaagtttccatatcaatataaaatttgtatagcttcctagaatttattaaaataggaatactaatagattcaaaaaggaaaatttgtataaattagtgaaaattaccaccctgtccttaatgccctattttaagattagtcattaaataaatatttacttgctggccctgaactctgtgctgggtactgtgaggcacaaaagaagtacaagatactgcctttgcctactaagaattttattcatactttgacagctttctgtgttgaaccagtaaatgttttcttacacagagctctaaaacatgtttaatctggtataatttaccactaggcacaggaaaataattatagctaacattcctttagtttgtctctgtatatccacacttaacaacagcattttcacatgatagacaccctgacatatgaatgaatgaatgaatgaatatcaggtgctagattaaaagctctaattcagtatctaatttaatcctctcaacaattatcatttagctagtgtattatccacattctatcagtgaagaaactgagcttcagatcactttaattaccttgcccaaagtcataattgaagtggcagaatgggactggaatccaggtctaactcaagtgctatagtggtgtgaagggaagactggtaagggttggtgttcatggagaatttgttgctgggtgtatacttcttgtttagatttcctgttttgaaaacattcaaacttgatcaaccaaaagaaatcatttgcataaatgttattcagttccaggagccaggttccacgcctgttagcatctgtccgtcagttctgtaagcaatcttacagtggtgtgtgttcatcctaagtagtacaaaacagtgcagaggaggaaggcggacagcttaggggaaatctgaccaccatgcgtgttggaagtatttctcttgttctcctgcttttagaaagccatctctgcttgctttttcagggggttattaagatcctactctcttggatactgtgctctattaggcaggagacacaggcagaaagaagctcacttggcatgaattaggcaacagagaaaactcttgctcagtgggagtaacctgtcacaacctggttttctctggccagataaccagtcttgtcgagtagtaatgccattacaacattcccattcagatcctcatgacccagtaattgttttgagaatgagtgcaaagctatcagacaccaactactataattagaaaagggaaaaatagacacttaccagagctaatgtctttaggctggagcatttacagctttttgttttttgttttttaagttatggagcctctttctcagttttgcttcctaaaatacaaattgcatggtttaggggttcttgcatttcatttttgttactgctgtgcactctctttccttttttcccccctattttaatcggagtacaaattgctgtcagcacatcgagttcatgtgccagccacattcagaacagggtgttctgtgctcttcaaaacaaaattgctctagggcagtaagagaacaataagtcagagctccagtttaagtgatgttttgcagctcgcttgatgtggttacactccgattgcgcagctaagcttgggtaatttggtttggtttgactttgtggggatttggaggacctccctccccctttaagttacatagtctttaagtcaagaaaaaaatgttgtctctttttaacttgtttatttctttctctaccaaaaaagccctaagtagaagcatcctgtatgtacttttattctctttgggcatgtcatagatgatttacttcccgtaaatcatgctggttgggattagcaacagacctcctgagccctacaggctgcactcccagtgagtcacgatggttattattaaatatttattaagttagtatttgcactaaaagatgccaggtcaaaaagcaaccacagggcttccacagccagagctgccatggtttttgttctgttttgttttggtaggaatttttaagataacattaaaaagaataagtggagctataggagctaggctcatctgcatctgttaccgcaatcagggcccctactgtggcaatcagcagtctttccgtggctccaagtggtgtgtgagttcttgtcagcagtctcgtagaacttttcacatcagtgttccaagtttagaaaccagttaacccagcaatgccctttgctacttgtagatgtagagaatcaatgggctgtattcaccatgaggctgtgatacctccttttactctgacattccgaatgttgtcagtattacaaggcgatggttttggttttttatataaactggggtgtatatgtctggatgtatatccgtttaagattttatagtactgcagggtccaattgtgaagggttagatttaccaggaaaaaaaagattagtccacatgtaaagtagaaaatatttataagagctatcacaaatgtttactgtcctattacagcatcagacactagttctgtcatttattgtctctctgagaagactagctacaatgaatgttttgctttcttaattatgcctttgttacagtttgacttttttttggcatggttacttcatttatctttcccaacatgtttattagtagccaatctttttccctcactaatgatgggttatcacatctaaagagaacttctgaaattactcatttaattttaatatcaagtacatacatcaagctgaaaaacagcctaggaaactaacgcacaggcaggaatccttgcagagtctctggatttcctgttttgaaaacattcaaacttgatcaaccaaaagccacaacaaatgtactgataatttcctcccccactaaatgtactctccttaagggaggaagatgatacttccaacaataaacttcagacaaaaaaaatctgttaactaagttgtgagctactaggacaataaatctctatacttgagacattccacaatacatgagaaatttactttgctcagcaaatctttttttttttttatgaaaagtgttattagtctaaatttcttgggcagagttttaaatatttagaaatgcaaactttttagaactcttaacctccttagaaatatcaatttttactccagtaaaaatatctttttttttttgagacggtctcactctgtcacccaggctagattacagtgccgcaataacaactcactgcagcctggaactcctaggttcaagcaatcctcccacctcagcctctcgagtagctgggacttataggtgtgcgtcaccaccctcagcgaattcagtaaaaatatcttaagcctcagactccctgtagaacctctctagtatgcatgtacagtcatatgctgcataacattttgtttaacagcagattgcacataggacagtggtcccgtgagattataattccatatctttaccttctcaatgtttagatacacaagtacttaccattgtgttacagttgcctacaatattcagtacaataacatgctatacagatttatagcctaggagcaatatgctataccacttagccgaggttatagtaggctgttccatctagatttgtgtaagaacattctaagatgttcccacagtgatgagaatacctgatgacacatctctcagaatgtatccccatccttaagtgaagcatgactgtatttgaaaaagtttaaatttgaatttattttttaaatgttttccaattcagaatgaactttcaatttgctacaagttaattttatctagagcattctaaaagtaagtctaacagaaggaattatcagcatttatgagtgtgggacataaactaaaatgccatatgcgagctctaccaagccactccaactctagcccttgtttggaggagctgactcaagagttaggccctttctagtttggcccaagtttcttagaccccattctgtgtctgcaaggggaacacatcaagatggtattaatactggtgagttaaaaaagagtagtgagtactcacttcggcagcacatatactaaaattggaacaatacagagaagatttagcaaatcgaaaaaagagaagaaaagggtagaacgctttagagcataaatgtccaggggacatttcggcccctagtgtctacaccatttctgttcattcttcagtttttctcatttctcaggcctgggctaggggtaattcaattaaattattaactgcaggaattagatttgaagctggtttctggactatactgatattgagagtgatattaccaggtcatagaatcatagaattttagagcttcattgagatcatgtagttcaaaagtagaataagttagatttgaatttttatttggaaggtaatagttgttttattgggcatggaatgagtataacagaacgagtgatttttagtctctctacaagttgttgatctaaagtagatcagccagtgttagaaaagaagcattttaggaaatctctagatttgaatataggctattatgttacagaagtaggaataaaggattttctttcttttttatttttatttatttatttttttatttattttgagatggagtctccctctgttgcccaggctggaggctggagtgcagtagcgcaatctcagttcactgcaacctccgcctcccaggctcaagtgattcttgtgcctcagcccaagtagctgggattacaggcacgtgccaccacacctggctattttttgtatttttagtaaagatggggttttgccatgttggccaggctagtctcaaactcctgacctcaggtgatccacccgcctcggcctcccaaagtgtgggattacaggcgtgagcaccgcgcccagtcaggattttcttatgaaatccaaattatcatattgcttggtgactgttatgctgtcataccagccatccatttttcttattacatcaaaaacttaaaatagaatacccttaatattaaaagtagttgtaaagtttcagagaattgtttttcctagaaataaagagtctaggccagacctggtggcgcatacctgtaatcccagcgctttgggaggctgaggcgggtggatcacctgaggtcaggagttcgagaccagcctgggcaacatggtgaaaccctgtctctactaaaaataacaaaattagctgggtgtggtggcacacacctgtaatcccagctacttcggaggctgagacaggagaattgtttgaacccaggaagtggaggctgcagtgagcagatatcacgccactgcactccagcctgggtgagacagagcaagactgcgtctcaaaaaagtctaactcatcaagaaaaaatagatatctgtatgcattttttctattttgtcttaaaatatgagaaaaagcctcttattttaatatgaaattactctgggaaagagcttggtaaattggggtggaacggggaattaggcctcccaaaattgacctcctaatatttcaggggaggttattaagtaatttgatttgtgaagttatagtagactattgattctttcacactttacatttattatttccagtaagggatatagctaagatagttattgatgttgttgtctttggatttaccatttttattcagatatatttgtgaatgagattaggactcttaaagaagaaggagcatctgtattcatttaatctttgtatatcattggagaaatagccatttagttggctttttggcccaagcatctgaagccaagatgcagttacagatgtttatatatttgatattaaatttgtggcatttgataactttattaaataattcagcatctcttgactttgtattataggtgaggaaacttctgtcacatagtaggcttagaataaacctgtgtttctggtttgttacctactaaactgtcttattgatacaaatatcagtaattacaagtttaatttagaaatatggttgctcctaaactttcagactgggtagactaagcttcaccaagacacactgtgtgtgtctcttgatgaaatgagaaaggggaaatggtatttgctacattgtcgaccactcatttatcacttcactgaattagccagtcctaagaagcagctctgttgactctcctgtctccttgccctcagtccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaaggtaagcagcataccagtttggaacacagtgaagtcacctaaaggacagggatatgcttgctttttcattcagtgttttggcattttcagtgaagttaatccaacaacggaaacaattaaatcaggctgcagttagtcatcacgtaaattaatgggccttacaatatcatagaggtttgtgagcatgtttacttgattgatatatgttcagaacaggtcttacagccactttttgcttttgtgatgatttgttttgcctgcagtattgccaagacaggcagctatggacccctctcatatgtggttctcttaccccctcttcccttttctctaagttaggcaggaggcaggaaaacatgggggttgggagtcaaagaagcatttggatgatttactaccacttgaacttgtgccacttgttcttatacagagtccctgaaaaaaaaagcacattcttcctggatctaaaggcaacagagatgactcattttttgtctaagtttttcccatcataaggatatccattagcactttcaagcttagaaccatcagacactgacagtctctcttgtgaaaacatgtttagtagtatttttagatctaaaattataccatgaatccaactcttctgtcttgagaaacagacccctgagagaacccggggtgttttgattttgtctgcatgagagtgcatctgcttatctagtgtatcctccctccggctccatggatttcagacagtgggattctgagttactgagaatcttgatgacctgcacttgccagtaggtgatgttaagccttttgtggtgtcattttatagactctgtagtaatccaatggcagtttacctttgccccagcacttgatccataatcatatatatatatattttgagatggagtcttgctctgccacccaggctagagtgcagtggcatgatcttggctcactgcaacctctacctctgggttcaagcaattttcctgcctcagcctcccgagtagctggcattacaggcacccgccaccatgcctgtctaatttttgtatttctagtagagacgaggtttcaccattttggccaggctggtctcaaacgcctgacttcaagtgatcctcccgcctcagcctcccaaagtgctgggattacaggtgtgagccaccacgcccagcccataatcatatttttgaggtgatctagccatgcaactaccacttgaaaatccttccaaagtgctctaccttgaactcttcatagccgtcactgaggcaccctttgtataatggcttctttttctctacctggttcctctttccactaactatagcccccacttcaatgtgtcttatttatattaatatttactctatatttgtagtttattcttaggtgaaactaattctgtttctaggagatactccttaaaattcagatagagcatagaaaaagctatctcttccatatccaaataatctctaattacttttttttttttggtaacaggatctcactctgtcgcccaggctagagtgcagtggcacagtcacgctcactgtagcctcaacctccagggctcaggtgatcctcccacttcagtctctagagtagctgggactacaggtgtgtgccaccacacccggctactttttgtattttttgtggagacagggttttgccatgttgcccaggctggtctccaactcctggactcaagtgatccgcctgtctcaccctcccaaagtgctgggattgattacaggcatgagccactgcgccaggccatctctgattacttttaatcagcatttcaaaattacagtagttctaaactcagagaggtggatttatgtgtaatgtatattttcaaaatttaagctcccttaggataaattctgtatgtattatgacaacataatgttataggaaccagtttatatacattacattttagcctggctgacaaggcaattgtggggacagatgtctcaagtttagtgacaaagaaaaatagaaattgtctttaaattttttaacgcaaacagttcttttcagatttaaactgtttgttgtatcattagtggttacactttgctctgtgcgcttggccaaggcacttaaccctcctaagcttcagtttcccctctgtaaatggggatgacagtatccatctcataaagttatggagagctaaataaaatcctgcacatatagggcacacatgagcccgcagtgtgtgagcttttgttgctattgtgacggctcaccttctcttccattttaccctcggaccacaagaaaaaggaaatcctgtttaacatgagatcaatctttcagatcttttcaggcataaaagttgtcaataggttttcataaatttctaggtataaaagtttatgagttttatggaaataatttagcatatttagaaaggaacattatttttgttcaaggtgttggtatgttggagaattatgtgaagtgcattctctgtaatatgagactgctgcatatgcattgcgtagtactacatatatatgtagaaaacccctacgtgctatatatgtgtgtgcgtatgcatactgtgtgtatagaaaaccccctacatgctatatatgtgtgtgtgtatgcatgctgtgtgtgtgtatagaaaacccctacatgctaagcatgttttcagtgcaggcagtgaatttacttgttttattcagcttcccactttcataaaacattgcatctaaatgttgctataagtatggctgttgcagaaaatatctgcaaatagctcttagtgtcatctgtatttcattctccagaaaatttccaaggcagaccttctctgtgactctgatactctgatagactctcgggaagaatgttttctttctgtccctcccccaccccccgagacagggtctcactttcacctaggctggagtagggtggcataatctgtagcctcgaactcctgggctcaagggatcctcccacctcaagctcctgggtagctgggactacaggtgtgctccatcctgcctggctgatttttttcattttgtagaaacagggtcttactatgttgtccaggctggtctcaaactcttgggctcaagcagtcctccagcctcagcctcccaaagtgcttgggattacaggtgtgagccaccacacctggcctagaatgtcttcataataagaaagtcataaaacatttccagacaatccatttttctttctcctcattgggacaatatcttccctttgtattgttttaaatactgagactaataaatcttttttgttttaggtcaagtgtatatagtgttaacttttttttccgtcctttccttatgtttctgtcacgcatgaaccccaaacaaaaacacaggctattggtcaggcaaggtggctcacacctgtaatcccagcactttgggaggccgaggcgggaggatcacttgaggtcaggagttcgcgaccagcctggccaacatggtgaaaccccgtctctactaaaaatataaaaattagctgggcgtggtggtgcatgcctgtaattccggctactcgggaggctgaggcaggagaatcgcttgaacccaggaggcggaggttgcagtgagctgagatcatgccactgcacgatgcctggggtgacagagtgaaactcttgtctcaaaaataaaaataaaaaaacagactaccaagagccataatgtctagttatgaggcagtatgagtccaaaaaacctgattttctggggacacacagggtctgaatttaaacctggctctaccactgcctgtgtgtgacttctcaggaagcactctgtgtctttatctgcaaaaagggagcaattggtaagagcttgtagtccaagtgcttcttatatgcacattaaggcttaatggtcattcatagtcattatttgtatctctattctctggaggaaactcttaattcaagggcattaacgctgaattccttctgttaccatagtctagattatcttttggttaggtcttgggattcctcttgtggtgttttgtttttcagtcagatgagttgggtgccctggttccttcttcacccaggctgacaactttctgtgtaatatggaagtcagggtaggtgctgccagaatatcttggcgtgggcttccacctctgcaggatcatgtgcgccacacgtatcttgactgaatcgcttcattttaacctgggagagattgtagaaataatatttttctttagtcttctttaatcccatcaataataggacacttggtgcctcccttgatacagccccacattccccacaggcagattttctcatcctcagcactgttgacactttgggcttgctaatccttggtcatagggggctgtcacgtgcattgtagaatatccagcagtattcctggcctcttcccaccagataccagtagcacccccatagttgtgacaacccataatatttctagacattgccaaaggtttcctggagggaagaggagttaaaatcaacctggttgagatctgctggtctaaggcaaatgccagatcatttgttgcatttgcaactgcttagcacaggactccaaatataacatgctctcagaaaatatgtgcttagcaaggactcacctacctacctgggtagttaaggaatttttttaaaatttattagatggcagaaacaaggtagtaggtatatacatctaagagctcaaagtagaaaattaggcatcacttcttaaaattggtcactggtaattatgtctttgtggaagataccctttgccccgctcctcattcctaccagctctcgtatctctattcctctttttggctccagcttccattttctgtgtaacagtggaggtgagtgagtaagcatttttattcctggaaaatccaggcaaagggtaaagaaagtggtgcaagcaacaaaatttgagtgttcccactctagtccctttgccccagagaaaactggaggtattagattaagtcggttttgacatctttcaacctgtaccttgaaagcttgagtttactaagttttttgtaataccatttcatatattaaagaacagctttgcttgcaacaaatgggaacataatatatttcagtgaacacttgactaatatgctgggccttgttctaaacaaacactgggaaacaggtgaaccagacagagctctgctacagctcccattctagtaaatatctgcttcccgaatacatttaatttgctggagatcttacatgatcccaagaaaacaaatgtatatgtcctcagttatttttttcagtaagttttggctaaaaggtatagaatcctacactctgatagctataagccataagaatatttctctagaggaggtgtcagaacttgctagggcagctatttttgagtatatcattatgttatttgtgtttcttcatgtgcttttaaaaaaacttaaatagtgtgaaaacttttctctcctgatgtgtgagcctttccccttcacttatgtgactggaagtggtactactagaagtgacagcactttaaagttaaaagcttattaaaacatacctcccgtgagtaccactctaacaattacagtggctgtgtcttctctgtcctttttgctgataaaacttaggggaaaattcctggcagctaaatcatggccattttattaaaaaaaaaaaactagatatgaaatcaagtagagaaaaagacagtgacatttaaaatcccatgaatcaagctgccccaaggagtacaggtgttgcattacatgtgaatgtgaaggagaaaagaaaactaaacctagcctggtttctaagaaaactgtagcagtgaagatacttcacactgtatcttctggtcaacatctggtttgtcttcagggtctctgacacatgtagcttgcaaatgatagctctgttgatgcctcaaaatactgaaggaagtgcctggaaatacaccaatccttttaaagttttattttttactctccatttcagatatggttttggagaggcagggaagcctaaatttggcattgaacctaatgctgagcttatatatgaagttacacttaagagcttcgaaaaggtgagaaaataccaacttccttaaaattatggtaggtttcttctccatccacttcctataaatcagtatcttatcttagtaggtggtatagatagatggtgtttattcattatcaagtttgtctcttgcctccaacactgctgctgaagaatagaacaactgacatagcacagctgatatacaacgaaggagctccgtgttcttattttgttcctatgtgtcagcttttttttttttttttaacttttttgggtagaatccaagacttgttcccttatttgttcctagacttgttctttttgtactttttttttcctgggttgaggacagaaaggttcacgttctgccaagtggctccttgggggagtggggtgcagcttttcagagctgaacggattgtacccttcacaggagtcacgaagaggcctgcactgtggctccaagttgttatcccaactgcaagtcctcgagggccactaggctctgtgaccagagatacaagaaagaaagcagctaacccgaagccattttttttttatacttctccaagtagagaagagagagaatttgtcagttgccttggattccagaaacagcatgcctccttgaacatatttccatctcagtttcactctggaggctcccagcagcagccgacctggacacacacagcatatacctgagctaggtatgctgttgtcttcggccacgtgcccctggcatttccaaagccccaccctttgtggagctcaaggactgcatttgtgttccttttttattcctgcacagtgctacctccacgttctgtacattcaacttttttttttttgagatagggtctcactcttgtcacccaggctggaatacagtgagcgcgatcatagctcactccagcctcaacttcctgggctcaagcagtcctctcacctcagccttccaagtagctgggactacaggcacacgctaccacacccagctaattttgtttattttttgtagacatggggtctcactgtgttgccccagctggtctcaaactcctgggcttgagccatcctcctgccttggcctcccaaagtgctgggattgtaggggtgagccactgtgcctgaccacattaagcacattaatataaatggaaacatgaccatttatattttgttagattcagaaaagaaatcattgtcctgtgggcctgtacctttgggctaagaaagtgaggggaggcctgctttgggattcacccccagtagtgacattcctaatcatacctcttctacttcatgttcccccaaacaaacatatgtctggttatgaccactgattgttgtcatgtaacctcttctgaaggcctgctagctcagcactgatcccccaatgctgttgtcatagcatatggtgtttttttattgttaaagagagagaagataatctttagcatgtggttatttagacctatggctttactatttccatttttgtaaagcagcctcttgccccttccttctcgtggcccagtggacattgcttatttaggagcactctcccagtggtgtgccacagcaagcctgtgctctgtcatcactccaagagtatattcatgcactgctgcttggtatatttgaaatcacatgaaggtatatgatgttgtttggggcaatgtgatttaatcctctgccttgttaagaatagactaggccaggctgggcgctgtggctcacgcctgtaatcctagcactttgggatgccgaggtaggtggatcacctgaggtcaggagtttgagaccagcctggccaacatggtgaaaacccatctatgctaaaaatagaaaaattagctggacgtggtggcaggtgcctgtaatctcagctattcgggaagctgagacaggtgaatcgcttgaacccaggaggtggaggttgccgtgagccgagatcatgccactgcactccagcctgagagacagagcaagactccgtctcagaggaaaaaaaaaaaaatatatatatatatatataaaaatatatatatatataaaaatatatatataaatatatacacacacacacatacacacacatacttatattccaggcatggtggctcacacctataaatcccagcactttgggaggccaaggcaggattacttgagccgaggagttcaaaaccagcttgggcaacatagtgagacccccctctctgcaaaaaaatttaaaattttcctgggtgtggtagcacattcctatatttccagctactcaggaggccaagataggaggatggcttgagcccaagagtttgagaccagcctgagcaacatagtgagaccccgtctctaccaaaaaaaaaaaaaaaaaattagctggacatggtggcacatgcctgtggtcccaactactcgggaggctgaggcaggaggattgcttgagcctgggaaatcgaggctacagtgagccgcgatcgtgccactgcactccagcctggacgacagagcaagatcctgtctcaaaaaaagaaaaaataaaagagtatcctgtctcaaaaaaagaaaagacaacagagcaagatcctgtcttagaaaaagaaaaaataaaaaaaaattccataaagactgaagccaacctaagaaatacaaagagacttattaactaggtgttctttgtttttgttttttgggtgctaaaacctggaattgaaccataactaggtttttgagtaatttgagctacattattaggaagcagaattacatgagttgccagaaagatgagtaacccttttattattcacttttaaaaagtagaggatagtcactgggcgcggtagctcacgcctgtaatcccagctgaggtgggtggatcacctgaggttgggagtttgagaccagcctgaccaatatggagaaaccccgtctctactaaaaatacaaaaaattagccgggcatggtggtgcatgcctgtaatcccagctactccggaggctgaggcaggagaatcacttgaacccgggaggcagaggttgtggtgagccaagatcacaccattgcactccagcctggacaacaagagcgaaactccgtctcaaaaaaaaaataataataataataataataaaagtagaggatagcaggggctgtgacaccaggaacacacactcgttatcttttgaatagagagaattttagttacccatttaaacttcataatttatatgcagtaaatagcactgaccacacccactgtcacttttcctaaaggctcccagattgttctcttgactctggtccttctaaatccagcttgtaaatggcaagtgcagttatttctggatttgtatctgtaatggtggaagtaataatacacacaatacaagctagcagatgataatgaagtcatttatttatggctctaaagtgatatttttgcatgagctttactcccaattatgttttgcttgaagtcccccccagtatacatctgcaagttgatacaatttagcagtattattagtatatctggttgttttagagtggcaagacaacctgacccagaattttgaaaattctgtatgaatatacaaactacaacttgactacagtcatgttcccattttagagttgaaaaacaggcttgagagaaacagcctagtggagaggtttgcagagggagataaggcatggccttaactttgtgtgggttcaccttgtatttctaaagattcactttgtagcagtgcttaccagagtacgttccttactgtgtttttgcggctcctctctcttgagcaacattgttcaagctacagcttggtcatgatggaaagtgagttcttcaaacagtatgaagaagcactggcctagcagtaaattggcactgacacacaatttcaacagccagagtgttttcagtttggagtatcttctagaattagctgctctttgttccaataggcctcaactgatgcttttctctctgttcatctaaccattgtcacaaatttacacacaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtggaaaaaaaaaaaagtacagattcctcttttacacattctgctctagattgtaaccttccatacaggcagaccaggtctggcatccccacccaccacagtatcactcactcctaaagcatcttgcttggtacatagttggcactcaacaagtgtttttggaatgaaaaaagaatgaatagaataattgttagcaaagaatggaattcataagggtaagtttcacatcatttttctttcttcctttttttttttttgtatgagagacagggtctccctttctttcccaggctggtctcaaacttctagcctcaagcaatcctcccacctcagcttcccaaagtgctgagattacaggcgtgagccactgcaccgggcccatcttcctttagactgtcttgatgaagtcactagagcatatgataaaaggagagaggacatgcacaaatttcaaaacaaactgacaggagagtattgattgcttctaatggccaagatgattcctgcacacttgcttttatgaggaatctccggatattcctgaatgatattcatcataaattgcttctcagaaacccttcttggagcaactaggagtgtgatattttctcacttagatcttaaacctctagatgtaagaaaaaaagaaaccgcccttcattctgttttaatcagtgttctacccattgcttccccaccccaaatatatgccttctccatgtcaagcagaaagggcttagtgatgagaattagagggagaatgggagttctgtcaaggtttctttcgttttctgccactgcaatacagaaattagatgtttttcagcagtataaagcagtgaggcataagtgtactttaacaagtctttatggggcatctgctataagacatgctattattaagttacaaccttgtcaggagggaggagtggcaatgttaatccaaatgaaacaactagagaattatgtaagaatatataatcaacccaaaattaacacagccagagggcaccatgtgttttcagaatttgagctgagacaatattgggtcatgaaatcagttttgtggaagtgtattgcaatatgttataaggatcagttttgttgcataaaactttgcttgtgtatgagtaagtactggattgcatatttcttactgtgggtggtattcaaacaaattttaaatcatgggtttagataagtataaatatataaatatgttatttatcattatttactatgtatactaaactcttatggatcaccagaaagcatgggggtatgatagaataagctcagaattgggaaaaatgggctttattgctcttcaaatgatttagtcatttaaggtccaaagaggttatattttcaagtgaaaaataggggagttagatgttccccaagtttctttccagcctgaatttctgtgagtttctaaactctcaagaacaagtgttatttttttggttttgttttgtttttaattctaattgaggtatattggatacttctaaactattcaagtaagattccaagtgggttatttgtatatccaaatacataatacactagagggaaaaatgtttctacaaaatttcttaagatcgtgagtccttaacagtattttctatatttccgaagtccataaaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgcttctcctgggaagaaagcatttctaaaacaaactagttgaggagaattgttcaacctctaaactcttcagataaatcgggctttgctatattttcaccacccttgctgttccaagataccagtaatgtgatttagaaacaagccgtttatgactctaggatttgatgttttaaaaaaaattcctaagaagagtccaccctgtctttcatctctttcctttagtgcagaatttttcaacctcagtactatcaacatttggagtgggataattcttgattgtgtggggctgtcttgtgcattgtagaatatttagcagcattcctggcctctgcccattagatgccagtagcatcctacccagttatgacaactaaaaatgcctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaaacctttattaaagacctcttggtgctaaaccctgaatattccaaaagggagaggacaatgctgcctgtcctcaaagaccagcaagagaaaaggcagtgacagaaagaaaatgccgacctgaaactggtgaggactttattcttttttttttgtagcatccaaaaaaggagtggtaggcctaagactatgacaaaatttaagtattgtcttagcttgggctgccacagtaaaataccatacactgggtggcttcaacaacaggaatttacttctggagactgtaagtcccagatcaaggtgttagcaggatcagtgtctggggagggcctctcctctggttccttgtagctcccttcttgctgtgttctcacatggcctttccacatgcatgtgagtggagagagggcagagggcagcaagcacccgagtttcttcttataaaggctctaatcccatcatgaggccccaccctcatgaccacatctaacctaattccctccccaaatgctccatctgcaaatatcacattcggggtgagggcttcaacataggaatttaggatgggggacacaattcagtccatagcaaatctaatttcctcaagaatttcagcatttaaaataaaatgccctggtttcgtgttcttatgaatgacctgtatcacacacttctgaggcagagagggtgacagactttgattttagtgccagtcttccctctcctaagtgagtgacttgggaagaaggatgttcgagggatgtagcctggccctcattcacacccaggccctccagctggaacaggtctgccccatcttcatcaccagaaaatccacaccagggcttcctttctacaggcagagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgtttttgaggagtctcgctctgtcacccaggctggagtgcagtggcatgatcttggctcactgcaacctctgcctcttaggttcaagcagttctcctgcctcagcctcctaagtagccgggattacaggcatatgccaccatgcctggctcatttttgtatttttagtagagacggccaggctggtctcgaactcctgacctcaggtgatccacctgtctcggcctccaaagtgctgggattacaggtatgagccactgtgctcagcccccagcgtttctcatatgagcatgtatatatatatatattatatatatattatatatgtttatatttatatatattatatataactgacagacctttctgatgtatattgttttatagttgttatttatgttgtatgctactatccaactattcatattcccattgcctatagatcaggggtcagcaaactacagtttgctggccaaatctggtccctgcctgtttttgtaagtacagtttaactgaaacacagctgcacccattgatttacatactgtctagagcagcttttgcactacaaatgataagaatttagtagttgcaacagagactggttcaaataggattggctgtgtttggaactagcacttgccagaatgtaatatttgctgtgaagtgctgaaaagaaaagtaacttccttttcatttttttagtggcatagtctaaaactgctcacaatccttttgaaagactaaagaataggccaggtgtggtggctcatgcctgtaatcccagcactttgggaggccaaggcaggcggatcacaaggtcaggagttcaagaccagcctggccaacatagtgaaacgctgtctctactaaaaatacaaaaaaaaatagctgggcttggtggcggccacctgtagtccccagctactcgggaggctgaggcaggagaatcgctggaacccgggaggcggaggttgcagtgagctgagatggcgccattgcactccagccctggagacagtgcgagactgtgtctcaaaaaaaaaaaaaaaaaaaaaaaaaaaaaagactaaagaatattagcaccaaagaacatagcccagaagccttgctgtactacacctgctgaagggatggatggaaatgctgcagagcagcactaggcagtgctcaggcactgccccaaaccagcccacaggccatcgaggcctccaagggagtgggaaaggtacctggagagccatctccagaaggaaagaaagaaaccagctgtaccagggtttgctggaggggttgcttcactttgaggatttgcttttcttttgtaccccctcaagagctgagtacaagtaatgacgcttttttatcctagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggtaacatcgtgtctcctgtgagatggactttagatactccagatcttttctccatctctgtcttttgcttcctctcagccaaaggttgcaggatttttcattttgcttttttttatttatttgaatgtttgggattatttgtttctcagtatgaattgggaaattcagcaagatttttattacagtcagacttttatgatacctagactgtttatcataatgcattctgaagaaaagttttgattaaaattaaataatttttatccacgaccttccttataactgtagtatttatatcagagtagacgtataactcctcaggttcagtttaataagagaagatttaacttaagcttttctggactttaacagactgcaactgttcatataaagcatatatataggtcaatttttattataatcatttattcactgatatgcataaataatatgaaaggtccacagagcatcagcagcctttttatttttacatttgtcttattaatactatctttggtcttttgagtgcttacacacagtactctataacagtggtttatcatctgtatcgttatgtatcgttctgatatatttatacaccagccgatactattttaggtatctggtctcagagtgaacagtatatattatactgtgggtaaaagtaaaaactaatcattggatgtatcttaaaggtagacataaaaggataagaaaagcaaggcaactattttgtacattctttgtgagattatttttgaattttgtggatcagtgtttcctatcgcatcctctctcccaagaccagttattaattttatatgtattttttcgtttttttcatacagagcggagagagagagagagagagtgtgtgcgcgcgcgcgtgtgtgtgttttgtttgttttagagacaagttgttgctattttgcccaggctggggtgcggtggctattaatacacatgaacataatgtactacagcctcaaactctggggcccaagctatcctcccacctcagcctcctgagtagctgggactacaagtgcatgccaccacacaccctgctaatttttaaatttacttttgtagagatgggggtcttccaaagagctgggattaaagttgtgaggtaccacacccagcacagccttgactacattatttttctgtcttctattgacagaagcagtcatatagcatcactattaaccctatctttggcaataggaagcctgttctccttattttcctctttttttttttttttggagatggagtctttctctgttacccagtctggagtgcaatggcacaatcttggctcactctaacctccacctcccgagttcaagcgattctcctgcctcagcctcccaagtagcttagaccacaggtgccgaccaccacaccaggctaatttttgtatttttagtagagacagggtttcaccatgttggcccggctggtttccaattcctgacctcaggtgatttgccacctcagcttcccaaagtgctgggattacaggtgtgagccaccacaacccagcaattttcttttagctttgttgattatatctttctctttaaagaaggttttaatgtttatgtagtcagatttgtcgtctcctttctagttagaaaagacttccccacaccaagattataaaaataactgaagccaggcacagtggtttacacctgtgacctgtaaccccaggactttcggaggctgaggcgagaggattgcctgagcccaggagatagaggctgcagtgagctgtgattgagccactgccctccagcctgggcgacagagtgagaccctgcctcaaaaaaataatgattatattttacatattttaaaataaaaaataattgaaacattttatggttttttttaatatgtaaatatggttgatctagaatttacttttgtgcttacaatatgaggtaagaacttttttttttttttttttttggagacaagagtctcactctgtcacccagcctggagtgcagtggcacgatctcagcccactccaacctccacctccctggttcaagcaattctcctgcctcagcctcccaagtagctgggattacaggcgcctgccaccatgcccagctaatttttgtattttcagtagagacaggatttcgccatgttggccaggctggtctcgaactcctcacctcaggtgatcacctgcctcagcctcccaaagtgctgggattagggtgtgaaccactgcacccggccttaactcttattttctatgtggatagctgccatcctggccccgtttattttaaagttaactctccactgattcacattaccacctttgtcattttcaaatgtttttatatgcagacacatgactgtttctgaatgattcgttctgttccactgagctgtttgtccacatgctagtaaccaaactgtcttaatttcagtagttttaaagtttgtctttttctctggtaagacaagtgcctcttatttttttcttttttcccaaattttttcagccattcttgggcacttatttgttccaatgaactttaaaatgaacttctcaagagccccctctcaaatctccttgggatctttctagaaattgcattaaatgcagaaaataatttgggtagtaaattttgatcagtagtatgtaattatcttgagccccatttttttaaatacactttttccatctcctttggcaagagaactttggtaagctgtttactgaatttattaaaattcgtcctttctaaaatatagaccatctattcctaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggtgtgtgcagagcctgatgactgcaggtggatcaagagcctgaccatgcccctttgattttaggggacaggaacagctaaacaacccaagaggctcaagagcagggaaaacgatttccaatctaatctgaggctgctttggatccaaaggtcgagtagggcagttccagtcaccaaaggcacacgtcatgagagatgagaaaactaaattcccttcagatgtattagattggttcaaaagtaattgtggtttttaccattactttcaatggcaaaaacagcaattttgcaccaactccccccgcccgccccccgggcccctgcccgagtcagagtctcactctgtcacccagactgtaatgcagtcgtgctaacatggctcactgcagccttgacttctctggatcaagtgatcctcccacctcagcctcctgagtagctaggacaagcacactaccacactgggctaattttttaaaattttttgtaaagatagggtttcactttgttgtctaggctggtctcgaacccctggcttcaagggttcctcctgctttggtctcccaaagtgctgggattatagacatgagccaccatgcccagcccttttgtcatttttgaaaaattgtaaacccatcaggatttttttttcaagtaagacttacgattttcccaggaaatgggatgttataggagccccatcatcacacctgttatcttgagggtcggcagccagcctgaaaaatgtggcaggagaggtctgtctgcagagagggcggcctccctacagcatagttggcattctggtcctgtccccagtctccaggaatgcccagacttcattatcccacagctgtcccatgtgtcaaccaaagaaaggtgaagctcccactctaactattggtagcacagccctgacctacccagctagatatcctagagaaaatcattgcaatacctcgtgtttgggacctgatacacagtctggaggagccaggaattatttcacttctttattctctaaccttcttgattgcttatttcttccttaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgacttcccattgtttttggttttgcttaagtgattttcagggaaagctatattggttaaaaaaccatggtgggggccaacttgaagaaattagacatcagagaggtcaggcgtagtggctcatgcctgtaatcccagcactttgggaggccaaggcaggtgcatcacctgaggtcaggagtttgagaccagcctggccaatgtggtaaaaccctgtctctactaaaaatacaaaaattagccaggtgtggtggtgcacacctgtaatcccagctactcaggaggctgaggcaggagaatcacttgaacctgggaagtggaagttgcagtgagccaagattgtgccactgcactctggcctgggtgacagtgagacttggtctcaaaaaaaaaaaaaaaaaaaaaaaatcagaaaatcggcaatggacagtatcatcctacactttgctctaaggtgaacctgaaaccaacattggggtgaaagtggcagaacaatgcatcattgctaaaaagaaccaagtaatgggaaaaataaaaaggttttgttttttcattagccagcggatatttcacctttttaagctgattttaaggtaggctcgacttgcaaaataaaatttaattgtgccctttaataaatatatgaaacataagtaaggctatctaaggtggtggtccatattgagcatgcattttctttcttaagtagcatatatcatcaatactcatcatcacagactctcaaggcctaaggagatgtcacatatactgcaaatcctcattttcacactgcaaaagaaggtggcacagtgctggaaggtacttagtaggacctctgaggtctacagacaggttgatgcaggttctaggcaccctttattccctctgaattcttggcttcatctctggatttgaattatatttctccctcctccctgttaaattatttggtaatgaaataaattcctagctaggtgcggttgcttatgcttataaccccagcactttgggaggccgaggtgggcaggttgcttgagcccaggagttcgagaccagcctgggcaacatggcaagaccctgtctctacaaaaagtacaaaaattagacagacatgatggtatgcacctttaggcccagttacaggctgaggtgggaggatcacttgagccctgggaggttgaggctgcagtgagccatgatcatgccactgcactccagcctgggtgacagagcaagaccctatctcaaccataataaattccctttatttgcgtgctttttttttgtaagaaaataatgatcaccctagggatcttgaggatgagccagagaagattcctggctgtaaatgtgtgatctcagaaattcagaggcagcttgcacaacctccaaaacgaggactgccagtgaagggctttgtctatacttacttggccttagcagcacactgaactccacttttagtatggtacatgtgaagcctgtattctctggggctggagactatctccagtattggtgacaaaacgcattgaatttgagccagttagtcaaaatcctgaaactcagaattccccaacccagctgtgtattttttccatcagctggctacttatgcatctgaatgacagtgactgacgaaagtacataaaaggacattctctgatggcttgaaaagttttggtagaccttcagtacttcccttcagatttttctctactacatgtctgacatggagatttctgtgggaggagaaggcactatctgtaattgcccagaatctccacgtgtgaccttaataatacacggcaagaaagagacagcgttaaatacaactcttaagatttttgacagcatcttgtttgggtaactgcagcctatagttagaaaaattaaagcacagtttataaggcagggattctttgtcttctaaagatgagggaaccttggagaatcaagaatatggggaggacccagaatggtgatgcagcctgcccatggccgtcaggtcacctgatgcccttgcaccattttaaaataggtctttttctagtatgatgagtgatgctcttggtgtatggaaggagatgttggtacttccttagaattcccacattcggtggaactgaaatggcagcagagccatgggcctcatagtctactttggaataaatctatggtgggaagcttgccaacgtgttaagcagaggcatctttttaaaatacactttaggggccagggatggtggctcacacctgtaatcccagcactttgagaggctgaggcaggaggattgcttgaggccaggagttcaagaccagcctgggcaacatagtgagaccccatcactaccacacacacacacacaaattaattagctacacatggtggtgcatgcctatagtcccagctacttgagaggctgaggtgagaggatacttgaagccatgagtcgtaggcttcagtgagctatgatcacgccactgcactccagcctgggcaacagagtgagaccttgtctctaaaattagaaaaaaaaatgtggctgctacattgtttccacctctcaaatctccacaaggtcattggtccttgctaacccagaactaagcagggaaggaattctgggacatgtgtttccaacttggcttagttgacacattgcaaatacaacatgtggctaaggctttcttttttgtttttgtttttgagagggagttttgttcttgttgcccaggctggagtgcagtggcacaatctcggctcactgcaacctctgcctccagtattcaagtgattctcctgcctcagcctcctgagtagctgggattacagggtccgccaccacacccagctaattttttgtatttttagtagagatggggtttcaccatgttggccaggctggtctcgagctcctgacctcaggtgatcaacttgcgtcagcctcccaaaatgctgggattacaggcgtgagccaccgggtccggtctgtatctaagcctttcttgaggtattaaatatttccagcctgggtctgctctgggataatgtgttttcataagataactccttattgtaggcattgttcttggcttaaagttatctccttaaagcttctgactagggaaataagtggtaagaataaacagttgatgagtatttggggatgcaatgactaattctagttactctagttctagtgaatgacttgatgagtttgtattgtatctgctcacaaccgtgtttccacactaaggactcctgaatttttttgtcttaaaaacttaaacccgctgggtgtcctggctcacacctgtaatcccagcactttgggaggccgaggagggcggatcacgaggtcaggagatcaagaccatcctgactaacatggtgaaaccccatctctactgaaaatatgaaaaattcgccaggcttggtggtgggcgcccataatcccagctactcaggaggctgaggcaagagaatgacgcgaacccaggaggcggagcttgcagtgagctgagatcgcgccagtgcactccagcctgggcgacagagcgagactctgtctcaaaaaataaaaataaaaaacttaaacccatgtgtatcctattgccctctgtggctaccagagtcttcctaacatgacaccagcctttacctgtagttaacaaaatgtgattccccttctcccactgagggatcaggaacactgccttactcatcaccatcctcagcacccagtccatcatccccaaactagaacatagtagatactcggtaagctggctttgtccctcctctgaaggcagcctcttgtctgtatcccagtggcccttcactcctgttacctgagatgtggaggccaaagccccatgatactgtggttgtccctgcagcctgattttgtgtcttgaattcttttccaagtggtgaaccagcagcaacttgaattttgggagcccataactgtaaaatgggtccatcgtcttcaggctacattgatcttatatctatttttagtcacaattgataactcagagttcaccaaatacgaagatcaaatataaaatattttccttaaaagtattctaagaccaccccgcccagtctggtgccctggtcagccagcccccaaacatttacggcccatctgttgtgaactgggtactgttccactgaggtgaaggatggggccccctgggctgagcgactcgcagacaagtgaaaaatgaggcatgcagatggctgcatcatcacagagcatctgccatctgctactgacatctacaaaatagggaacagcaggaaactcaagcctgcctctccagctctccccactcattcagagccacactggagaccgagtcaagccagggcccaccccactgctgacatccagcccagtgctactgggcaagcccttcctcagcactgcccccagctggccactgttccacccctgtgcttctctccaagcatccgggctgcaaaaagtgcccagccctaccctgagctataccagccctcttgccctgggcccagccaggatggtttctcctggtggcaggatgttaatctctttggcacaccaggcagaagtctaggagcagagagctatgtccttaggtctgtttttcagttacctgcctactggaatacagctgcaagaaaactgtgtcctttatttacgagacaactgtacagatacaccatgcctaactttgcttactgcatggtcactaggatgtactgagtttcaaggaaatatgtttttgctacattttaattagcactaccccccttaggtgaaatttgggccaggtgcagtggctcacacctgtcatcgtagcactttgggaggccaaggcaggaggatcacttgaagccaggagtttgagaccagcctaggaaacaaagcaagaccctgtctctacgaaaaaattttaaaatcagccgggcgtgatggcgcatgcctgtagtccctgctactcagatggatgaggtgggacgactgcttgagctcaggaggtcgaagctgcagtgagctgtgatcatgccactgcactccagcctgggtgacagagtgagaccctgtctcaaaataaataaataaataggctgggctcggtggctctcacctgtaatcccaacactttgggaggccgatgggggcggatcatgaggtcaggagattgagaccatcctggctaacacggtgaaaccccgtctctactaaaaatacaaaaaattagccgggcgtggtggtggctgcctgtagtcccagacactcgggaggctgaggcaggagaatggcatgaacctgggaggcagaacttgcagtgagctgagattgtgccattgcactccagcctgggcgatagagtgagactccgtctcaaaaaataataataactaagtaaataaacttcctgactgttctgggaaccctcacccctttgtcaccaacacactttccctgcagagaaagctacactgcttgagtgagttggtaaatgctcctctctctctccactctgtctctcgcaagggcacgcaaggctttctatatgggcttctaagctttctctgaacccagctgtctggttgacaaggagcagattgtaataagacaatacagtgaggtttgcacccttctacccttcagccgttaccaaatgtgacagtaggtaagtaaaccaagccaccttcaggctgcaagtcggggcctcagaaccaagttataacctgagataaccccagttggctggatgattgccgagaccagacttcctacagagagtgctgcccacttctgcggtgataactgcaaaacagggcccctcataatgtcctcatcaggacctcctcaatctgaggaacacagaggcctccaatgtttggcaagagcactggtttgggtccagctctgtgttgggatctcttgtttcctcacctgtgaaataacaatggctaatatttatacaactgttttaattatagtagaaaacacataccatgaaatttatcatcttaacaatttttcaggttttttttttcttttttgagacagagtctctcgttctgttgcccaggctggagtgcagtggcacaatcttggctcactgcaacctccacctcccgggttcaagtaattcttgttcctcagcctcccaagtaactgggcatgggccatcatgcccggcttttttgtatttttagtagagacggggtttcaccatgttggccaggctagtgttaaatacagtaagaagttcttcttcaaaggtttagcttgtttaagtttccttgtcctctgttccctcctttcaaggccagacttccttactctctgtgtccccctgccctggtaaacaaccttcccaccagtccttatctatacagcccacattccacatctgctacccactctgtgaattacccctcccgtcacaacgaccctccccgcagaaactgttcctcccaccccccaccagtgtaaccgcattcttgcacttttcaagttagccaaccgggttcagcttggattggtccagctccagccaatggagacaggacacagtagcgggcacaagctgtgttaggaataaaaaccccttccctcctttgtttggggtgctctcgtggcgaccagacctacaagaagcacccttctgcagaagcaaatttgccttgctgagagatcctttgtctcagtgctggttcttctttgcagcactgagcatttgtttccaacaaatttggtggcccatatggggacctcattctcctccgggaaagggtctctgatcacttctcatgaggagacgcatcccgctaactcattgcagtggcctcaagggtaaagaatcgggacccacccagtgcaaccaataaacccagactcttagcaacacaggaagaaaaggcctacagttactgtggtgagcaggtaacgctatgcacagaccaaggtaagaaaaactgtgggggcggtgaagtacttccttggtggtagggacagtttggaggttaaaagtgtgtaaataagatgcacaattaagtgcaaagcgagtgtggagtaaagtaaaggagtgcaagaaatctccagtgggggagctgagcctccagggaaagggagcaaaaaaaaaacaatctctagtaaaagaggttgagccaggaggccgaggcgggtgaatcacgaggtcaggagatcgagaccgtcctggctaacacagcgaaaccccatctctactaaaaatacaaaaaaaaaaaaaaaattagccgggcgtgatggcgggcgcctgtagtcccagctactcgggaggctgacgccagggaatggcgtgaacctgggaggtggagcttgcagtgagccaagatcgtgccactgcactccagcctgggtgacaaagcgagactctgtgtcaaaaaaaaaaaaaaaaaaagaggttgagccccacacacactcaggttgagccttcagggaaaagggtgcaagaaatctctaataggagagactgagcccccattaacttccaggatgggaaatacccctagtaaaacaagaactacaaaggaccaaacataagaaaaagcaacagatgataaaatattgttgttttttttgaaccaaagaaactattcttaaacctttagttttctggccaagttttgggtcaaataaggattagatttgtcaacttttaataaagtatgtaaataacaaaagtcctgtctcccaggaagaaatagactatgccctgcactggcggcaggggcctgtcctctaccccctaaaaactgcaggaaaaaaagccagaaaatacctcccctaaagaaagtaaaatccctaaccccaaacagtccactagcacatgggattcaaaatttccctttcccctcctcctcaaaaaagtctaccccaaccctttttcccttaagggaagtgcctctaggaggaggggaaattggctttgtaaatgccccttaactagttcagaggtcagaaacctaaggaagaaacttaaaccactattagatgatctttttagggttgtggatcaaattaaccgatttttaggaccacaagtatacacttgggctgagctaatgtccatcttaagtattctcttttcgggagaggaaagaaccatgatccgcagggctgctatgatagtctgagagcgcaaacaccttcccagtcaaaatatccctgcagcagaacaaaaatcgccggcccaaaacccccaatgggataataacaatgcagcccaccaagaaaacatgaaaggccttaggaaaatgatagttaaagggattcgggaatcagtgcctcaaacccaaaatatttcccgagcatttaatatgcagcaaggaaaaaacaaagggcccacggagtttttaaacagactcaaggaacaggtaagaaaatatacaggcttaaacataaaggatccccttggacaggggatgttaaagctccattttgttactagtagccaaatatcacaaagaaattacaaaaacagagaactggaaagatcagcctatagagggaatggagggagtcagggagagagagaaagagaggcaaagagagaagatggagaggcaaggagagacaga

SEQ ID NO: 1095 - DNA, 1694 bp, Homo sapiens
gggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctg

SEQ ID NO: 1096 - DNA, 1374 bp, Homo sapiens
atgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatga

SEQ ID NO: 1097 - DNA, 48995 bp, Mus musculus
  misc_feature (12543)..(12562): "n" at positions 12543 thru 12562 can be any base
  misc_feature (40585)..(40631): "n" at positions 40585 thru 40631 can be any base
gtccaaaaaaagactcctttttcatattaataaaccatagacaataacaacagttattaaactatcaggtaagaattgtattcataattgttctggtttaagcattcaagagatagatggaaaggtggaagcactagaagactcgatggtcatgcattacaagcagcagcccaatgggctggagcgccagaagaagacatttgagccacagtctctagaaactgttctcaggatgaacttagaaaagctttgagcacaagcagtgctgactgaggtgtatataccaaagtgtcatacgctatttgacagaaggaaggtcttctgtactaaataaaacaggagagaagagaccatgctccactgccttatgcccattcaggtctaaccactttaactggaatggcatatccatgatcccgctagaaagcagacactaatgctgggacataatctctctccatacttagaacaatgtttagcatgaagtgtgtactgaatcatgaattgattcaacaaacatttatagcttgacttttatttatatattcataatcccatgacaacttacagaattaatatgactatgacaaacatgtattcattttattcagtaaatctagagatataaaagtacacttttatcaattgtactattagttcaagcaagcaccaaataacactgaaggtgtacctaaacacaacatgggtattccccatacctaagaggaggcaggaggattgagactttgaggtcagcctgagatatacaatgagacattggctcaaataaataaataaatacataaataaatatatttactatgaaaatgaaaatactacctggaatatgaaaaaataaaattcagtgttagataaaagttatacttgtcttcaagttacattagatatctaaatataggtctttcttttttagtcaataatttacaaagcccagattccagttcatatttttccattctcccaatcttctaactccatggtcattcagaatctttaacctgagaggatatggcagtctcagaatgttcccagtttcctagaacagctgctttccacccagtcctatttctgagctcagtataaaatccctgtagcacaatggcaaaatgcaaaacaaaaaaatatgtgcatcctacatccgccatttagcgagacacccccttgcttgatgcttcctcactactgaggttgtcaggaagtgtaaacatttccctagaaactggagggaaaaagaaaaagtccacttgtgttaaagattctatgtccagttagagtgttacagaagagacagattatcttgggctatttttattcttcttaaatatatataaaattagccgggcagtggtggagcacaaagttaattccagcactcaggaggcagaggcaggcagatcagagttcaaggccagcctggtctacagaatgcgttctgggacagccaaggttacacagagaaaccctgactggataaacaaatgtatatataattcattttccacgcctgtgtccaacctaatatcctcataactgtctaaaactttaaaatgcagttttaacagacttctaatctaagaagaccctcagatagcacctgaggcttgcacctcccactctgtaaccaacagaccagatacagatgaagtacctaagggtgttccgtgtcctcacttgtgagatatgagctggaatgagtggagtcaggagttcaggtatggcggcacatcctgccccacaagttcaacattggtttgggccataatgagttcaaaggttagttacagcaagtctctgtccagggaggtctgacagatggatcccacgtgacctcagatgtcattcctgttacagaaatgaagtcaccctgtgtcacacttacaagcgctgctatatgcacaaaactggcttcgtcctctaggccttacctaggataagcgtacagaccgaaagccagaagtttctggatggtttacgacctgcctttaggagttctcatgtactcaaatttagtttctctgggacttcactaacccaatgtttcagttccttttagcctagctgagtggggccgctttctcaaagctgtttctcaccttggggactgtccctctttcctgcagctgactttacaaagggtgtgcacgccctccttgttggacaggagaggttacagacaaagctgatggcagggttcaggtgatgccactgtctgaattatcactaatttttgaagtagtcatacatatttcttgctgtacccagagcatctcagacttgcacttgtatccagttcctacccccagttctctaaatccattcagtcaggaaggtggacagcttctcctcgatcctttcctgaatattttcattccgtttaagtttgacttcatatgctggctggccgaggcttatttgcttcaccacagtgacttctacatcaagtgtttctgcttcccacctggttttcctcagacgcagcctctgttacagcgctccctggtttaagagcttgtcacatttctctctggatacaacctgtacagtggatctcagtcccatataaccgaaggtatgggttgggccaacataaatttggcaacagtcaaaagtttctgaacttttagaatcttctgaactacatgaaattaattcaaattaaacctcataaagactctgctatgtttccgaggaactcaccagctttggatcacaggaactccctgcagccttgtgtctggaacacacatgtgctagccacaaacacatgccatcacacaacgccaggccagtatctgcagccgaaacggttcgtactttacctgtgctttgattgtgtggatgagttttctgtccttatagaacattatagcacctaatagcattcctcagcatttatgcatatagttagtctgtctgtctttctttctttctttctttctttctttctttctttctttctttcttcttccttccttccttccttccttccttccttccttccttccctcctcctcctcctcctcctcctcctcctcctccttcttcttcatcttcttcttcttcttttttaatatttgagctgctaatttgagtttcatttaaagatcattaaagtaattttgatcttgtttaggatcagaatttctaacaatttctaaaacagacccacacacgcttctggtattttgcatcacatatttataaggcagcattttcagcattcagtgttctgcctgcatgcatgccttcaggccagaagagggcatcaaatcccattgcagagggttgcgagccaccatgtggttgctgggaattgaactcaggacctctggaagagcagtcagtactcttaaccactgagccatctctccagcccaagaattattctaaaataatttctaaaatagtttctctgagatttgctattaataaatggtttgtaaacctctttgtgtgtgtgtacacacatacatatatatacatatgtatatatataataaaaatataataaatacattactcaaaaaaagagcacctccctcgtgaaacaaaatactccattgtcaatagattttttccctatttcctttttttcctaatctaatatatacccatattagtcaatattagctactttaccaaacatagtagttcaataaaggggagttttaaaaaatctctaccttttttttttaactgtctgctctacacaatcactcgggctccttctgtctcttttctcagccatctctagaagcctgctcagcaaaggggatggaattacaatataggatcaacagcttgtagtaggatcgacaggttagcttaacataaaacaaaagtgctttctacaagcctctggctgagggcaggtgaaacatatctctgatgaagaaacgctgaatgcttacgtggccatgcagagaccatgatggtgaaggcagctctcccagagggaggcttagttgttgaccctgtgacctctccagatatgggaaactcaactgcatagctgttacagtgaggaactgtattcaaactctcctctgttaaataaaattaaaagaaaaggaaaaggtgagagaccaagtgcagcagagcaactaagttacaagtagacattttggtgagaagaggtattaagatgaggtctcactatatagcccaggctggcctcaaattcactgtggaaccccatctgacttcaccttatggcagtcctgccttagcctctcaagcaacaacatctctggctagctgccatcaaaccgaagaggtggaattataaccaagtttcagaataaactccagtatagaccttcataggctcagaactgtagtgttaactcctgaaaacaaatgagtgtgtgtgtgtgggggggggggtcacagctaggacaaggtgattatttacaatactgacatttccaatccatagacatggcatgtctctagaaaggagtattctgggcagagggagaagaacgaaagcagataaataagaaaccatcttgtttatacatctcagggtctatagagcagttcaaaatgtataaaatataagatatagattgtaagaaatgaggcatggcctcctggaagcagccagactatggaagagtttggaagccatgtatttgaacccaaggacggttttaaattgcaaatttggtgtggcttgatgtgtatccccacaggtaactggggcagcaatatattcgaatatatttttaaaggggacagaattaaaaaacacttagaacactccagtagtttagaagaaacctaacaaagatgtcccaatgatgatggcagtcaaaataaagaagaggcatagctgttggcataactcagtggcagccttagcatgcttatggtccatatgtgccctaggatagctatggggcaacccaacacaaaaccatgaacacttaaaacagcatgagcagattgtttttgcaagtttttttttttcaatctacctatgcttttcccaaatgtgaactttataggtgacagtgtatcataacaatgtcaaaagactgtacatttctccaagccttaaatttaacccctagcaacagaagaagaagaaggattcatcacaatagactatatggtgaatggatactgtaaggtaggctgaggtgataggagggccagtcatggctctcagtctgcagagatatctcagcaagtaaagtgcttgctgaacaagcatgaggagcagagtttggaccctcaagagaagccagatgcaagtctgtaattccagagtgccttacttcagctagagtaaagggtacagagccaaaacaaagaggccatcttccatcccacacttacacaggtggttctcaacatgtagattgtaactcctgagggtgggggtgggaggtcgggggtcaaatgctccttttacagaggtcacatatcagatatactgtacatcagatatactgtaccatgattcataactagcaaattacaattatgaagtagtaatgaaaataattttatagttggggtcaccacaacctgagaaactgtattaagtgtcacagcattaggaaggttgagaaccactgctttaataaagtcttttagaaacaagtgagtagtcaatgctctttagcaaaggcaacgcctacattccttccttggtacagcagaggtatcctgttctagcaccatctgcacactaaagctccaccctggtaccattcacttcctttactacctagtcctgactttaccctgcacgatgaatggcctgggaacccaactgccatgccagagactgaagtgctcactgatagttgtgtttgtttgctccttctgcattttcagtcttactctgtagcccacattggcctgaaacttgtaacaatcctgttccagtctcctaagtgctaggattatagctatgagccaataagcttgcttctcattttcctttagcaatttctgtttcccaatctctttggaggctaaggcagtatatgctgtcctggtgtgcagtaatagtaaggcagactgtgcctggcgcacattcatctttcacttgtcctccttttccctcccttggtaaggcagccttaaaggtgttagacatttgttataggcacgtgtggcagaaacatggacagacatatttgtctttctataatctcagaatgtactgagtaaaaataaatccacaacctacatcagttttgttggctagagtttcccaaatctccagcagacagttgggaatcagttcttttaactgtaattattagcattaattctcagacccacagtatatacatgttgtgtgtatatatgcacatatgtaacaggataaatgatgtctaagagaggctacagaattctgaggctttcctgaagtcaaagaaagaaagcagatacaagcaacaggaagagtctgcatgcattggactagaagtcttacaaactgcaggcatggaccggttcacatcaaataccagtccaagtgacaggacatttccagggtcagtttgatgtgagccaagtgtcacctgccggagtctctttgcttatgctggagactgaggcaagggcaaaaggagtgcttgatataacaattatcctatatgaggcttatgataggtagcggggacaattgtcatacctgtcatgttttggtcttggggcactacttcttttctagtcccaggtcaggggatggattacatgtaacatgtcagttcatgtgtgctgtgcttctgattaccatttgatatatttagctcttggtttatgtttcacactgtgctggcagataatgattgtttgcttgtgcaagcaagatatagactcattctttcttggcactcatactcaaaacagagtaactctggtcatggttgttgctttgtaaaatggaataactcaaggcaagtatggtggtttgaatgagaacactcccatgggctcatatagtttaacttggtctaaagtaggtggaactatttgggaaggattaggaggtgtgtcactgtgggtaggctctgatgtttcaaaagccattccctgtcagctttctgacttgtggttgttgtctcaagatgtaagctcccagctagtgctccagtgctctggctttcatgctccccaccaagatggccatgaactaaccctctgaaaccatgagccctcaaattaaatgcgttcttttacaaattgccttggtcattcctttgttttatgactgtaatagaaaagttactgaggtcactaggcatagcctaaaaggtgatattccacatcatagacctggtcagagcagtcccagcccattctctcagcattagtatgcagtatgcaaggtgcctggatcacccctgaaagggagccagaggttgttactgatagcccgcgcacactataagtccacaccctgcatcagctaatactccatttctgttttctttgacactcttctaaaagtttatacctaccacatccatcattctctcctcaacctgcttcaatttggcttttataatgatccttttaaaggcacacttctcaagtcacaaatgtcctccattctttatctatttcatagacagggtctcccaaaatagcctaggctattcttgaacttcagaatgtctggcatgagcctgcctagtcctgggattactggaaagagctatgccacccaatttaatgacctccattttgccatactcatttagagttcattcagaaaagaatcctcaactgtttcacttctagcagctggccctgccatcaaacatgcctgtcaccatgtcttctgtacaaacacttgtctaaatcacctttctaaaatttccatcatggcaacagtgccccaccctcacccctaggtagcatatactaacagtgtaccataccagccagggtaagtcttcaaatgtactgcatcaactgcatgactaaagtttccagtagcaaccactgactcagctcaaacatggcctctacagaatgtccttctagagagcccagttggtttctactacccccactaccttattttctttatagaaatgcagtgacatcaagacttatgcatgcttgtgttttgagacagactccctcatagctcaggctggctttataaactcattatatagtggaggatgacctagaacccctgctggtcctacctccacctcccaaatgctgggattacagacatgccacccagtactaaaattaccacgtgttagtctctgtaaaccccaatgacaagcagccttatcaggtgtacagtgacaccttcccctagcacaaggtctaaaaatatccatgagaatttcaacctcctatttactttttctttgaataaagacagtaagtagaaactatgtcattcagatatggttgagttaaaagctgaagtatgcctgcattcatgtgtgtgtgtgtattggtgtgttcagtgttttgtggctcatcctatcttcaaagttatgattctgtggtcttgacctctggagcgctgaacatagttcaccctgctaattgttttattttattttatatctttgtgacttgtttatgattgtgtttaactaaaaacacaactgctatttatactctttgagaagacaatttggaactagcagattttaattatttccttcactttgggggagttgtataacaggatgaattttttatgacaggatagtatatattttaattatccaaccccccccccccacacacacacacacactttggcgttctttgaagcgcatgtagaggtaagaggacaacttttggaagttgattctgtccttccatggatcaaactcaatttgtcaggcttggtagcaagcgcaattattctctaagctatcttgttggccatgcaagatgatattctctatttcccctccattacttgttttagtcagtaaatgactggagaacgtaagaggtggagccagataaccctgagttatttctgttgttgagacagtccacctacctcagcctcccgcgtgctgggagtgcagtgcgctaaacggggctggataatcttaagcttaaatcgtgcaattcctttctagaactctaaagtatggacaagctactcagcttctccaaaccccaatcaaccctaatactcgtgtatacaatgacatgctaatacatcatagactaagagaacaggtgcgtattagcaactgaaggcaaacaagattccgcctgacctgtcaaagcaccaaagttcggtccaggcctcaggccgtgggtatctcggccaatctctggacgtcgtgtacatttatacagaatggggttagcggcctcgcagtgcagctgaaaaactttggtaggtaaaagacgtaatgtagatatagagggaaaataaggctgcgggggtccccgtatgcaaatctgcgccttactgccgaacgcgggcgctggcgcttccgcacttcccctccagagcacccggacaactctctggcgcgggggcggagatttgcatgtgcgaaatcgggaagagggggaaccaccggtcgaaaaccccgggcgggcctcgggcggccaaggagcgcgcccggtgcaccgcccggcccgcctccggccgctcggccagcatgacgtcacgaacacgcccctcggctttaagcggcgctctcaaggactctggaggagggggatttctcagggaccgacggcttctcacgcgcggagtcgtcgctgcgcgccctcacggagctcccggcgcgagcgtgcaggctgtggtggctctggaggaagtaagcgcactggcccgcgcggggtcgcgcgcccgccgcgaggctccgccccccgccccgggtaggcggtggcgcgagtgacgtaagcagcgggaaatccccccccctccccccacgttccgccgggcggtccgccccgccccctgcccctgccgcggcatcctggcaaggcgacgccaggacactagtgaccggagcgcgaagattcgggggtgggaaggtgtgagccgcaaacccagaggagccgggaaagaagaggaggcccgggggtggtccgaggacaggcgtcccggctgcggaggctgctcagcctcctcactggttggctgactgacgggctagctggctgactgcctgcctgaccgactgcctggctgactgactcactgactgactgactggctgccttgcagcctcgggccggacgctggaagctgcagcgagcggcgcgcggagccgagccatggcctcgagtgagtaccggggcgagcactcgcgggtcacggggaggagctgtcgggggctccgtttggggttaggacggtctgcctttcaagtcttctcatctggcaaattgtcagccgtttgaaaagttgcccgctccggggtttgcgtgtgaaatcaaagcggcgcactgtaatctgatcttctcctaatagccagaaccttcgaaattcccaacggtgtgcttttaggatcacagggggtaatctcagtaaaggagagcagagaagcctcgcgtttaaagactcagtggtatggagacccagttttacatttttgaacaaaaaagaggaacctccggacctcagacgagctttctttttttaagtccaatcgtgctagcggctgacactggtacagaatgtggcgtggctgtgaaagtcctcagtggcgttttaattcgttccaagcgaaaacactacccccgcccccacgagctaaagatgttgcttgtctaatttaccgtgtagagacctcgatcccttcaacccccaaccccaaacctgcacgcgcgttttgttagcagcaagaggacgagatttgattatactttaaagtaactggtagggttgaaaatgtcatcgtttaatgtcagtgttttatctgccactagtaagttttggatcatctgctttgagggggacatttataagaaacagtttacaggacaggggagtttagtatgacagtcgtactatatgtaaagcaagcacttgaagcagctgagatggtggtgggagctaaaaatgacaccttctgtctgtagcaggacgctgacccttatcttcccagtgaccctcagtagaaggcagccgacgtctggcagagaagaggaagtagaaagcttagtgaactctttaagagttgagcagaacaatatcataactcctgctgtaaaggaaactggggtgtttcacatgacacttgatttcagtttgtctgtggttttcatgagaaaacaagtgtagtttaaaatatttcaactttctctttacccatttaaatgaagccaggctttcagatgctctagtaaatttgtaaatttaactcatgttctgattagaagcacaaaaaggctttaagtatttaattcattggtaatcagaaagagatttttgtatgacatttgtaaagagtggcaagctttgttaaaacagttctgtccttgtctacctaatagaatcttattatatagtgtatgaatgcaatacttgaatttttttcaacagaaaagtcatttattaaagaactgtaagacagatatgattttaaaatgtaatacaattgcaatttgcctaaggacatatattttgtgctgttatagaaatgattccaaaagttaaagtggggaactttttaaaagaaatggcaagttttaaggatttagaagttgggttgggcttgcccagcttctgtgaagccctgggttcagttctcagtactgtcagagaaaaaaaaaaaatcccaacaaacatagaaaacaaatctgcaagttgtagtatcattatcttcttgctttttgatcttttatcaagggttgcactaaatgagactacttaaaatacaccatgtcatttaaattgtaattctgctatttgaagtttctaggcaaaaatatagtttaaaggagtctgggtaccttatatcagttataaagaccaaatagagaaaaattatgaaataaatttaaaattcccattccctttgaaatactaatttaaaagcaacaaaactgtttaacttatgattatgtaatttagatccttttttttgcaatatagtactgaaacctaggaaagtattcatattgattaccaagcattgagatcatttgttcattcctctccgatgtcatatgtaaataggtatgtgtaattgaataggtggtgcttataaatgtaaagtgtcgtagataataatctcctgggcagaattatataaatgttgtgaaaagacaggattttatatgatgatactaattattgttcaggtaaattagcaagttaagacttcctagctagccattaagctgtttttcattgccttttaaacaatactgtgctttgttctagctttttgataagattaattatagcaggcaacatgggaaaaaaatgttcctgatcaaagatctgcatatttaagcagtcattattcaaacaattgtattctatttaagttagctgtcttgtgtccatatctaaaaattttcactatttcnnnnnnnnnnnnnnnnnnnntggagggaggtgcacagttgccttgtaagatacatactattttactaatgattaagattgtctttggtgaaatgtactttaaaatttagaaagtttgtatttagtcacattttttttctttaacatgattctgctgtgtcacataacaggaagtataggaaggaattatttttgtggaccttactactcaccaactttttgtatgaatttcaagataaccttttccccccccccaataaaagtgaacatagctgtgtgacaacttacactttaataatagagctggaagttaggagtggccagctaaaacaaatgacttccttttttaagaaggaagactgttcacaaatacagatgtttcagaaacgcagcacatgaaaaagagataaaggtgttgtaatagtaggtgatgtaacaacaagaatgaatggagaaaatggtggatacagggtatatgtggtctctttctcaatttttttgtttcaattttctcccatatgggttctctgcatgattgtgtttatgggcacatgagctgaatattgcagaggaagatatattttcaaaaaaagtgttcctttgaaatttgtacttaattggatctcttgtatttttaagtctgaaatctttttttttttaaagatttatttatttattatatgtaagtacactgtagctgtcttcagacactccagaagagggagtcagatctcattacggatgattgtgagccaccatgtggttgctgggatttgaacttgggacctttggaagagcagtcgggtgctcttacccactgagccatctcaccagcccatctgaaatcttaatagagatgatttggccctgccatgaattttttatttgaggaaagacttttaaacattacttttgtattctagtaggtaaaaacctctcaggactggtttttagtttgttgtttgttttgtttttcccgtatccacagcagtgatatcttactgcaaaccgtttacacggctttggttggccttgtgatgaatactcagcagaaagttctggatggagatgatatttggaagtgtatgattattagctgcttgctcctttgcgttccaggcaaaagctgtttccctaggatttcatgagaaagaagcacactagtcagctcttctcaaccatgcttactatgactgccatttctgtgctgccttgtaaataacaaggctcagatatgttttatataaagggaaatcaaaggccatcttttgaatgttttctttgtttcagttgaatgaggttggttggttggttggttggttggttgggtgactgggagagtgacaacttgccagacattttttgcctgtcttatccataattatgtctatgcttggatccgagcattgggttacttccctgaacactttgcattgttgtttttacttcttcatgtcttaggcagttggtcttcagagtattcagattaatttgggatgtttctgcagaaatctgtctgcactttattcttgaagtgtttcatttctcctcagatctctgtgaggttagatagtggtttggcttctgatatacagccccagaacaaactctgttctagggactttgaatctaaatattcaccttatattcttaagatagttgtatttgttttaggttataggttatggccatatctgttattgaggttttatgcttaacaacttttttcttgttacataaatttaaaagttgattttattttgaaacttggttgtaattacacctctgcagtttaaagacacctatgacttttattctttaaaaaaataatctcatggaagagtttcacgctatcattctttccctagctcttctgtggctatggacccagaagacatacatccatttggtagtcagatttgttagttccttggattatgactgcctcactgctatattattaaaaattgttactgtactgtgtatatatgtgtttatgacaggcatagtggtccattccttcaatcccagcacttggaggcagaggcaggcagagctctgaattcaaggccattctgctttataaagcaagttacaggccatccagaccatacaatgaggctgtctcaaaaaaaaaaaacaataataataatccttttcctcaaaattttatattattttgaagttttagcatctctaaaatgaacagcagttctctttatgaagagtaaagttaagagaatctgtgagaaatacctatgtgtgtgttttaattggtattataattaattatatgtaacatattctcattgtgtacttaattatggcttctcattctagcaatagtatttttgttgatatacctattttatatataattgtggcaattgatctatttttaatgtttctaatgtgaaagaaatttctaattcctttttaatcttaaaatctaatttttaatttttttaatcttaaaactcatacttgagattttaaataggctcagtgttttcaaatagcattctcttgcacctaaatgcaaatgaaatcataactatagtgcaagcattttagttataattcaaaacttattctagtagatattagcaattcaaaatttataaaaatatatttaaaaaatatggagaccaatccagactttacacttgtcctggttaaagaaaaataccttaattaaattgtttagaaacaactttgaaaacatttctgtgcttttaaaactcatagtgactttctgtaaccttaggtaagagtatttgttttccctaaggttccttggtttataatttttccttcgtactctccatagaggactacagtttttaatttttcatcttcaagaggaatggcattgtaaaacagtaccaaggaagaacatgattggatcattctactgacacatgataccaatgatttcctagctaggagggctacagttaaatcagaatatgaacacatatgaggaagcatgaaggtgtagttgttctggtacctacaaagtactgggtttttttttccagttattgaggaatataataaggagggactgataatcattaatatagtcctttaatttttgaatcactgacacaaaagagctttggaattttaattttcacacagatattaatttaggacattaataagtaatacaatttctgccattcagtaacttgaagaagtaaaacatgtagtttcatttcaataacaaagctgggtatggtggtagaaatctgtagtcgtggtatttggaagatcggaagttcaaggaaagcctcaagctacacattgagtgaggcctgcgtagattacttgagagcctgtctcaaaaaaggatgtagctcaattgatagagtagctgcccagccttgaggagccctgattggacccagcattgtacaaagtctgtggtagtggagcctataatttcaacactaggaaagtggaggccagaggcttagaagttcaagatcagcctaggctacaaaacaagttagaggttagccctagatagataagacactgtctcaaaacataaagaacacaatagttaattttccctaaactaatggtttttttggggggggggttggttttgttttgttttgttttgctttgtttggaataattgctcttaaaaattaccttgattgtttgtttacaggacggaaaagttattcccaatagggaatgtagactataaattctgaaatttgtttttgagtgagacttgttatcaatgaagagttcctttttattgttggtatatttttgattttttgttttttgagacagggtttctctgtgtatccctggctgtcctggaactctctgtagtccaggctggcctcaaaaatcagagatccacctgcctctgccttcccagtgccaggactaaagttgtgcccaactatttcctggctcaatggagaatttctacaagaagaaaaataaatataaatgcatgaaattacatgacaatatttaggtaattcttattactttaagaaattttaaaaatacttagtcttaggtcctttgtatttcatagttttataaatacactcactggtttaaagaaatgtgtaacttgctttgaataaccctgcaatgttttttatatttctcctttaaaaaaaatccagctatcattaatgatatcattaattatcaatttctcaccagaacaccttttaagtagtgggctgggatttatttgaccatttagttcaaccatataagttctttaagatgccactgaaaaaaatcatgttgaatttaacacatttgaagagaaaggtacattctcttaagtagtcctacaagaatgcataggcatataagatatttaaaattacgatgtaatttttacatatacagtgatacacacattgtaaaatattcatttgccttatatttccagtaattactatggactttgttggattaaagtagttttctcttttgtgtgtgtgtgtgtgtgtgtgtgtgtgtgtgtgtgtgtgtttgttgtttatttgtgttcttttgttttgtttctggtggtactgagtttgtacccagatccttcagcctgctttctgtcatttgaataagcaaatgagtgatagattcaaatgcaagaggtctaaatcagaatgaataaaattaaaggtagcagcaataatttattgaaaaaccacatggccacaattgattctcccctttgcccccaccccctgtgtgtctctctcacagggacctagtactcactcattaggctagtctggcaagccagtgactgccaaggttcctcctatctcctctccagcactggcttacagggatatgctaccatgcctggctgtttttatggatgctggggcttgaactcaggatcttgtacttgaatgtcacgcatttttctgactgggctgttttcccagactcttaccactagtggtttatttctctttgatgtttagataccaaaatatgtcagttttgttttttgaaataatcttttttctttataacagctatatttcagacatatccacatttttgctcatatgacaatactctccacttacctatagtctgatttttttcagttcatttatttgtaatcaactgtagtccaaaatgttaaaagaaaaatttcataaagttttaaataacttgttttagtcatttgttgtaattctattatattgttgttaacctcttatatgtgtgtatgtatgtatgtgtgtgtatgtatgtatgtgtgtgtgtgtttataggataaaatgtatgtgcatgtatgtaagtcgtcttaaactgattcttttcttttctttttttttttttagtctaaccactaccatcagaattctttctctagaaagctaatctgagcctttgatttcctgaataaaagcattgattgcttttcacatatacaacaaaatccatattactggatgtgcttggacttttggttctctttctaagagtggtagtgcactctacttccattggtggttgatgtcatggacaattacttccctttttctaaaatgtctttccactcttgttttgttacattttccctctcttaaactgttagattcctcttttgttcttattataactttctgcagaattttgttagtatttcccccttctgtacactaacatcattgcgatgactagtatagtcattgcttgctgttgggtatagggtccttccgagtagcagctgtgatagtgagggtgtcactttcttcaagagagcaacatctgaagtaatagtagtaccatttactgattaccacttgtatgtgtgatacttggaagaatttaacacatattttacagagcatattaataataagatattattaaacacagggtcttgctagactcttgctggatcttattttgttttgatagtagaactcaggaggcaaaaaaatcactgcaagttcatggtcaattgggtctacatatacatagtaaattctacaaggaaaagaaaagtgcccagtttggaatagaccatgtcccatgctatactaaaaaactcattgtttcaccatttctgaagcttgtttacattctacaggataagccttagtgaaatgggtttatggtttggggaatttatactcctgaagtaaaatcacatggttacctgccttaacatgaaaacacagttattttatggaccttctatttccatgacttggctaaagggtgaagatgcatatatttttaaagttttattgacatatacttaaaactcattataatataataattatatataaactttttttttagtttttttttttttttgatatgagatctcattatgtagccctgctggcctggaacttgctatatagttaagactggtcttgaactcacagagatcagcctacctctattaaggcctggccctccatacttggaaataccatccttcaaactttctcatctaccaagtttagacaaatagtgatcaccttttttttcattatagattagcttacatttctggagtttcatgtaaatggatcatatagtatgtgcttcttttactcaacacacttactttggtagttatatttatagtgttttatcctaagggtacgtatgttgaattacatttgttatggaaggtaaatgactttgttatctccacattatgtgttacattttggagaagatttagatgggaccgatttgaaagttcagttgagcttaaagtcagtatactgttttagtatattgtgtacagatcctttgataatccagactcgcctatgcaaggacgtaagtccactttaatttttaatgagtgttctttcatgcagtgattgtctaatttaaaataaagcagttaagtacattttactcagttttggaatataatgtacttctgaatactattttcttcacctttcttgggaaatgttggaagaaaaactttataattgccctcatgtggacaggtaactctaagagttgttatctcacaacttaatacactcattaggtatagatattaagcaataaagaactcaccagttatgtgttaatactacataggaatttagtttgtataaggaaatgttatcttcatcatttaatctttgaagattacattttaactttgttatttaatgttgggaaggaaaaagatctttgttttttttaaaaaaaaatatatccattaatgtctattatattactattctaatctcattgcactgttctttttaaaattttcaggtggatataatccatacgtagaaataattgaacagccaaggcagaggggaatgcggtttagatacaagtgtgaagggcgatcagcaggtagcatcccaggggagcgcagcacagacaacaaccggacatacccgtctgtccaggtaatggcctttcttcagtatctcacttttaagggttcagtttgttttactgttttctagacagggtttctctgtgtggtcctggctgtcctggaactcattctgtatagacaagactggtcagagatctccctgcctctgcctcccaagttaagggtgtgcattaccaccacctggcagaagactcagtttaacagtcttttgcaaccccctttcttctttgcatttgctctccaatagctagatgtgtagggttatctcttaaaggaatctttcctgcttttaaagttcatgtagtaatataactgcagtgattcacagtgcttactgtacactgacagctttggatcggatccctcttgtaacacaaagcatttaatgaggaaaaagcattctgtacgtatactggtcaagggaattattgtataagttaaagatggatttggaacattttttgaccttttagtatagagggtattaataactttccccttctttttttcatacctttatgcttacctcccaaactctgagttattaacatcatttaaagtatcgttccttttctgtgtgtgtaaagtgctcttttgtgtgtgtgaatgtggacactcgggtaccttagtgtccatgtgggagtcaggacagcattcggcaggttggcgtcttattcttgtgttttgagacagggtgtctttgctgtttttccactctatctatacacctggtccactagtttccagggttcttctctttctgacgctcatctcctgataggagtgctgctactacaggctcaagctactggtctctttatctttattgacagtactagggattgaacctagaatattaggaatgataaacaagtgttctaccactgttatatatccctagcctgtgaaaacagtgtttttggttgaaagtgaatttagcaaatataccatttttataatgtatgtttatatttgatatttataaattacatttccttttaatttttataatctatttattcatttattcatgtttagtgttttcaaacaaaattgttagccccaaacttgtagtgatcttgcctcttgcctctgtttcttcatactggaattacagacatgtgcaatcatgcctagctaatttttatcgtttaagtgccaattaaaatccttaatagcgagttggtctggtagtacatgacaagcattgggaagcataaacaggtagatattgagttgtggactacttacctatataagaagttccaggccagactgggctatttaaacaagaccttgtctctacaaacaaatgaaaacaaagttaatagaagtcaggggcagtgtcacccatcaaaatctcatctacttgggaggctgtggtgggtagatgccttgggcctagaaacttgtatggataaaaggaagactatctcaaaatggagtttgaaatgtccttaatttttcaccaatagatctgaaattactgttttgtaactagcttattatttacagtttattttattgagcctaagaagaattacaaaattgccaagttatatatagattcccaaatttctgtttttatatttttaactgatacagatgcttaaattgtacattttaatgggatgtcatgtaatatataatacatgtatacatcatgtaatgcttcaatcaagttaaacatacttagctcctcaaacatttatcattccttgtggaaacattcaaagtcctcctagttttttgaaatatatagtgtatttgtacaataatatgcctaaaggcttttgtcctatctactgtacgaacttaattttaagaaaatattttatatatgcacacacatacatatatatatatgtatatgaatgtgtgagtatgtgtgtacatgtgtgtgcacgcataggcccatggaggccagaagagagtatcagatcccttgaagctggagttacaggcaattgtgaactgtgtaccatgaattctgcggtctgaactctggtcctctggaagatcagcaagtgcttttagctgctgagctatcactccaggcccataacttcatgtttttaaatcacactatttgcaataatattgctttgaattatctaaattctttctaagtgttcaaagacatacaatgaaaagttaatttaaaattctttttttccaacattgtgagtcatttttggcttctcttaaaaaaattgtgttcctaaagcattccagagcagtgtgtcttaactccttactcccctactccagttcatcctggtagacctggaagtaacacatgcagctcagagcacagtttgctgctgtctacagggtgcagccagacacacaaccagttctggagatggttcttcagataaattttgaggagatgtttcagatacttttgaaagaaggtgcctctgaagaggcaggtcttgctctcactcctttgatggtcacaccctccaccaagatcccagctttcccttcacctgtggcgtgggtacagtcagggatgaatttcaaaacctgcttctatttttacttcctttaccacaaagttttttgttggctatgtggtcttagaggactcaggctttttttttttttttttttttgacacttctctctctctctctctgtctctctgtctctctctctgtctctctctctctctctctctgtgtgtgtgtgtgtgtgtgtgtgtgtgtgtgtgtgtgtgtgtgtgttctctccttatgctactgtgagatacagagattgaagttgttagtggcaaatgcctttacctgccgcaccatcttaccagcccttagttcttcttaaatcatcttactttattcatcaaaattatatgtacagtttgtattttttctgtcccaacaagtctttgctgtagtaatatataatcaggggtttctactctgccttggatcatttagttcccaaattaaaaacttaaaacctttatatttatgttaagcctttaaagcactagagctgggcagatatctaccctctaagttattagtatctactttctgagttacaacttgacatgctatgcctgggccactcttactgcaattggccagcccttatggccatgctttcatgattcacctaccccatggtatcttttcctctctccaccttctccttcttccctcatggtctcctgcctcagtccccacgcccaggaaccaaaactttacccatctctcttctgcccagctctaggctatctgcatctttattgaccaatcagggataagttgggggtcaaggttatatttggtgtacatgaggatcttccatctcctgaagcaaccagggccagtttttagcattacaatacatagcaacagaccaaacctcaacagttttaagttaaggagcaagttttgtacaaaaaaggctggtaaatataagaactatttattttggatttttgaggcagggtctctttgtgttgccctggctgtcctggaactcactctgtagaccaggctggccttgaactcacagagatctgtctgcctctgcctcccaaactctgggattaaaagtgcaccataatgcctggcctgcttacctgctttaaaaggaaaataaacagatgataaagctagataaaataagggcagaaagaaacattttaggaattgaaagataagttttcccagctgatatattctctgaaaactttaatctcaagtaaactgctgactatttgaattttattgcatgctgactacattatataaattgaacttaaattaatggatcaattctttttatttgtttgctttttaaaaggggcattattgtaggtagccctggctggccttgaacttgtgctgatcctgctcagccttccaaatgctggggctataggcatatgctacaatacctacctattgttaacaagatatacatacagactgtatatttaatttcccttttcagattatgaactactatggaaaaggaaaaataagaattacattagtaacaaagaatgatccatataagcctcatcctcatgatttagttggaaaagattgcagagatggatactatgaagcagaatttggaccagaacgcagacctttgttgtaagtatacagtgacagaaaccttcagcaataggacaaagatataattttagtttatagcaaaataattctgtatttaacttactgtaacatgtacattacattttaattacactttgttacctgtggggaggacacacgtgcttggggtgcatgtggaggtcagagttggctcagctggtggagtcggttctcttctccaccacgtggaccctgaggattaaactcaggttgccagacacctttacccactgagccatctcaccaacctgatattaaaatttttgttcttaccacttgcattcatcctttattaataggtacgcacatgatagttagtagaaattcttcctaatggcacctagactgggctcaaacttactatgtagaatgtctttgtacttaccttcctgcctccaactcccaagtcctgacattagaggtaacaccaccctgtctggctcagtaggagtattttttatgttattattttgttttcctttgttgttcttttgtttttttcaaaacaatttctctgtgtagccctcactgtcttggaacttgctctgtacaccaggctggcctcaaactcaacctgcctctgcctccccagtgctgggactaaaggcgtgccctacctctgcctggcttccccccccccccttaagacagagtttcctgtaggctagggttgccttccagaggattcagatactgagaattagaggtgtgagatcatagccttaagaccctgcctccagtttatgaggattgaacgtaagactttatacatgttaggctagaaatctgccaacatatccaccacttcttattttttaacttttgactgttttgagacagaatctcactgtgtagctcagcttagcttccaacgtgtagtgatcctccttcctcagcctccagagcaccggggttataagtaagcatgcattaccatgtctggataggtatacctctttatattgttgaaagtaagaaaacatatgttgtgattaatctcttcgttctgtatgttctacaaaataattgtgactatcctgtaatacacagacataatctccaaaaagttcttcttattaatagtaatgacacaaaacacaaaaagccctagaagtacacacttgacaagaaatcttaacgcctgcatgtcttgatcttccagcagtgtttcaaactttcagtcagtcatttgtgtcttgaatactctttcttgatttctgtgaagacaaacttgttgtaacctgtagttttctggctgttgttcgatggcccctggtttttatcttttgtcccactctagtgatatatatatatatattagttgttggggtttttgtttgtttgttcgtttttgaaacagggtttcctctgtatagccctagatgtcctggaacttactctttagaccaagttggtcttgaactcagagatctacctgcctttgcctcccaagtactaggtctaaaggtgtatgcctccactgtccagcttagtgcctctgatcttatactgcagtcaggagagtgttccttcagtctctgttcacagtgttctttcagagagatgtgatttacttagttcacaagacttgagctagcagggttgttgtttgtttgtttgtttttaaattctagtagtatcataggccttgtaagccctttggactcttatgtcctactcagtggcaggaaaacatccacaaaagatatgtgagtgaatgaacatgcatgtgttccaatacaaactttatttgcaaaatgagcagtatgctgaatttggcccatgatttagagtttgccaaccgtccattccagacactaagttccatgaagagaggaaaatgtatctccattccctttgggagttttagtgcacaattggaactccagaacgtgttgaatgactatgaaaaagtacattgagtgaatgatcagacgccccatgattcttagcttccttaagtcagtgctttcgcctctttcccttctttcctttctttagtactgggctgattccagggtatgatgtgctagacaggtaccacactactgagctaaccctctgtgcatacccgatgaggttattcagatgaaagaaaaccaagtcgtgtatgttagggtgaagaattattttgttgcaggatttcaagaaaggattaagaattgacaatttattttttgttattggaggaggaggaggaaggaagtggcaaagttattttaggtgctaatgaagtcacaggtgtgagtgccaagcatgaagcatgaacatacagtaataggaacatggagtaaggcaaaccaggcagcctctggctgcaagtgccaagtgaagtttgaagaaacagtgatgttcttatcatttgagttttgcttccttattcacacccacccatctcagatgatgtcatggtttttccatgtgggaacaagtatgactggatggtggtaggggagttcccccatcatcatttgtattacacatatgcaaatgagtaatatttgtagctattgagaagttttccataaatgaccctttgaaactgttgctaaatattgttagtattaaccctctctaataaaaatacttcatttcctatattgtaatcatataacatggcataaagtgtattctgttgtcaatgaaaaaaattgaggccaggctaaagtacacagcaagaccttgtacagctgtgttttcatatatttcatggtacattttttagtgatgagctaggcaggcatcataactgagcagagggaatcaaatataagaaggctagcccggttcctcatcagagtggataactgtgtgtaagtggggttacaggtgctcagctctaacagattgtctctgtgcccaaggagtgctagcaaacctctgaaatgttcatgaaaccagaagagctgatgctcagctctgatcacctcactcttaagtttggtaatgtatatatataatttttaaaatgcactagccacttctatacattttttaaaaatacataggttaacactgctataagtttagcaaaacatacctgcatatttcagggtccagctgtctttgtaccttttgatacaccaattttagtaaattgatcatgagtttgtttggaaggtgaaactttgcttcttgatggttttgtttgttttacttgtaatgtttatctaccttggtatatttgactaagcctattggcaaaatgtaattataaaatagtatatttgacagttatataatactctatatacttttttagtttgggacaggttttcccataatccagggtagcctaaaagttgctaggtaaccaaggtaccacttgcctccatctcctagtgctagaattaaaggcatgtcaccatgtgctctatttttctattaacaattctcttaggcaggcctatgtttgtttctcttgtatcttctttattatcacagtcagaaacaggatctgtgacctagaggttggtgtggcagagagctgactttctgagtatgtttgatttttgtcatacttttgtttaactatgatgtgattttgaaagtttcattttttgcttttagttttcaaaatttgggtattcggtgtgtaaagaaaaaggaagtgaaagaagctattattttaaggattagtgcaggaatcaatcctttcaatggtaagtgctttgttataatttctactatttgtattatcagtggactgtgatttctatttatagtataattctacttgttgacttgtatttaagtggaagcctcccctcccttgttgtttattttgacgtgaggtctttatatgtagctctggctgctctgttactcactacgtactccagattggccatgaactcctagcaatccatcctcattggcccccaggttctgggattgtagatgtgagccaccatgctcagctaaaacagaaaaccccaaaactgaaaccttctccaagtgtttttgattctttcaatatgcttcttctttatgccagtctaccaaccatcaggatcacccttctttctgagtgttggatggacactatgttataaagtattttcctcctttaccaccactgttatttaatagtgatctcatacagcccagccagcttgaattgctgctttgctgaggccggccttgggctcttgatcttcaccttctaagttgtcattacaggcaagagctccatacctggccactcaaaatattttttagacttctcttgattttttgtatgaatgttttgcttgcatgtatgtatgtgtaccacaaatatagctggaggtcagatctctcagaacttgagttgcaaatgtatgtcacatctgcaagatgtgacttggaattaaacccaggtcctctgcaagaacaacaagtactcttaggtactaaggcatctcttcagcccttcaaaatatttttgtagtctgtttttgtattggtaaaataaatcttactgtttagtacattttattgtgaatagcacttactaagtggtttgtttttattttattgttttggggacaaagccttaccacattaaaaaaggctaatttcagatgccttgtcctcctatctcaagtctccctcctgctggggttatagacacataccaccatttatagtttaagcatttgatgtttgttgttgtttttgtttctgtttctgcttttgagacagggtctcatgtattctgcactggtctcaaactcactatgtagccaagaatgaccttgaattttctgatcccctgctccacctcccagtactgggatccttcacattcatcataacacttggcttatgaatcattggagattaaactcaaggttttgtgtgtgctaaagaagcactctgccaaatgagctgcttccttggcctttatgacactcttggctatggcatctggtacctttagcattctatattgttaagtaggtaaatgattcctaagtgtatgcagttattctatgtacctattttagtagttttgtttgcctaggcatggtagaacacacgtgtaattcaagctacttgagattgcatccttaaacttactgtgtagctacgggtaaccttgaattctgtttgagcctttagtcatttgaaggaaggtaataaccaattgtatgtatcctatcttcagtgtttagtgaaaatacaaagatgtagcagatacacccattctgagtgcataagactttgcctgataggatagaagtggcacttgtaggtgacagtcatgtaagattaaaacctaagtacagggggctggtgagatggctcagcggttaagagcactgactgatcttcccggggtcctgagttcaaatcccagcaaccacatggtggctcacaaccatctgtaatgagatctgaagacagctaaagtgtacttacatataataaataaataaaatcttaaaaaaaaaaaaaccctaagtacagatctggtgctgcgctgactgagagagaagggatattttttgtattccaggataaagtttaggctttatagaaaattagttccgggtagggaatatgaccaagtaagtgaagtaagcatgaagatctgagttcaatctcagcatccctttgacaagagctaggtattctcaacaccagggaggtagctccaggtggagttctggagctggcaaggctcagtgggagaccctgtctcaaaaatacttagtgctgatacttagtgctgatctctacgtcctcacgtatgcttatctgtacatactgtatacacacacaaagcagttattaattgaattttcagcttttactctgatccagatatcccttgtgattcctggttgtcagtagtttttaaccatgtcgtacagagatgggaataatattgataaaataaaaactggttttctacatactgaaaaaattcaaagcaaaatatcccaaattataatcttttgtgaaaatagaatttcttgtctttgatagaatcatgggatgctaaatacatttatattttagtttattagccattttatttttctttaataaatcattttactactttaaactcttatacttgaataaatccacccagatacagtctttcatgtaacctcaaggcaaagaaacatttcccccactcccaaattgtctttgatctttctcaatcatttctttccttccagctcttgccccagtcaacagctcatctcctttttgtcagcacacctaatttttctagggttttatagaaatggaagtattcttttatattctatattctttcctgcctggctccacttggtcttactggttttgcagtgtatattgttggaaaatataaccatagtttgttctttattgctgagtatttgttcattgtatgactatactacaacttgtttctattaacagaaatttatttgtaaactgtcaggagcacctagccattcattgtttttgtctgtctgtctttctgtctgtctgttttgttttaatattgattactcactttgaaatgaagacactgaaaccttgagctcttaaatttatattgctattaaatgagactttcagtagtcctgcactcttactgcctgtcctggtcccagcaactgtgctactgtgatacaggtgctgccctcttagcattttgaacctcatattttccccttgaacatggtatgagggtgcgtacctaggtatggaggcaaaaggactgcctcagatgtttgcctccaacattttctgcctcccttttttgaactggggttctcatctgcgggcttagatggcgaccagtaccctgcttctgccttcctggcactgagaatattatcaggagcctgactactactgcacctggcttcattgcatgggttggagggttgagctcatacttgcaaggaaagtactttaccgactgaatcatctctctcagccccattttgacctttctagttgtacaagtatgttttcatagactcaaatgttaggcttaagaatgctgatactggaataaatttcagtgttagcataactcctgagactatttgactggctttgtgtgagatatgtttttttaaataagttatcacctgtaagactggggaatttagctaattatttttcatatttaatcttttaattttaatactagtgtcctttccaagtaaatttttcatgtaatttaatgaattttatgtttttaaaatatggcatatattagtaacaatttattgctataggcttaaaatatttcaaaacgcagcaatattttgttttagaaatgggcttcttttcaaatatcaatgcaaagagactattgtactatattctgtggcaagtttttgtatttttttttcagaactgtaaaaatgccctggtgtgcagtttgtttttaagctgacttgacttacacataaagttatatcatctgatatctttttcacattgcatctctaaaatgctggtgcaatatgttaataagttaatatgaccctctgcttcaaatttccatgctattatttagctgtaaaatttattatttagacaaataatgtcatctccttaaaatcaatgtcttacctataagaacagggatgatggtgatttttgctagatttagaacgtaattacagactgggccaagtgttatgttaaatgaagtatgcatgtttcccattgtctataacttgtatccatatttaagatttttgattttggtggtcagtttatgattctgcccttaagttcctagtccctggtatagtctctctctgagcatggctacagtctgttatatactgttaaatagtaactgtacaataatgaaaactgttcttgagattgaaccccatcttagttttctgcagacgtaggtgcgggttaaggttattggatgttgtgggcagagagaaagacagcaggattttggtaataataaagtattagtattatgtgttctacattctaaatctgagattgtactgttcagtccctgaacagcagctgctggacattgaagactgcgacctcaatgtggtgaggctgtgttttcaagttttccttcctgatgaacatggtaacttcacaactgctctgcctcccattgtttctaacccaatttatgacaaccgtaagtgctttaattttcttatgtctgtacttttagcttgtttcatttccttaactgctgaaaagtttaaaggatttttgcaatttgaaaaggagtatgttaggtgggattggtggtttgtgcatataattctagcaaccagaaggctgaggcaggaggataaagtttgaaggcataatggactacacattgagaccttgtctcaagaaacaagaagaagccaggggtggcggtgcatgtctttaatcccagtactcagagatagagataggcagatccctgtgggttcaaggccatccttgtctaccctgtgatttccaggattacataaaaagatcctgtctcagacaaaaaacaaacaaataaacaaagcactgttcattatagaaaaaaaaaccctcaagcatatatacatatataagaaagaagagcaaatcaccattagtctcctcctaaatggccactgtcctcaagcatacactgtagtccctttgaataagcacagacaccaccatcttcctcatcaaccccattcacccactaagtttggcaacttaaaaaaaaagatcaatgatattttaaaaaaaaacaactttttttcaagccagtagtggtagtgcatgcctataataatagcacttgggaagtccaagcaggcagatcaggagttaagttttcctttaccatgtttaaaaatgggaattcaagaccctactgtgtcacatgggatccttcctcaatagatagagacagaaaatcccagaacttttctctttgcaatgtatcttgaacctttttcaatcactttttcttttcttttttctttttaaacactgctggcatttaaccaggacattgtacagagctataccccaaaccccacttaggtttccagtagctgaatatttatctccttccttccttccttccttccttccttccttccttccttccttccttccttcttccttccttcttcttcctttctttgtgttgctttatacttttttctttttcttttttctcaagaaagggtttctctgtgtatcagtcctggttgtcctaaactcactgtagatcaggctggccttgaaccacagagatccacctgcctctacttttgcctctgcctcccaagtgctggtattaaaggccagtgtcaccttgttcagaagcatatttttttatatgtctatatattaattttaagaaatcattaatatggagtataaaaaataaaaaagatgacttttaagaatcatatttaagaatatatttggtttgtttccttttgtaagcaaattataccaaagtagatatatttatgtgtgcatttaaagacaactctctatggatcatgtatctgcctgtttatatgtgtgtggtcagaagacaacttacaggacttggctgtgctctttcatcatgtgtttccctgagatcaaactcaagttgtcaggctttgctgccttaactatgtcactggctcctgaatgtttatctcttatgcaaatatttctgacatttatttttaaaagaataacttttgacagatacctacatcaaaggatatagaagtttatttgaaaagattttaaaactttcctccaaaatattttgtgtatatacacacacattcaccagtagtatatgccacacctgatttgcatgtagaatactggaccataggagtatagaggtagattattcttaacagagagccttgggtacctttaagaactatcataataatattcggaagataaatgagaactgcattgccctagggatatagccagtgatataaaatgactcatttattcacagtgtgcctttaccaagaaacaggaggaagaggcaagaactgctcaagttaaaaggccaactagcctggtgtacatagccataagtaacaaagagactgtctcaaaagaggtaggagttgagggctagcaagcacctgaagttgtcctctgacctcttccacacatatgctgtgacatatgctcacctgggcctacatataaccacactcagacatactatagttataatacatacataaccacactcagacatacctcagcatagctataatacacacataactacactcagacatacctcagcatagctataatacacacataactacactcagacataccacaacatagctataatacacacaaaaaacatttagtttcctttatctatacattaaaattttatctattctctaaattattttcctgaaattcttccccttgtacttgtactggctagttttatgtcaactgacacaaactagagtcatcagagagggaacctcaattgagaaattctccttggaagatctggatataggaaaacctgtggggcatgttcttaattagtgactcacaggggagggccaagtccatggtgggtagggccgcccctgggctggtagttctgggttctgtaagaaagcaggctgagcaagccatgaagagcactccactaaacagcacccatccagggcctctggatcggttccggcctccagattcctgccctcactgctcgttttctcttttgatttatttgttttatttatatcagtacacagttgctcttttcagacatgccaaaaaaaaaaaaaaatcatcccgttacagatgattgtaaaccatcatgtggtcactgggaattgaactcaggacctatggaagagcatctgaaccctctctcccatccaccctcactgcttctgatgatgcactgttacatggaactatgagggaaataacccttttctcctcaggcgacttttggtcatggtgtttcatcacaacaactaacattaactaagacaatgccgagacccaatgtttttttttttaatcctttgcatttaggtgccccaaatactgcagaattaaggatctgccgtgtgaacaagaactgtggaagtgtcaggggaggagatgaaatatttctgctttgtgacaaagttcagaaaggtatttatcagctttgtttaattgaattagtagtacatatttgattaatatatgtattgtaccgtttccccattgttattattctttggcatcttattcactagatgatatagaagttcgttttgtgttgaatgactgggaagccagaggtgttttttcacaagctgatgtacaccgccaagtagccattgttttcaagactcctccgtattgcaaagctatactggagcctgtgacagtgaaaatgcagctgcggaggccttctgaccaggaagttagtgagtctatggatttcagatacctgccagatgaaaaaggtatggcaagttgggagtaatgtgtatacgtgtgtgtgtgtgtgtgtgtgtgtgtgtgtgtgctcactagaaacagctatgtagctacagatggatcttagctgagtgtggggattacagcagtgtgccttgtgctgtccctgctgcctttttaaatgtgctgctaggaattggacttagacttttatgtacactagcaagtgatgagctgaccaagtgacagtctctgctgaaggacagatcgtctaaagctgatcatgcttgtaatattgtaaaataaacattcgagtgcagttttatatcttcagaatctgtattttttttcccctagaagttttcacttgtgtgttttggtttggtttgggttttttttttttctcctactctttgcatttcttaagagtttgaataattttagagttctttttttttttttttttttttttttggttttccgagacagggtttctctgtgtagccctggctgtcctggaactcactctgtagaccaggctggcctcgaactcagaaatccacctgcctcccgagtgctgttctcaaactgttagattatattttccatctatatatgtatttttgaatttattttctgtactttttatacccttttataggtgggaaatttggtaatcataaagttgtatctattttggtccaatgtgttagttcatgttgacttacagttatttttaggatgaaaaattattattttaagctttttaaaattaagagtaaagtgtcctttataactggtactggatgtattgtacagtagcatacttccagcctgtactgttcgcatgtattttaagcattgccacactctgataaggcgcttgttcctggtgcaggaaggaagaatcccatgacttaccgctttcccacttttctttcttaatcagatgcatatggcaataaatcaaagaaacaaaaaacaactctgatttttcagaaactgctgcaagattgtggtaagaatattttggattgagttatagttaagtaaatgtgtcttatttgctttattctgtttttaaattttttaagtgataagctgtttttcaaattacacttaataatagaaaaacttatcataccaggtcactttactgagaaaccaagaactgcccctctgggatcaactggagaaggaagattcatcaaaaaaggtattttatccactttttaggaataactgctttttaagtctctttctttcctacaatcccgcacactctcactattgagtgcagctaggctgtacctctgcaggttgtgttggaactaattatatttgagggattttattgttcaagaaattacattttgtccacacactggtgcttttgcttttttttttttttttttttttttttttttttggtttttcgagacagggtttctttgtgtagccctggctgtcctagaactcactctgtagaccaggctggcctcaaactcagaaatccgcctgtctctgcctcccgagtgctgggattaaaggcgtgtgcaaccactgcctggctcattggtgcttttactaatttgactgttaccatgtaagaaatggcatggatgtggtaggcacctgtttatagctgcttacactttgaacaaggctgtggcccttggggtcatgtactgtctctcagggccactttaaaaggggtaggaccacaggcatgctgaccacctgctgtcatgcccagacctagagtcccctctctcttctgctacagcaacagagctggacagttcccacagagattgcttcccacataaaccttaaaactgtctggccttttagagaggatattttgcaatcccctaacaaactctctgtcttgtacccttacattggtgctttatcctggtttctgtagggcttgtgtaatatgtacataaatgcgggcactgtccctcagttgtctgtggtggggaattttgtgagaccttaggtcatgtcttaagtgataaaagctatgtgcagttgtcagtcctctccttcttcccattctccctaaaagcagagactagaagatcattttggccactaggtacctgtttgttgaaattctaatatttaaaaatgtgcctatatggcacaagaagctggattttcatatttaactggaagaaaattacacatgccaaaataactttgaaaaacattttcatatatttatatggaaatttgcatgttacagactttagttttgaattcaagtaataattttatgctttaatttatttgatatgtgtcagtgccctagaaagtttttagtatgtttttataatttcaattcagaaataatgctttatatcaatttattcatcttactctataaaatatattttttcctctacagaatcaaacttattttctcatggtacagttttaccagaaatgcccaggtcttcaggagttccagggcaagctgaaccttactattcttcatgcgggtccatctcgagtggattgccacatcacccaccagccataccctcagtggcccatcagcctacaagctggccaccagtgactcaccccacctcacacccagtcagtacaaataccctgagtactttctcagcgggaacactttcctctaattcacaaggtatccttccattcctagaagggcctggtgtcagcgacttgagtgcatctaattcgtgcctttataatcctgatgacctagctagaatggaaacgccatccatgtcaccaactgacttatacagtatctctgatgtcaacatgctatctactcggcctctgagtgtgatggcacccagcactgatggcatgggggacactgacaacccaagacttgtgagcatcaatcttgaaaacccctcatgtaatgccaggctaggcccaagagacctgagacaactacatcagatgtctcctgccagtctgtccgcgggcaccagctccagttctgtttttgtttcacagtcagatgcatttgatagatcaaacttcagttgtgtagataatggcctgatgaatgagcctggactatcagatgacgcaaataatcctacctttgttcagagcagtcactattcaagtgttaacactctgcaaagtgagcaactgagtgatcccttcacatatggtttttttaaaatataagttgtaggacttaaataagtatatagaatattaagagaaagttcagaagtcaaaactttaaaagccgctactgtttcttactttgaaagatatgcctaaagtccacgtgcttgctgtgagttgttttctgtatttccccaagacaaactatgtatctttgctaatgtattagttaaatgagatgatatttgctttcaagcagatttaaggtgaaaaacgtgtaatggctatgccattgggaaataaactcattattattgttgaggcccataggccaaagtgacccctaaggggttttctgaggtttcttggtatttttagggtgtgtgtgtgttaaagtaagctttcaaggcatggaagtttttttttttttctattttctattatttaggcttttatctttaaagttacatgtgaaattagcttgatatctgtattttcaagaaaagttttcttgagccttttctttttagatgttctcattccgtttgatctcctaaagcctgtctgcttcactataaagaatctaaccaggtattttgggctcatgtcagtaatttccctacttgagatcgtaagttcaaaacctgcctgaactacatagtaagttaaataccagcttgaacagcttatggaaatcttgtctcagaaatagaaaagaccaagggtgtgactcagtggaggagcttgcgtaacatttgctaggccctgtgttcagccctatgaagaagaaaacaaaataacaagttcgttttagctcagtatatccatacagagttttgaacttctctcccagccttgtgtctccttcagccttccctgctctgtatattgtcacgccatgcttcccgttgctaagcaccttggtgcgcctttattcttcctttacctcccacatctgtctattccatcgtcaaacccagaaggccatttcctcagtatgcatccgaagcccaccgtctcctttgaacttttgtgtgagacaggctggcctcaacctgctatgtagccaacgatgaactcagccttcagttctcctgctctgcctcgggagtgctgggattactagtgtgcacccccccccccacacacacacagaggtttgtgtggtgctagagacaaaaacaggtctttcctgggagaagtattctcacagttgagctatctgctcagctcagaccaaccacaagcattttgtattagtaaaactgataaacccagacgcagctattagagagctcaacagatggtactcacacagtgacttatttcacagtttttcctctaagttgaactaaggtctgtctacatctgcatttagagtattttcaattgacgttttattttccagtgcctcttactgatcacatcattcagtttataccttacaatgcatttagcaacatgtttttcctttctctatggctgcgtttgtatttcacatggttttgaaagaattggccttcttttccagattctgcttgtgcacagcgtctctcctcctgtccccatgtcaccagttagttcttgcttcctttgcataaacagagtaagtatcttcttgagcttaaaaggaaaggttaaaaaatttcccctctaaataccaagagcccttcccccacagtgccctgtcctccacattttgcctcttccatcttctcacctctcgctcgctccttcaccttccatctctgtctttagttttcccagttccttgtcttcctgtcagcctttaccctccttgtctgtgctgtccatagcctggcacctcctgaaggacaggatcctgtgggacggggctgtgttgtctgcactctcctcagcaccgcagcttctcctgctgtgggatgctcttggtaagcagctgcnnnnnnnnnnnnnnnnnnnnnnnnnnnnnnnnnnnnnnnnnnnnnnnctggaaatctttattctttttcttcagtgaatatcttttccatatgtttaaggtttttttttttttgataccttattcctcttagacgttgtagttggaacatgttgaatttattcccacaggtgtctatagatgtaacctattctgcctgtgctcccaacacttagcttttaacagcaggcttctctgcaaggcttggtcctgctgctacagctgagaggtgcagctctgcctctctctgctcctatattacagaccttcagcggatggtagtcagttaagtgcttctcacttatctctgggactctagcatttgacgtacactctggcctaactggtgctgtataaatagtagctatttattagaaaagggggataattataaaatcatatttgaggatatagtttttaatgggaaaggtgcttcaccctgcaggaaaagtaatgatgccaagataacctgtcctgtgagacatacttctcttctggtcgactgctgctcttcctcctcctcttcttccccctcctccttcttcttcctctttcctcctccttcaaaaaactatacagacactggcacatgcttcatggtagagcatggccctgtgtttgatacccagaattgcaacaacaacaacaaaattataaaacaaaagtataaaaactaccctgaggctctttgatacccaaagctgttctcttggaaatcgtagtaccaccagtatagtatcaggtagaaatcctgcctctgtatggaaggttatatcctacataccccagcggtaccccttgacagtttaccatgcatagacatgtaagtagcctgtattcataacatttttgtaactgtatattgtacaatgtaccctgttccatgtagaaaataagaggggaatggtattcaacttttgttctcaaagatatgtttcttttcttatgaagaatcacatatatagtcaaccacagaaacatggacaaactttaaggtataatttgaagaatttttgattatattaaaacaatgcaaccactatgcttgggaccccagaagttctccgcacctccaaaccactgttctgatttttgagagcctgctgacttcctatccttttcttttgctaattagttctccatttggaaaaccttagtgtagagtaagtcagtttgttttactatgctgtgtcgtgtttccacagtctcagaaaaactatatttttgtggagagacttaaaattggtgatccaggttgtctaattgtaccatatcaagttttaatcataagttggaatattgaaagtttaccataagctgtcagacagcatgcaacaagataaagaagagagactgattttagtcagttagcctaaatggacctgctggtcttcagaaactcaggcagaaaatcacaagtttaaggcctgcacagtctgcagagtgacttcaagggaacaactttgtgagctcctatctcaaaatataaagtggaaaaaagggcgtcctgagctatagttcagtgatagagcacctagcatgtacagctaaagactcggtgcctaactccaaagaactaaaaacctggccttcctacttcctagggtgtggtttgtgctaagaaatgtctgaatagaaacaccgagttaaagattgtgtttctcatgggccctgattagtctattatccaaacattcttaaccacttgatacccagagagaaaaatcacagggtggataaacactttgggagacctatgagaaaagcaggtttctctttagacaaacgtctttaagttgccccatatggacctggctctctccgaggacactttcttatcaagggaagtcagttactggctttacttttggtattttgtgacttgatttctttgtgtaagttgagagtctttgggagtactttaactcctgtgacgttgccactgcagggtttcaggtctgttcagaggttggatgtgcacggaagaggatagaatgcttttgtgtctaggaatggaaagcccacgctattcttggaagcccagcagtgggccataggcatgaaggtgccacccaagtctatccagtttcatcccttgaatatttaagccgaacatcatggcagaatttaaacctcaaggtcaacagtggatgagatcaaatctcaaaagtgatcaggtctgattgttttcatgtctgtagaaaggccgaaacccacgcatgtcctcatcatcttttgtctttttggttggctttggggaggttgggtttggtttggtttggtttggtttggtttggtttggtttggtttggtttggtttggtttggtttttttcccaaacagggtttctccgtgttgccctggctgtcctggaactcatggaagtctgcttctgcctcccagactttatttattttttttagctttcagaactttaaagaatcacaaacaagccaggtggcactaacacactcctttaaaaccagcacccagggggcagaggcaggcagatttctgttagtttgggctggacacttactctgtagtaagtgtcaggccagatggggatacacagagaaaacttgtctcaaaaaacaacaaacccaaaaacaaaccaatacaacaacaaaagaatcacaaacaaaataaaaagaaatgttgactcctcaacaaattgagtttttagcagctttataatttttggtaaaataccaaatttacctatggtaatttttttctaagcttctttagccaaaatgtaacttctcatgagctggagtaaagtaaggctgaggcatcttgggataactatgacttcactgctcttagtgaagcagccatagtgatatatcctgtagctccaatacttggaaggatgaggcaggagggatgcttgagggagacctcagctagtcagtcaccagagaactttaaaacactattggctatggttaatagacccctacaaaacaggggaatctttgctgttgttttgaccttaaattgaatattgacctgcctctcccttctgagtactaggattgtaggcatatgtcaccacacctcacctaatgtaaaatatttagatttcagagaggaggggagcatcatgctgggattgaacccagggtctcatacaagttatggttggtgttagctctctaccactaagttgtctgcatttcaaactgattttatatgcttgatgatgaatgaatttcaaggctctgatgaaattatttttttttaagttctcaagatactggtacttaagaagttaagctttgtatcaagatgaaatatttttttaatgtcaagatgccttttattatatagcatattgtgttacttttgtaatatctttgtatactgtgatttttgttgatgtaataaatagaccattttctaaaaatgcttgttacagttttgctgtttgcttacgaaatatcagatttctttttttttttgttttttgttttttactttttcattataaggggtagctatttgggattgtttaggaatagtaggcatttttataaaatgttctcaggatacagtctatctgtaactaccctttgaaatagtagtctcaagaagtacttgaaatgccctttcaaggagtcttgggttggttagatggttagttggttggtttttgagataggatttcactggggttttgggcatgaaccaccatgctgttttaacaaggcactgagcatggaatctagggactcatgcatgctaagcaagcattctgctgcctgagctacatcttcagtccttgcaggctttggtctttattattttggaacagggtcaagctggcctagatcttgctgcatacttcaaattcatggtcttcccacctctgccatctgagtcctaggatttcaggttgagtcaccattcctgcctctccaacttcattctggtttaagctcacttcaattgcttggtttttcttctgattccatacatatctttgatgggtctgctaaaaatatcattggaattatgattgcttttgtcatattaacccatccttgaagtaatcccacatggtcacagtgagctaccttttgagtatgctgttcagtttgccttgatagcatcttaaattttttcatgtatgttcatcaggggtactggcctgagttttgtcttaatgatgtctttgttggattctgccatcagaatttggcagcaattcctctctgcttgctttagaagtcttgctgccaagcctgatgacccaatttacatccccagaaaccacatggtattcaagaactaaacttactcccacaaattatcctgacttccttacaaatgctgtatcacatatggacatgcacatgataaatataagaaatttattctagaaaaaataccattttccacaaatggaacctgatctttttagagaaactgcctattttgtggctagtgtagaggaaatacaaagcctgggatatttttattttacaagaatatgctcaaagaacgatggagataatgttagaagggcataggaatgagcttgagaattctcactgctcagagtaatatatagaaataatatcagtggcaaattaccaagtcattgaataaaatgagaatctattggtgacagtgctgctttgtcttggttcagtccctaacaccacaaaacaacaaaaaacaaaacaaaaaaaacacaacccaggcttcagtccacatccataaagtaaggaaatgagagaaggccctctctctcagtgggatgccattcaatacatgtgaaaagaatgacacacattagcagttatacttagaatcagtagtaactgagtcaggtagagatctttggtggattccaatcaaatgagtgaaaatctggtctatctgcaaggcactgagtagagagggaaaggacagtaagactggaagagtttgatagacaacacccacccctcagggactagaaagtttggcaagatgcaaggaggaagcatctcctccgtggtgtcctcacatcttaaatctagtaccaggcaaactggagctgagcatagcccactaaataactgggctgaagctgtgcaaccgcttcatgaagcttagcatacaccgactacaaagcaggagggctcggtcatgaagccagtgacagacaaactgatggacaacctcagcgatgtcttccgactagataatggtggtctgtcagagctcacttcctggtatggtgggtggcctgtgatttacaagatgtcttctaggaattatgcactatgtatgtatttgaaatggtgaggtggtgctgactcagcacctctgtgggaaagttcctttgtactttttagttaagttttgaatcattttgaaaggaaaaaaaaattaagatatgaaagtaattcttttttcataataataaaacacagattctgccagctagtttttatgttaactttatacaggctaggctatctgggaagagggaatcttgcttactgattgatgtgggagggcccggcccactgtggttagagccacatggtcagggctcatggccctggatgctatgcaagagcagactgagcaagccatatagagcaagccagtgagtagcactgctccgtgccttctgcttgagttcctgccctgacttctgtcagtgatggaagtgtaagagaaataaaccctttcttcctcatgtccattttaaaaccagtcagaaaagcttacatctggactgggggttgtggctcctgagtataatccagacactttgagaggcagaggaaggagaatcataaattcaagtctagtccaagctacaaagtgaaaccctctctcttgtggcctccctcacaaagctacttcactcagttccttctcaagtggagatttaaaaataagactcaggagtagaaatagtagatgagctggctgatgaggactgctgagacataaccttctcaacaacatcacttgactgtagcaatcatgacctcatggtaactgaagatgcttgagtgggtagggagagatcacggggctctgtgtctccccaagaactactagctgttgatagatgcttgaagaggcatcatcttaaatgttgcttctgtttgcgagttcactaatgttttacatccctgcccacaaaggtagttaatactgtaagacccccgaagctgggcctctgctcaagtcccgggatgagctggccagcaccccagtgtcctgagagaaaaccacacctgatgcaaactgcaagagccatgcagggcaggggagttcaacccagagcggtgacagtagggggcttttaacagctagctgaggaattgggaggagttggggagagagttctcttcagcatgtccttggtgaaatttacaaggcgggagtggggagtgagttctttctgaatttttatctccgtgtcctcggcactggaacgcaggcatctctggttgtaaagtatagaaacaaaaaggctttttgctggctatagagaacaacgagcttctttctggctgtatttttagagatcagggaaaacaagcttgggggacgtccaggggctttaccttccagggagaaacgctctaagttgggggtctcacaataccagtgggtcacaaaacaaaggcattacagtacgaagaggtcttgtagggaggccttttgttgggggtgttgggggataaagtaggggtcaatgtgctagtacaggccatgaatcccaagtgccttggaggaaggcagaaacttgtgagctctaggacaaccaggactacagagagaaaccctgtcttggaaacaatacagaaaaaggactgggtaagtgtgaccactgtgttatattcatgtatgagactggcaaaaataaatttaaaaacaaagaatacagccccaagtgaaagagaatgcttgttgtcttttaggaaatagaaatttaacttgttaagttacttcatctaacttgcaaaggtaaccagttatcttactaggaagattctcctttatcaagtctttttttccttgctttctctcgctctccagagttgggtggttttttcccttctgaaaataagctacagcttatatctgcaacacagataagaagagagagctcattctgcagatgacataaacattgcttctaagttaaacaaagcatagagaagaggatacactgtaagccaagtgacacaaacccacaagacttcctagccctgtgtcctcactcccaaagacattgtctatagctactgtttacctttcaacaggaaataattcaaggaatgctttgttggaagttcctgaccttcatgttttgggtccagtacattcaaaactgagctaaaaaaaaaacaatgctcaaagacttttcccaaattatttaatcttttagcaaaatttcatcagaagctgagaaacattacatagaagtctttaacttttcacttttcatcagttagtttctgttatctccttttcaattttctgacaatgaaaaaccctttgctattattcacacatgatgaaacaaggtttcaaaggagcaggctgccctttcatcgcaatcaaaaacatcttcctgatataatacatctttcagagtcagtatgaattgtgtgcaaagatgagaaacgtgaataatcaaatgctattcaaatcaatgcatcaaaaaaagtcaagaagttgcactagctgatgaaaattttacttaagtcaaaattttattgagcttcccttctggtatttttgatgattaattcttctggttcaatatgtttaagatttctcttcaccatgccattacaattgacaattatgagatcatataagacataccattagccatttcttgggggcgtcacttgatatccaagttccagaagccaacctcctggctttgtaagcctaactgtccttcttaggacactgtcacccacaggagatgcaggtgctcctgacaagggtttttagaaaggctcctggagacacaacatcagctccagacctgttataagagtaactaggtgtgtcatttaacttttgtttccttgtttatgtaatcagatgttagatagaccacttgaaattagaaaacatttgaaattggaaaataattgaaacaccaaaatatgtttgtatttgtttagcattatcgaattttcaaatttgtaactctgggacaaaagttactgaaggcacttgtttctctttacataaaagacaaaagaggtaggcagtgtctagagtacgcctccaggggtaaggtgtcacttgctttgcaggagacacatactgacaattttcgattgtcaaaatagtcacttgaggtcataaggactatgacaaattgttcct

SEQ ID NO: 1098 - DNA, 2361 bp, Mus musculus
cactagtgaccggagcgcgaagattcgggggtgggaaggtgtgagccgcaaacccagaggagccgggaaagaagaggaggcccgggggtggtccgaggacaggcgtcccggctgcggaggctgctcagcctcctcactggttggctgactgacgggctagctggctgactgcctgcctgaccgactgcctggctgactgactcactgactgactgactcgtgccttgcagcctcgggccggacgctggaagctgcagcgagcggcgcgcggagccgagccatggcctcgagtggatataatccatacgtagaaataattgaacagccaaggcagaggggaatgcggtttagatacaagtgtgaagggcgatcagcaggtagcatcccaggggagcgcagcacagacaacaaccggacatacccgtctgtccagattatgaactactatggaaaaggaaaaataagaattacattagtaacaaagaatgatccatataagcctcatcctcatgatttagttggaaaagattgcagagatggatactatgaagcagaatttggaccagaacgcagacctttgttttttcaaaatttgggtattcggtgtgtaaagaaaaaggaagtgaaaggagctattattttaaggattagtgcaggaatcaatcctttcaatgtgggtgaacagcagctgctggacattgaagactgcgacctcaatgtggtgaggtgtgttttcatgtttttccttcctgatgaagatggtaacttcacaactgctctgcctcccattgtttctaacccaatttatgataaccgtgccccaaatactgcagaattaaggatatgccgtgtgaacaagaactgtggaagtgtcaggggaggagatgaaatatttctgctttgtgacaaagttcagaaagatgatatagaagttcgttttgtgttgaatgactgggaagccagaggtgttttttcacaagctgatgtacaccgccaagtagccattgttttcaagactcctccgtattgcaaagctatactggagcctgtgacagtgaaaatgcagctgcggaggccttctgaccaggaagttagtgagtctatggatttcagatacctgccagatgaaaaagatgcatatggcaataaatcaaagaaacaaaaaacaactctgatttttcagaaactgctgcaagattgtggtcactttactgagaaaccaagaactgcccctctgggatcaactggagaaggaagattcatcaaaaaagaatcaaacttattttctcatggtacagttttaccagaaatgcccaggtcttcaggagttccagggcaagctgaaccttactattcttcatgcgggtccatctcgagtggattgccacatcacccaccagccattccctcagtggcccatcagcctacaagctggccaccagtgactcaccccacctcacacccagtcagtacaaataccctgagtactttctcagcgggaacactctcctctaattcacaaggtatccttccattcctagaagggcctggtgtcagcgacttgagtgcatctaattcgtgcctttataatcctgatgacctagctagaatggaaacgccatccatgtcaccaactgacttatacagtatctctgatgtcaacatgctatctactcggcctctgagtgtgatggcacccagcactgatggcatgggggacactgacaacccaagacttgtgagcatcaatcttgaaaacccctcatgtaatgccaggctaggcccaagagacctgagacaactacatcagatgtctcctgccagtctgtccgcgggcaccagctccagttctgtttttgtttcacagtcagatgcatttgatagatcaaacttcagttgtgtagataatggcctgatgaatgagcctggactatcagatgacgcaaataatcctacctttgttcagagcagtcactattcagttaacactctgcaaagtgagcaactgagtgatcccttcacatatggtttttttaaaatataagttgtaggacttaaataagtatatagaatattaagagaaagttcagaagtcaaaactttaaaagccgctactgtttcttactttgaaagatatgcctaaagtccacgtgcttgctgtgagttgttttctgtatttccccaagacaaactatgtatctttgctaatgtattagttaaatgagatgatatttgctttcaagcagatttaaggtgaaaaacgtgtaatggctatgcattgggtaaataaactcatattattgttgaggcccataggcaaaaaaaaaaaaaaaaaaaaaaaaaaaaaaaaaaaaaaaaaaa

SEQ ID NO: 1099 - DNA, 1764 bp, Mus musculus
atggcctcgagtggatataatccatacgtagaaataattgaacagccaaggcagaggggaatgcggtttagatacaagtgtgaagggcgatcagcaggtagcatcccaggggagcgcagcacagacaacaaccggacatacccgtctgtccagattatgaactactatggaaaaggaaaaataagaattacattagtaacaaagaatgatccatataagcctcatcctcatgatttagttggaaaagattgcagagatggatactatgaagcagaatttggaccagaacgcagacctttgttttttcaaaatttgggtattcggtgtgtaaagaaaaaggaagtgaaaggagctattattttaaggattagtgcaggaatcaatcctttcaatgtgggtgaacagcagctgctggacattgaagactgcgacctcaatgtggtgaggtgtgttttcatgtttttccttcctgatgaagatggtaacttcacaactgctctgcctcccattgtttctaacccaatttatgataaccgtgccccaaatactgcagaattaaggatatgccgtgtgaacaagaactgtggaagtgtcaggggaggagatgaaatatttctgctttgtgacaaagttcagaaagatgatatagaagttcgttttgtgttgaatgactgggaagccagaggtgttttttcacaagctgatgtacaccgccaagtagccattgttttcaagactcctccgtattgcaaagctatactggagcctgtgacagtgaaaatgcagctgcggaggccttctgaccaggaagttagtgagtctatggatttcagatacctgccagatgaaaaagatgcatatggcaataaatcaaagaaacaaaaaacaactctgatttttcagaaactgctgcaagattgtggtcactttactgagaaaccaagaactgcccctctgggatcaactggagaaggaagattcatcaaaaaagaatcaaacttattttctcatggtacagttttaccagaaatgcccaggtcttcaggagttccagggcaagctgaaccttactattcttcatgcgggtccatctcgagtggattgccacatcacccaccagccattccctcagtggcccatcagcctacaagctggccaccagtgactcaccccacctcacacccagtcagtacaaataccctgagtactttctcagcgggaacactctcctctaattcacaaggtatccttccattcctagaagggcctggtgtcagcgacttgagtgcatctaattcgtgcctttataatcctgatgacctagctagaatggaaacgccatccatgtcaccaactgacttatacagtatctctgatgtcaacatgctatctactcggcctctgagtgtgatggcacccagcactgatggcatgggggacactgacaacccaagacttgtgagcatcaatcttgaaaacccctcatgtaatgccaggctaggcccaagagacctgagacaactacatcagatgtctcctgccagtctgtccgcgggcaccagctccagttctgtttttgtttcacagtcagatgcatttgatagatcaaacttcagttgtgtagataatggcctgatgaatgagcctggactatcagatgacgcaaataatcctacctttgttcagagcagtcactattcagttaacactctgcaaagtgagcaactgagtgatcccttcacatatggtttttttaaaatataa

SEQ ID NO: 1100 - DNA, 60940 bp, Homo sapiens
  misc_feature (5047)..(7943): "n" at positions 5047 thru 7943 can be any base
  misc_feature (35382)..(35843): "n" at positions 35382 thru 35843 can be any base
aaaccaaagcctgcatatgaaaaagctctagaagacaacacatacacacatactcacacatgcacgtaggtgatgtctgtattagtgaggcagaattataagtgagttttcttcttttctccaatctttatttaattttgtttatttgttttgttttatagagacagggtctcaccatgttgcccaggctggtcttgaactcctagcctcaactgatcctgccaccatggtctcccaaactgctgggattacaggtgtgagccaccatgcccagcctttctttaatgttttatatgtgtctttttttaggttgtaatttaaaaataaacatattttagcaaaaaattaaagactttgaatgttattaaagaatttaggtccgggagtagtggttcacgcctataatcccagcactttggcaggctgaggtgggagggctgcttgagcccaggagtttgagaccagctctgggcaacaatagtgagattccatctcaatctaaaaataaataagtaaaatatacatatgaacttagtaactggttggcccagcttgcttgctttcatgacagtaatccatgattttgatacccgtcttaatataatcactatcatacctctctgcaggcatagttatcactttgggtaggagttgagccttgtgcctctttttgtttttcttgatggtatctaacgcccagtggtgatacattgtcactcatatcaatactggtgtgattcaatgtgtaataatttatattttattcgacatttaatgagcatctacaatgctaaaggcactgtactagccactctagggaataaaagatgaacaagacacagtcaatgcctttaattaaagaagtaaatgcactgatttttacttttcctacacaggtattgaattgagaattttggggaaaagaacatgaagagtcttaaaagatatggaacctgtgaacgctaaaccttcatatatttgcatttttattagtaagattatggctgccagttatattgttttatatcttaggtcatattttgaaatgtgatgtgacatagtgaaaaagaaacaaagagtctggaggtctggtttcaagtttcaactcagcaattaactacctaatgaacacgggcaaggtacttaaacttcctgtgcctcattttcctcatgtgtaaaacgagggagatgaactaaatgatctacagggttccttccaaccttaaaattgaactaactctctcctgttgagacataaaagaggcaccatatgacttgaaggtgatgatgacttcattacttgttctgaaaaatgttaattctaaattggaacaagtaatcactggatctcatggttgtgacacatcagacattactacagttagagaaacccaagttagcacactgtgtcatacttctaggcagtgctatatacgcaaaactagcataccacagtatagggcctacacaatataaacaaaaagattaaaaagagattttttttttttttgagatgtagtcttgctttgtcgcccaggctggagtgcggtggcacgagatcggctcactgcaacctctacctcccaggttcaagcgattctcctgcctcagcctcctgagtagctgggattacaggcgtgcaccaccatgcccagctaattttttgtatttttagtagagatgggttttcaccatgatggccaagctggtttcaaactcctgacctcaagtgatatgcccgcctcggcctcccaaagtgctaggattacaggcgtgagccactgcgccctgccgatttttttttttttttttaaatagagacagggtctcgctatgttgcccaggctggttttgaaatcctgggctcaagcaatcctcctgcctcagcctcccaaaatgttgagattacaggtgtgagccgctgtgcccagccaagaaaatttttaacaatggatattttacgaatgctttttggagtttttatgtactaagatttcatttctctgggtgttcattaatcttatgtttcagttccttaaatgaaaataggtgagtggggcaggtttcctcagaggtatagtttttactttagggactatccctttctcctaaagtgtgctttaaagacggcagcacatgaacttgtcttagataggagggacagcaggcaaaagtgatgacaggatctgggtctgctgccacacaccaaactatttatgaattttttttaagagacagggtcttgctctgtcacccagactggagtgcagtggtgtgttcatagctcactgcagcctcaaactcctgggttcaagtgatcctcccacctcagtctctcaagtagctaatattacaggtgcatgcccccaaacctggctaatttttttttgtttttttttgtacagatgggggtctcactatgctgcccaggttggtctccaactcctggtctccaaagtgctggaattacatgggtgagccaccacacctggctctcattctttatgggttttttgttttttttttttttgcccttaagttttgttttttacaaccttataaatcacataattgagtttcagagatctcaaacaatactaatgcagtaagtaaacaggagagcaggagtggggtttggccaacagtactggtaaaattcactcatagtggttgaacccagctgttgcagctatttgtccttaataggaaggacacctcctcactacagagagttgggcagtgatttgcagtatgctaactgggactagggcatactctcgataaggtttaattttttgtaagagaaccatgtggcttaaattgatgtaaagcatctacataaactacataacggaagacaggtaactcagataatgggggtatcaaagacgaaatttggccatttatctagaattatctgagggagaaccccaatgaatccaacagatacaatcactctggttattagagtagtgtaagaatcacagtcatacgtgctgacttattcagagggcaaagtaccagtgtctgcaacttattttgaaatacatttttaaaaaccagatagatgaatggatagacagagggatggaaaaataaacagacaggtgataaggcaagtgcagcaaaatgttaatggtggaatctagttagtgggtatacatatgttcccggaaaaaaaatctttcagtttggctgtatatttgaattttttttttttttttttttgagacgggtctttctctgttgcccaggctggaatgcagtgccaggatcatggctcactatagccttgaccttctgggcttagctggaaccacaggtatgtgtcaccacacctggctaattaaaaaaaaaaaaatcttttgtagagatggtgtctcattttgttgtccaggctggtcttgaactcctggatcaagcgatcctcccaccttggcatcccaaagtgctaggattacaggcatgagccaccatgcctggccccaaacatttttatgataaaacaggaaaaaaacctgccaacatttctgagggctttccctgtgtcaggcactttgtattagtgatctcaattagccctcacaagaagcctgtgaggtaggtaccatattactacccctattttacagataagcaaacaggcacagagaggctaagggacttgcccagagtctcacagctaacaatctaggacaagctaagattcaaatccaggcctgtgtgtttgcaaagccagggcctttagctgtgaaacacagagaattccgcagatgtttttcagagcctccattaaatattactgagtattataaaacttctagaacataggaaaatattttcataacctcagtccaagaagagttctctaacattcacaaaaaacactatcaaagaaaataaatcagacttaattaacactaagttaaaaagcttcactaagataatgaaaaggcaagccacagactaggagaggatacttgcaatgcatatattttataacaattctgtggcatccatagaggtgctctgctcagatctccattctagagaggatctgcctcagctttcaagccaaagccacatatttccttggagccacctacccaattattaagtacagaggtagtataagggctaactatctctgtgcacagtgtttgtgttagagctccccattggatttactgagacttcctcaaagatgcactcccatctcattttctttctaccaaatttaccttccttccccctttcttttcaccagtgtcagacctgcatcttaagattttccctgcctataacttttttctttcccctttatctttcatagatgttacccccaataaatctcttgcactgttaatttcatattggtacttgcttcccaaaggacccaactggtatactcatatccagaatacataaagaatgtctacaaatcaataagaaaaagatagataatccaatttttttttttttttgagatgttttctcgctctgtcccccggctggagtctagtagtggtgacatggctcactgcaaatctctcgtccccaggttcaagcaattctcctgcctgagcctcccccgtagctgggattacaggcacctgccactgcacccagctaattttttatagtttttaatagagacggggtttcaccatcttggccaggctggtcttgaactcctgacctcatgatccacccataattttgttatgtaagccctatcattattattattattatcattattattattattattaagacagagtcttgctctgttgcccaggctggagtgcagtggtacaatctcggctcactacaacccctgtcacccaggttcgagtgattcttgtgcttcagccacctgagtagctgggattacaggcattcgccaccacacctggctaatttttgtatttttagtagagacagggtttcgccatgctggacaggctggtctcaaactcttggattcaagtgacccacctgcctcagcctcccaaagtgctgggattataggagtgagccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtctcgctctgtcgcccaggctggagtgcaagtggcatgatctcggctcactgcaacctccgcctcccaggttcaagcaattctctacctcagcctcctgagtagctggggttacaggcgcccgccaccacgcctggctaatttttgtatttttagtagagacggggtttcaccatcttggccagactggtcttgaactcccaacctcgtgatccacttgcctcagcctcccaaagtgctgggattacaggcatgagccactgcgcctggccggctctttcttaaactgaggactcagctcaaatgtcacctcctcagaactttcctctcccccagtcacttttcattttgaaattccttcagagaactgaaaatgttttccgtctctttgaaatgtatgtacatattttaaaaagctaaataagcctcttgctagttttgcgtcctcagaaggtctttcttgcgggcctcggagccatctcttggaaatgtgaacatcaaggatggtgctccatgtttctgtctctaggagggtttaagccttggctcttggttccaagataacttcccattattttcctttggataaagacaattaataggtatgtaatggattgtacgtgcctgaccatatgaaaaggtgagatttccttttttttggtctttgcactctcttcagtggattgcctgtgatgtgcatcatggtacgttttagtacatatccaataataaaactgtttcattcttttgttgtacattgcgcatttcgtggaaagaacagtttggggttggcaggatattttaaattatttgcccatatgggtcccccagttttgggcacttgtatggcaggctgatattccccattacctctccgtactaattttaactagtaagggacaggggcaagggcatggagctttggagtcagacaaccctggctttaaactgtgccttttatcagcattctgaagtactgtatgttgaagtaacttctctgaaccccgaatacttcatctataaagttaggaataataaatacgtcatagattaagtatggacattatctgatgcatagcaggtactattcaaatgaaggaaacgaagttatcctaggtcctttaatgcactaaatgtgtgctccatttccgcctttcttggcatctgtgtgaaatctcaggatatagtgtccactaaacttcagtgcactgcctaatgagacaacgaactccaagtgcggaccttttgagtttaaacgggtttcagtaggtaaaatacgtaaagttcacagtaccctcgcaatttagatggaggaaaaaaaatcagtcggggggggggtccccgtatgcaaatacaggaattacagaagaagacaggacccccgccgcagcaccacttccccctacagggcgcaacgtcccgccgctggcgcgggggtggagatttgcatgtgcgaagtcgggaagagggggaaccacctctcgaaaaccccggccgtcgccctcccaggccgggagagtcggccccgcgcgcccccaaaagctccccagcggccggccctctctacgtcatccgcaccctcccgcccgctcctgaactttaaaccacactcggaagaacaacctggaggagggggatttctcaggagccagcggccttctcacgctgctagccgtcacctcccggctcccgccgttccctgcgctcccgaagcccaccccaagctcccgctccctcgaccccctcccaagccagccgccgcagcagcgccgggggcgtatgcgtgggggccggcggggagcgtgcgcggggacaggcaggggcggggcgctgggggcggtcgcgcgcgcggcggccgcgaggtcgccccgcccacgcctccgggtgagggttgctgcgtcgggcctacgtcagccgcgggaaattcccctcccgccaggctgctcgcctctcggctgggccagcactcggctctccccgctccgccccctgcccctggctcccgtacggtggacggcgacgctgggtgacccggggtgcaagaattcaggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgagtgttcatggggcgcgggcctgggccgggggaaaggagctcttctgaagggggtcctgccgcagtgagtttagggagctcagtttttgctggggcgcgttctgtctttaaaatctcatatggtaaaattgtcagcttttaaaaaagttacctgcttcagggtttgcgtgcagaatccaagccacgctctgtaattcgatcctgttgtcatagcaggaaccttagaaattcccaacgacttgattttaggattagggaagtcataagcgaaccaaaggaggacgaagagttctcattaaaaatgtatatgtattgaagatggtggttttatgttttagaacaggaatgaggaaccttcagacctcgggcaagctctctccccctttttagtttaatttcatcaaatgcaaagaggtgatcccccttgtactgacagttgtacaaaatgtgtcacggctttaaaaatcatccgtggtattttaacacgaattagaaaatccgtggtattttaagtgttaatgttgcttcgaccaagtgtaggccgggcgcggtggctcatgcctgtattcccagcactttgggaggccgaggcgggtggataaccagaggtcaggagtttgagaccagcctggcaaacatggtgaaaccccgtctctactaaaaatacaaaaatcagcggggcgtggtggcgcgcgcctgtaatcccagctactcgggaagctgaggcaggagaatcgcttgaacctgggaggtggaggttgcagtgagccgagatcgcgcccctgcactccagcctgggcgacagagggagaccctgtctctatttaaaaaaaaaaaaaatgtagtttttactgtgagataaagctcaaggttcctaatctgacgaatagagacgttgaatcccccttcctcctcgctggaaataaggggaaagaggagttttagaatatccgagctttaaaataatgagtaggaatgaatacaactttatcacttatgtgactatatattttcccttaataaatgctcgatctctccctttgggggggaataagtttgtaagaaacattgcagagcaagaaagtctcctatatacacagatgtggttggggctgcctggagcttaaggttgagggggacgggagagccggggcggggggataaatcaagtagcctggggtcgagttggtcttttaccaggattttggcaaggtgagtgggggacactttccagacagaggaagcagcgtgagcaaaggcagggagggctaaatgcatgttaaatgctgtactaagagaatgaagagggggccccgtttatgaacttgactcttatccccaaactgcctggtccagtgaccctcagaagtaggctgatgtctagtagagatgaggaagtaggaagcttaaagaacctttttaaaaggttgagcagaacaatgccatagctattgctgtaggcagaaaaggaaattggggtgtttcacatgacatttgatttcagtttgtttgtggttgtgagaatactaagtgtagtttaaaatatttcaactttcccttttcccacttaagtgacaccagactttcagataatcgtgtaaatttatgaattcaaagcatgtgtagattagaagtgctaagatgacttcaaatattttgttaatgtattggttatcagaaagattttgtttggaagtaatggagaatgcctagcattataagtaagttcaggctcttggcgatttaatcaaactttattgatatattgcatgaatttaatacttctaattttttcagttgagagaggaaacaaccatttctatatagagtattgtaagacccacaggattttaaaatttgatacaatttaaatttgttcattgacactgtattttgtgctgttgtgaggaggaaggattccctaaaagtaaggaggaaatgtttaaagaaatggaaagttttaaaggtttagaagttgaagggtgattaacttttttttttttttttttggtcttttctaagagttgcattaaaatgggactatttaaaatgtaacaagttatttaaattgtaattcagttgttagaaaactgccaggcctggaataaaaaaaaaaaaatgtttacaggaatctgtgtacttttccttaatctgttataaagaccttagagaaagaaaaagattcactaataaaattctaaattcctattctgttttgaaacagtaatttaaccggaagagtgaccaaaaaaaaaaaaaaaaagaaattgcttagtttttcattgtctagtttagattctgtttgtagtaaggtagtattaaaacctcagaaagtaacttttattcattacgaagtatttaagagcatttcttcatttcttaccagatgtcatatgtaaataggtatatgtagttgaatatgtgatagctataatgtaaaagtaacataaatcataatcttataagcaaaattatgtaagttagaatgtagtttaaaatcatgtatataatatgattctaaattttgtttagataagttagcagattaattaggatttcacagcttgtattaagctgcctttcgttgctttttaaaaaaattacaccttgatcacagtcttttgacataattaataatagatatagtgaagaaaaatgttcccaaacccatctaaggtatgcatagtaggcagttgttgcttttgtatatttattctatttaatataagtaaaattagatattttatgtctgaatttaaaccttctcattgttccagtaaaaagagcaaaatgtctttgtgtggcatatagctctgttaactaataattagtgctgtctttggtaaaatgttttaaaatttagataatttatttttcttcacatttttcttagtatggttcttctgtgtcacacaataggaaggaagtacagaaatgaattgtttttgtaaacctcacttcttaccaactatttgtagtgtgaatttcaagagaattgttgtttttctcgattaaaggggagaaatggaagtaagtgtgaggcaacttaatctttaataacagagctggaagttaggaatggatagctacagtaaatgacttctttttttaagtaaaatgccacacatgagcatgaatgtttcagaaatgcaacacatgaaaaaatagaaataacaatggagttaaataattaaggtgacgtatgataggcacagataaagggaatgagttaatgtaatgactagggaggagccagacaatgaatcataattaggaacatctaggttatgcatagtatctttctcaaatacaatttaagggactcagaatttcattttgttccaactttctctcatatgggttctctgaaaatgattttgtttgtaggcacatgacccaaatattgcatgggataaaattgtttttctgaaattcatatttatctgggcctcctctgtttttatttttaaaacagaggtgatttggtcttgccatttgtttttaactttaatacctgtataatctaggacagcttttaaaatttatttattttaccctggcacgtgcaagagttttttcaagacttaccttttttcccccttggtaacagaatccctattgccagaatcttttacagtttttaccttgtagtgcataaatcagttgaatactcatctgaaaatttcctttctttgattcttaaggcccagttgaaagtcagcctgatgtattggagtaataaagtcagcctgatatattggcatagcctttggctgatgagagacctagtttgaggaaaaaaataatagatcttattttctttttctccaaattgagtagaggtgatatttggaaaaatatatattgttagctccattggctcctttaggtctcaggcaaagtctgtcaccgaggacctttatgagagacatgcagtctagtcagctattctcaactgtggtgttgacacactggtgtgacaatcatttgtgtgatgtgttgcaagagttaaaatatttgtgttgtaaattatttactttttaaataaatgaaagcatttgaaggttatctctatattgtcattttttcttgcttgcatttgaataaggttcttttttaagtgggagataaacacaagttcaagttacaagtagccagaattgctttgcctaatttactcacgtcccagtccatatttgtacctgaatttttagattacttctctcaatatgtgcattgttgcttccacttcatgttttaagacaattattcttaatcaggagtgtgttagaatttcttggaaggctttttcagcaacgtgtatctgggctttaaaaactatgaagatttctttatcttctaaacatctcaagtggggtaaggacatgtatgttttgaaaaaactacctaggtgattctgatgtacatccccagtatgaactctgttctagggatttctttggatctaaatactcatttggctataccaggatgcattatcttcttaaattaagttgcatttattttagattgcagattatgtgctgtatcagttattacctccagttgcttttatgcttgttttttaaatttggcactgccatattagcataccattcataattcatttttattataacttcatataattttcaactttagttttatcatgtgtaagatgggataataatttctattatttttcaaatggagattaaagttaagaggatcaaatgagaaatgtatataaaggggtcttaaaataatgttataattacaataattagcttttttttctgtatacttgatgctggttgctaattctagcaataaagtgtttgttaataatgtgtctatttccgataatttatgatccatttaaacatttcaatgtaatttttttattttaaaagctcatgctttattagataggcactatgttttaaaatagcactctttcttgcctaagcgcaaataaaaacatagatatatcttacaaacattttggctgtattttagaagttattctgatgtatattagccttttaaaatactattcagaatataggggtcagtcccagctttgcatagtgttgcttaaagaaaaatacagtaatcaatttgtttagagtcaattttggagacgttttggtgcttttcaaaactgtggcgatttgaggttatcttagttaagagtacttattttccctacaatttcctgatttatgttttaccctcttgcactccatagatgactacatttcaacacattttatattcaggaagaatggcattgtgcaaagcacagtactgaggaaggagataactggtgcattgtactgatgcattatataaatgatttatagctgggaagttttttaaaaatcataaacacagataaatcaaaataggaatgagtatgaggaaatactgaggtgtagcaatcctggtacctataaagcactatttttttttccttagtagtggaatctaattaaaaaatctgactaatcacttatatgattatttaacgtttgaataacttgtataaacaaaagaccttaagattttttagtcattcattcaatagatgtttaatgaatatctctgtacaaggcactgatgagttaaacacaatttctgccttcaagtagcttgaagaaataaaacaagtagctttatctcaagaagaaataagacggtaagttttccctaaattacagttatttggaataattgctatacacagaatactatggtagtttaaaggaggggagattatttccagctgggggaatgtagagtattacagtatactgtgttacttggttgtaatactctacattcccccagcttgttaatttttaccaattaagagcttctgcagtaggaaaaataaattccaaggactttaaatactcaatattatatgataactgatatttatgtagtttttactatttaaaaatatttaatcttttcaacaactacttttctgttctttttgtaaacaatctaaagaagtgtcatgtaaccaatgaagttttgggtttttttgttgttgtttttgtgttttgtttgtttttttttttgagacggagtctcactctgtcacccaggctagagtgcagtggtacaatcttggctcactgcagcctccacctcctgggttcaagcaattctcttgcctcagtctcccaagtagctgggattacaggtgcctgccaccacatcccgctaattttttgtatttttagtagagatggggtttcaccatgttttccaggctggtctggaactcctgacctcaagtgatccacccactttggcctcccaaagtgctgggattacaggtatgagccaccatgcccagcctcagtgaaatatttgaatgctcactatgaacctagcagttttattcacactctctcttcccaaagttaaacacttatcattaacgatgtcattttatatcagtttcccaccaagacacctttaaataagtagtgggcagggatttatttggcctttacttcagccacataaattatttaaaatgtgacttaaaaagtaatgttgattttaacagtttttaagaggaaaatatactttcttaaatactcctacaaggatatataagggtatgaaatatttgaaattgcaatgtgaatttgaaatctttaaaatatgcaaggataaaatcgtgaaatactcatctgcatatcttatgtttttgagtaaaactgaaataaggattatgaacttgtttaggttaaagtcagttttctctggctcttcatcttctgaataaacaaataggtagtagattcaaacacagggagtttacaccatacagaataaaattgaaagttacagtaatactttattcagtaacccaaagtagaagccatggaatcatcaatgattctttaatttctgagctatcagtgattctttaatttctcttaaccctactgttcaggcaccaggtgctgtcaattttatcttttaaataatccttcattcatcttatcactgccatatatcagagataccctcatcattgcccacattattatagtggtctctaaactgatgacattgctttcttttttctatctgttcactgtgactaaaacttttactctaaaatgcaaatctgatcatgtgatttgcctgcatcaaaatattcattgatttcatcacacataaaatgaaatccacattgccaagtgtgctctgacttttagttctctttttaagagagaaagtgtgttccatttacattggtgattcttaaataaaccctcctctgtggacacactgttcccttttccctagaatacctacctttttcctcttcatttcctccgctcttttgcttcattaaccgctctttttccactgacacagttgggcattcctgactctttcgctcttatttccgcagaattttgttagtgctttccttccttctgtagtctaataatatatgttgtttgccttgctcttctataaggtcctttagagtgacagttgggataccaccatagtatcactaaatcattgttttcaagaaagcatctgaaataatagacaccatttttttttattttttatttttttacactttaagttttagggtacatgtacacatcgtgcggctttgttacatatgtatacatgtgccatgttggtgtgctgcacccattaacttgtcatttaacattaggtatatctcctaatgctttccctccccccttcccccaccccacaacaggccctggtgtgtgatgttccccttcctgtgtccatgtgttctcattgatcaattcccacccatgagtgagaacatgcggtgtttggtttttttgtcctcacgatagtttccagcttcatctatgtccctacaaaggacatgagcttatccttttttatggctgcatagtattccatggtgtatatgtgccacattttcttaatccagtctatcattgttggacatttgggttggttccaagtctttgctattgtgaagagtgccgcaataaacatacttgtgcatgtgtctttatagcagcatgatttataatcttttgggtatatacccagtaatgggatggctgggtaaaatggtatttctagttctagatccctgaggaatcgccacactgacttccacaatggttgaactagcttacagtcccaccaactgtgtaaaagtgttcctatttcttcacatcctctccagcacctgttgtttcctgactttttaatgatcgccattctaactggtgtaagatggtatctcattgtggttttgatttgcatttctctgatggccagtgatgatgagcattttttcacgtagacaacatttattgaatgtgtatgtatatatgacacttcgtaagaatttagcacatataatctgtcatcttcacaacaacccaatgaggtaggtgctattatgattattcctattttacagaggaggaaactaagagatttttaattttaatcacatttccttggtcttactgttaagaagtagctggggtaggattctaaaggcctcttctccatactgttctgataaggcccactgtgttaccatttctcaggattgcttgcgttctaacaggataagccttagtcagcactaaagtgattaagggacacattattattattttttaatggaaaacatcttcacacccctattaactcccctacttgcaagtacagttgagtgtctatttaccttttcccccacaatttggataataaaagtaaagttgcatacattttaaatagctttattgacatataatttatgtacaacaaactgtacttttaaagtatgcaatttgacaagttttgacatatgtatacaaccctggaatcatcatcacaagataatgtcccccctgcctttcctatccaccatatatccctgttcttaggcaaccagtgatctgctatcgttcattgtatattactttacatatcctagggtttcatataaatggaatcatacagtatgtgctcttctggtctaacttctttcactcagcataatcattttgagagtcgtccatgttattatatgtagcagcagttcattctgcagatgcatattttgaattttagttattatagaaagtgaatacttttttttctctattatgtctttagaaaaggtttgcatgggactgattgcacattctttgagcctaaagtccctcctggggcttgttttgatatactgtgtgtaagtcctttaatatttgaatggagatataaaaaacttacatatgcttctgcaaggatttaaatgcattttcattttcagtgaatggtcttttcattcagtattatgaatatgatgtaaaatcaagcagttaaatatatttaactcactttaggagtgtgatattttacttctgaatactgccttctttacccttcttggggaatcttgggggaaacccttctgctaggtctcacgtgggaggcagatatctctgaagtggttatctcagaacttcatattgacgttagctatagatattaagctataaagtgctaaccagtcaatatggtttgaatgacttgttttgacactacatagggactcaatttgaatgggaaaaaaaggtgcctctcccagccaatctccaagataacatttcggtcttgttatttaatgttaggaggaaaaaaatctttgttttagtctgctgttataaaaaaaacagaatgttaaaatccattattaattgctatattaatctcactgacctcctcctttttaaaaacttttcaggtgcgtataacccgtatatagagataattgaacaacccaggcagaggggaatgcgttttagatacaaatgtgaagggcgatcagcaggcagcattccaggggagcacagcacagacaacaaccgaacatacccttctatccaggtaatagacccttcttctgtgtctatctcactattagttgcttcatatactagctatagcaattattttaaagggccagtttcttcacagtcatctccacaggtttatctttttcttttttcctttttttttttaaacggatctgtcaaaaagacatctattagatagatgtctaaggacatttcttaaatataaaatggagtcttccccactgcagatagttctatggtgcttgtgtattaacctaagtagagcgactcaatgttgagagtacactggcaacttttggatcatgttctttttcatggaacacagagataataaggaaaacccattctctgcagaggtgagtgatattattctgtagattaaacatggatttgagaactcaatcataattcttcttggctagtcttagggctagaacatttttttctcctttttcttaactttattgcttgtctctgattctctgggtcattgactgatttgaaataccactttataaatacagttttttcacattagcataaattttaaaaagcttttgaccaaaaatgactttggtaaacatactaatagttataagatgtactaaatttatttatttatttatttttgagacggagtttcacacttgtcgcccaggctggagtgcaatgtcgtgatctcagctcactgcaacctccgcctcctgggttcaagtgattctcctgcctcagcctaccgagtagctgggattacagacgcccaccaccacgcccagctgatttttgtattttttagtagagacggggtttcaccatgttggccaggctggtctccaactcttgacatcaggtgatccacccatctcggcctcccaaagcgctgggattataggcgtgagccactgcgtccagccaagatgtactaaatttatttatttttttattttttatttttttgagacggagtctcactctgttgcccaggctggagggcagtggcgtgatctcagctcactgcaagctccacctcccaggttcaagcagttctcccgtctcagcctcccgagtagctgggactacaggcgccccctaccacgcccagctaatttttgtatttttagtagagacagggtttcaccatgttagccaggatggtctcaatctcctgacctcgtgatccgcctgccttggtctcccaaagtgctgagattataggtgtgagccaacatgcccagcccaatgtactaaatttctattttctatttgtaaactatttttctttgactttcaatgaagggtttatcctttaaatgccaattaaaaactttaatggcaaagtagattttgaaaagtgttgctttttgtttttgtttttgaaaagtgttacttttatcaacagatcttaattcactgttttataactagattatttacaaaatctattctgttgatgaacttaaagggaattgctgaattatagaataaaccaatggcaaaattatatatattgaattccagatttctatttttatcacatttttggcagtaatatggatttgggttatctaagtcttttaaatgttaaaatggatgagatgctaataaaaaggaaataaggaaatactatttgtccagttttttgagtcatttttaaacttttcttcataattcatcttatcctatgcatctctatttctaagatatgtatttttaccattccagtaggtcctaaacactttacagcttgagttttgtatttgcctacttatagtcttgagcaattaccttctctttcatacagaaagaaatgtaatacttcttggttactttcaaattctatttaaattcaaaattatggattttagtgccctctaccttgtaagctacccattcttactttaccttgctcctttgtggtatgctggtttttatagtccctgctttgttcttgcaactttactagctttcaaactaagcattaattcctgtcctccttcctcttccatgttaaactctcctttttactctgtgttctagctatactttctatgtgaaatttgatgttgttaaactcaatttgatttattgcctattctagagtaaacacttggggtatgcttactgaacaaatatttttgtgaagtgaaatgtcatatattaagtaaaatgatcatatttatgtgctatcctttccaatacggcttaaatatattttcaaggaatgtttatggtatgacagtacgttaaagagctgggcatttagtgacttaacatctgttttctcatgttctatggataaaatttgggtagagttttacttgttttgaaaggaaaataagcccagtcaaatgatatgaccaattgaaattagggcagaaaatatgtcaagaaactgagaggtaagtttttctgtactggtattctctggaaagtttcatctaaactgcagttgttcgtcagctggattttatttatctagtgccaattacattataattaatgtaaattgaattctcatttagtagatcagtttataatgcaatctatttggatcatgtatttaatttcccccttttttcagattatgaactattatggaaaaggaaaagtgagaattacattagtaacaaagaatgacccatataaacctcatcctcatgatttagttggaaaagactgcagagacggctactatgaagcagaatttggacaagaacgcagacctttgttgtaagtacacagttacagacatcttcagaaataagataagacataggatgttctgtttcttctccatgacaatctgttactttttagcagaataattttctcattctacttctatttactgtattttacacttacatttttactatttgcattagaactaccctttcattctttattagtagacacatcttatgatagttagcaggaagacatttttattgttattaaaagtaaacgtaaacttcttgtatactgtgatttcctttcttggggtggacagtttttgaaataattattcactctgtcttttttttttttttttttttttgagatggagttttacccttgttgcctaggctaaagtgcaatggcgcaatctcggctcactgcaacctccacctcctgggttcaagcgattcttctgcctcagcctcccgagtagctgggattacaggcatgcaccaccacgcctggctaatttttttgtatttttagtagagatggggtttctccatgttggtcaggctggtctggaactcccgacctcaggtgatctgcctgcctcggcctcccaaagtgctgggattacaggtgtgagacaccgtgcctagcctctgtcttttcatttatagttaacttattattattattattttgagacaaggtctcgctctgttacccaggctggagtgcagtggcatgatctcggcccattgcaaccttcacctccagactcaagtgatcttcagcctcagcctcctgagtagctgggactgcaggcatgtaccaccatgcccggctaatttttgtattttttgtagagatggggttttgcttgttgccgagggtggtcttgaactcctggactcaggcagtctgtccaccttggcctcccaaagtgcttgggattacaggcgtgagctgctgtgccacgcccatttacagttaacataaaaatgcctggatgtgagaaaaatcaactggaaaactctagagttattatttagaaagtggcaggttatagaattaacatacaacaatagttctaagataaaaatagtcatgtaatacttcatgatagtgaggctaccagaagatgggcccattcatcatgttagaatgtaaattaataaagacgtctggtaggcaatttaactacatggcaaaagcctgaaaaatattaatgcctcttgagccagctgttccacttctaggagtttagcctcagaaaataattaagtgtgttcagacattatgctctaatgctgttcattgcagttctctttgtaatggcaaaaagctagaagcaatccaaatagtaagcaaaggggattaattaaataaactgatacattcatgcaatgtactcctgtacagccttaaaaatcatattgccaatatgtctattggtatgtaaatatagtcacaatatattagataaataggttttctgttttttgtttttttttttctttttgagacagtcttgctttgttgcccaggctgcagtgaagtggtgtgatttcggctcactgcaacctccacctccctggttcaagtgattctcctgcctcagcctcccatgttagctgatattacaggcatgtgccaccatgcccagctaattttttggtatttaaaccattagagacagggtttcaccatgttggctgggctggtctcgaattcctgacctcaggtgatccacgtgcctcagcctcccaaagtgctgggattacaagcgtgagccacggcacctggccagataaataggttttaaaacaatatgtaaagaataattttatttttgtttaagataaatttatacatatacatgatgtgtatatgttaatactaaggtattaatagtagttgtctgggtgggtaagattgtagggttttatgtttttcttttaacttatattttataattcatttttgtaatgaacatgtattggcttttggggaaaaatgaactaatggcaacagaaaagagattaatagtctccacatatattagtaataaccatttagaaaaaaatactttaaatgctcctcttacaataataacacaaaagaaaatatctagtattatacacacttggcaaatatttgtctatattacttgacctcccaacaacattttacactgtgatcactccttacttgaaacatttttattccttgctttctgtgaaaacaaacttccattttacttcctgcttttctggctgttctttcttagttacaggcagttaaatttttggaccacctcacttattgtcctaataatgctctttatggctgttccaactctctccccaattcaggatcccattaaggattacacactataggtaacattatatttaacatgaataacatgaataatattttcatgttaacatgaaacattttgggcaagaaatctatagaagtgatgcagtataactctaaaaatatcccttcagttttttacattattggcgatattatcttggcattctattataaagaagaactttcccttcctctctttctccatttaaaaagtatcactgtaaactcatgcattcttgtatttaatatattatagttattctgttattcttttgattttcaaattgacccagatttgactaatgcaagcctcttcaaactgtctcctgtgtttttttgatatgccgtcatctttctttgagcacttttttactttctgacaaaatgaaatgttcaagacttgtgcttttcttttttctttttttttttcctttttttttgagacagagccttgctctgttgcccaggctggagtgcggtggtgcgatctcacctcactgcaaccttcccctcccaagttcatgcaatttttgtgccttggcctcccaagtagctggaattacaggcgtgcactaccacacccaggtaatttttgtatttttagtagatacggggtttcatcatgttggccaggcttgtctcaaactcgtgacctcaggtgatcctcctgcctcagcctcccgaaatgctgagattacaggcatgagccaccgtgcctggccaacttgtgctttgcttgccccagccctgaagtcatcagctttttccagagattcttggttccttctggtggggaatggtagtaagtctgattgccttctcaacatattcccttaaatgtctcaaaagtaccttaagtagcggggcacagtggcccatgcctgtagttacagctactcaggaggccaaagcaggaggattgcttgagcccaggagtttgagtccagcctgggcaacagagcgagattgtatctctttaaaaaaaaaaaaaaaaagcacttcaaatagaatattccccaaacgtgattttactgtgatcatatctctttcccctcataactggtcttcttccaatgtgccgtatgttagtgattgcgataaaagacctataggtgtcatctctgacattcctcatccaggtgtacacattgaatctactaacagttaccttctcaactggttttgaatctatccacttcactcagtgaaattcatcaccgtcatactaccactatagcctaaactggggctgctggaataacctcctgactggtcttgcattaaccattttgtaccttttccaaaccctctatctttcctcgctttagccagtgtgatcttttaaaatacaaatgaaattgtctttcccttgcttaaaacattttaatgggtttatttggctcttggaataaagacagcattccttctatatagcctataaggcccacatgacccacctttatttctagccttctattaaactctgctttccttaatttttatactccactcacaatgccttcctttagtttcctctgtttccactgctcttttctaggggtctttgtgtggcctgttccttttgcctggaagtgtttttcttctgttccagcataggctcccataacatcatgtatacctccttcataaaacttgttatgattgcagtttagcatttgtgtatgtgtgattatttaatgtatatccacttgaccagagactaccagactttttctgtaaagtactagatagtaaatgtttggggttttgcaagctgtatggtctctgttgctcagctctgctgttgtagcatgaaagcagccatagataatatgtaaacatcagtttggctgtgttccaataaaactttatttgcaaagacagacaagatgttggatttggtccatgagttacagtttgccaatctttccactagactgtaagcttcttgaggaaagggattgtatatccccattactttgcagagtttttggtatatagtacgaaccccaaagcttgttgaatgtctgtgaatgaatgaatgaataattgattcaaacaatctcttgatccttcatttcagaatttcaaaaattaccaccacccctaatattccgtgaatagcagtcaaatatgagattattcagatgaaacaaaatgaagtaatataaatgtattaatatgaagaattctataaaatcttttaccaaagaaaaagaatcaaaccaagaatctttcaaagaagtggaaatacttttgaggaagaggattatagttgcaagatttcaagaaaggattaagaattcaagatttagctgaccaagcatagtggctcatgcctataatccgagcactttgggaggctgaggcaggtggactgcttgagtccaggagcttaagaccagcctgggcaacctggtgaaaccctggctctacaaaaatacaaaaattagccaggtagggtgtcatgtacctgtagtccagctactcaggaggctgaggtgggaggatcacccgagcctgggaggcagaggttgcagtgagccggtatggtgccactgcattccagcctgggtggcagagtgagatcatctcaaaaaaaaatgttttttaagatttatttttgtagttattggaggcagaggaaggaaatgtgaaagatattttagatgctagcaaaattgtagatgtgaagaacatgagcataagacagcatgagtatggagacaggcagacaaagtagcctccggttgcaagtgccatgtgaagtttgaacaatagtaatgttattataattgagttttgcttccttattcacgcccacccaattttactgatgtcatggtttttccatgtgggaacaagtatgactggtggtggtgggggagttccccccaccatcgtctatgctacacatatgcaaattagtagtatttgtagctattgggaagtttttcataaatgacattttgaaacttgttaaatattgttagcattaaacttctttctaatacaaaaacattttagtaattttttatgatgaatggctataactttatataatgtggcacaaaacatattctactgctaataacagtgaattcagggctcaaaaagcaaatctctgtggagctaggcaagcagcataaatgagtggtgtggatcaagtgtaggaggactaacaggcactgtagcaaactaaagagccctgaataaatggggcttagtccctagcctgttgtttctgtgccaacctagtattgccaggtctttaaaatgtacaagagaagccggaaatccagatgttcatatgcaattacctgatttctaaatgtagataacctgtgcagatttttaaaaatataggcaacacttttgtgagcctagcaaaacatacctgtgggcttcaacctgtgaacatctctttacagcttttgctttacattatcaaacagactttattgatttgattctgaatttgtttgggaggcaaattttaccatttaatattgctttactgttaatctatattttggtatgtttgacataggcatattagtaattgtaaaacactgtatgttaaaatgatatagtatatattatttttcttttaacagttcttagaagtacaaccccacttctttttttttttttgaggcagagttttgcttttgttgcccaggctggagtgcaatggcgtgatctcggcttaccgcaacctctgcctcccaggctcaagtgattctcctgcctcagcctcccgagtagctgagattacaagcatgtgccactatgcctggctaattttgtatttttagtagagacggggtttctccatgttgatcaggctggtctggaactcctgacctcaggtgatccacctgccttggcctcccaaagtgctgggattacaggcacaagccacgcgcccagccatataatcccacttcttactctctcatctttatcagagcaattggaagcacgttcatgctttggtatgtacaactgacagcatgataacttcagtattgctatatgtttgatttttgcaatattccttgtgtttataatgcagttttgaatattgtttttttcctgctagtttccaaaatttgggtattcgatgtgtgaagaaaaaagaagtaaaagaagctattattacaagaataaaggcaggaatcaatccattcaatggtaagtatgtttgataaaatcatttctatttatttgggtgttgatttctgtttcttttttctttcccttttttttttttttttttttttgagacggagttttgctcttgtcgccaggctggagtgcaatggcgcgatctcagctcactgcaacctccgcctcccaggttcaagcaattctcctgcctcagcctcagcctccggagtagctgggattataggcgcccaccatcacacccagctaatttttgtattttaagtagagacggggtttcaccatgttagccaggctggtctcgaactcctgacatcaggtgatctacccgctttggcatcccaaagtgctgggattacaggcgtgagccattgtgcccagctatttatatcttcaacctgtgttttaagttctgtgtttacttttctacttgttgacatgtacctgtatctgaggaatgacgtatactatttaaaatagtttcttcacagttgttgaaaaaaatcttatgcacagagaggtttttggtattgttggagagtgtcactgttttatataataaaacttcaaaatgttgtgatccttttgaacatggccttccttatgccacttccagcagacaacatacactccccccttttgagtgttaaataggcactgtgtttataaggtattggagtgcatttagctcaagggtaacacttaatcccaatgtggaagaagaagcatagaaataatagaaatcacacaaagtattttcatagcatatttgtgtatatgactagatatttactgttcagtgaattttattggggatagcatttattaagtatttatacttatggtactatctgcctcatgctgtaagtataaatgcttaatactccctggctaactgttacttgtaagcactctgtattgtttgaatagataagtactaccacactagatgctggcatcctatacttagagtagcctccattctgaagtctttgcagctacttaaatatgcagaagtcaggaattaaatgactgtaatattttcaaagaatatatttcttggtcatatttgagacatccttatactgttggtttgtatttttcctggatgtataaaaataatttaagagatatgttgataatttaaggaatatattcacaggtaattactgttttatgaaccataagatctgcatctctttaggttttatttttcacactatttagtataaagcggaaagtaaaagtcaccttcttcccttccagtcttaccaggggagactgctattaagtttgatgtatatttttctagaattttctttatacatgtgtagttatatgtagacatatatattttataaaaaaggaatcatgctatatatcctattctactccttcatttttttccactcaggaatataccttaaactttccatgtcaatacttacaaatctgttttttttttttaacagaatattttattgtttgggtagaacataatttgtttatttagtcatcttttttttttttttttttgaggtagtcttgctctgtcgcccaggatggagtgcagtgatgtgatcacagatcactgcggcgttgacatcctgggctcaagcggtcatcccacctcagcctcccaagttgttggtgcaccaccatgcccatgcccagctagtttttgtattttttgtagagacagggtctcgccatgttgcccaggctggtctcaaaactcctgagctcagcaatccacttgcctcggccttctaaagtgctgggattacaggcatgagccactgcacccggtctatttagtcttctattaatgaacatgtatgttgttttcattttgttttaaaagctccactgaatatacactgtgagctcttgtgtgattatttccctaggataaatttttggaagtggaaaatttctgggtcaagagtatgctcatttaaaattgtgattcattgccaaattaataggccagacttttaaagaggcaggtaagtctagatgcaatataaaacaaggaaattataagtgatagctatcatttattaagcacttcttgtatgtcagggagtaaacgttagtgctttatgcacactactttatttaatcgttggaacaattctgctttatggaagagaatgccaagacttttgttatttaactgtcccaaatcatgctgcaaatataagtggcagacctggaattcatatgcaggttccttgactccagtggtaaaggcattaaaaaggaagatgctgtctgtggaatttctttttcttagttttggcagctcagaatcaggcttgttttttgagatgcccgggctggagtgcagtgatgtgatcacagctcactgcagccttgacctcccaggctcaggtgattctcccacctcagcctcctaagtagctgggattacaggtgtgcatcaccatgcccagctaatttttttttttgagacagagtctcactctgtcacccaggctggagtgcagtgtcacaatctcgacttgctgcaaccctcacctcctgggttcaagcgattctcgtgcctcagcctctcgagtagttggaattgtagatgtatactacgcctggctaatttttgtatttttattagacacagggtttcaccatgtcagccagcctggtgttgaactcccaacctcaagtgatcctcctgcctcagcctcccaaagtgttgggattacaggtgttagccaccacgcctggccagagtttctgtattttttgtagagatgggttttgccatattctccaggctgatttcaaactcctggggtccagtgatccgcctgccttggcctcccaaagtgctgggattacaggtgtgagccactgggcccgactcaggcatgatattaatagtgaattctcataatggcaattaaaatagttgttggtagatagtaagtgctttatatattttatttcatttaatccttataacagcctacgaaataggtactattaataactcaattttaaaaataagaaaatggaagcatagaaaagtgaactcaggcttgtaatcccagcactttgggaggccgaggtggggggatcacgagatcaggagttcgagaccagcctgaccaacatggtgaaaccttgtctctactaaaaacacaaaaaattggctggacgtggtggcacgcgcctgtagtcccagctacttgggaggctgaagcaggagattcgcttgaacccaggaggtggaggttgcagtaagccaagattgctccactgcactccagcctgggcgacagaacgagactctgtctcaattaaaaaaaaaaaaaaaattagccgggcgtggtggcgcacacctgtgatcccagctactcaggaggctaaggcaggagaatcgcttgaacccaggaggcggaggttgtggtgagccgagatcacgccattggactccaacctgggcaacaagagtgaaactccatctcaaaaaaaataattaaaaaaaaaaaaaatcaagtaggccaggcacggtgtcttatgcctgtaatcccagcactttgggaggccaaggtggagaggattgcttgagcccaggagtttgagatcagcctgggcaacatggtaaaaccccatctctacaaaaattttttttaattaaccagatgcaggggtgcacaactgtggtcttagctactcaggaggccgaggtaggaaaattgcttcagcctgggaggtcaaggctgcagtgaacggtgttctcactattgcacttcagcctgagcgacggaacaagaccccgtctctaagtaaagaaaaggaaagtaatttgttcaaggttatatagctgatgagtggtagagctaggatttgaacatagggagcccctgactctaaggtcatggttttaacaactctaccatgccgcctggatgaatattgatttggggaaggaacaatcctgccagttaatccttcccactatttatgtttcctgttgttgtttacttgttttttctttgtttgtttgtgatggagtctccctctgtcgcccaggctggagtgcagtggcacgatctcggctcactgcaagctccgcctcccgggttcacaccattctcctgcctcagcctcccgagtagctgggactataggcacccgccaccgcacccggctaattttttgtatttttagtagagatggggtttcatcgtgttagccaggatggtctcaatctcctgaccttgtgatccgcccgcctcagcctcccaaagtgctgggattacaggcatgagccaccacacccagcctgtttgcaaattcattccttcccgagcctttcagcagtggttctcaatttgaatgtgcataggaatatcttagtactgttaaaaatgtagatttcaggccacacttccactaatttgatagggctggtatgggtcctgggaatctacattttaaaaaatatttttaaaataataacttatccgagtcacatggcaccaaagtgtgttagcagccaaaagtatctgttcgggtctgcagcagccccaattcttgcctcctcaggagacagaaggagagaccgagacaagttttagagcaggagtgaaagtttattaaaaagccttagagcaggaaggaaaggaagaaaaatacacttggaagagggccaagcaggtgacttgaaagacaggtgtgctgggaatctgcattttaacaaacatctagatcagtatttcttaactctttcaccatgacccacagtaagaaatagattttgtttttgagttcaatatatatacatacaccacacccttaggacagcgataccctatgtattagtccgttttcactctgctgataaagacacacctgagactgtgaagaaaaagaagtttaattggacttacagttccacatggctggggaggcctcagaatcatggcggaggtgaaaggcacttcttagatggtggcagcaagagaaaatgaggaaaatgcaaaagcggaaatccctgataaaaccatcatatcttgtgagacttattcactaccacgagagcagtatgggggaaaccacccccatgattcaaattatctcccactgggtccctcccacaacacatgagaattatgggagtacaattcaagatgagatttgggtggagacacagagccaaaccatatcgccccactacatgcagtgtactcaattctattctgtacctttcctttcccttctttttctttctctcttgcattgttagtgcttacccagcccactaaattaattttacaatcagtggttcccaagctacaatttgaaaatctctatctgagatgattctgatgcaagtgatccacagagtatactctgagaaactttgatctgatctacatgctgagttcagcttctcaaatatggcctttaaagcccttcataatctggaagccttcctttccattctagctttcattctgtacctcagcttcctacccctccttcctctaccactgagtgcacacatgcacttacttgtttttgccgttctgaactatctgcactgttagaagagccatgttctttcttacctctgtgcttttatacatgcagttcctttgcatgaaataccctgatctgcctggtgaatttttcttactcaccctccaagtttaaggatcacatcgtctttaaagccttccctgaccttctctctgttttcccaaagtacctgtgtgtgtgtgtatatatatatgtgtgtgtatgtatgtgtgtgtgtgtgcgtgtgtgtatgtgtgtgtgtgtatatatatatatatatatatatatttttttttttttttttttcttttccgagacagagtttcgctcttgttgcccaggctggagtgcaatggtgcaatcttggcttaccgcaacctccacctcccaggttcaagcaattctcctgcctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggagtgcagtggtgtgatctcggctcactgcaagctctgtctcccaggttcacaccattctcctgcctcagcctcccgagtagctaggactacaggtgcccgccaccatgcccagctaatttttttgtattttttagtagagacagggttccaccgtgttagccaggatggcctcggtctcctgatctcgtgttccgtccacctcggcctcccaaagtgctgggattacaggcttgagccaccacgccccgccttatttgtacttttctaccaaaaatatcacagttgttttccttacctgagatgccctgaaagccttctcagttctcttaagtctgagataacatcttcctaattatacggtatactcagcaattaatcattgaaagttttgtgttatctgttagatcatttgattcttcaggaattttcttaaaatattaatttcatgctacttgtggacagggtctgtgatggaatcttgtttccatttcactttggcacctaaacaatgtatttgttttactgttatctctatcttctcagctaagtgccttgagctattgagtttcctacctgcacacaatagattccccaactagtgtgttttaaggccggcctttatctttcttgccatttgttctttaaaactaagaaacagtctctagcaaacggggcataaagcagtctaatactgtcaaatttgaggcttcaagtaaaggattattcaaattgtctaattgccaaagtctaaattgggtgaggaatttaattagggactccaatatcagattttaacagtgtttacttagctagaacaagagtggcagttagactttgtagaggactcttaactgcaaaagctgaaaaaaatttgtaattatatatcattttctagttatgtactttggtaatgaaatgttaggatttctagtatgcggcagttaaactccatagaatatctaaactgtatattaaattttgtgcaataaaattgattttgacaataaagaatttgcaattaagttttattaggtagtttactgttttcccatgtagagaatcttgagttgttatgagagtaaaaggctgctatacagttgagtttgggaaaactacattacttagtagtctgaaagggaatacagtttaataagtagtctaacatagattcttatctctaaagtctggtctaatacaagaaaaagcctttccttacaactgaaaacttaaagtttgaaaaaatggctcatgtgtacttcattgtcctttctttattgcagtcagagttttcgaagcctttttttcattaccctaggcagaacttgtgtactttcttgctttcagtattccttgagcatatttccattataaagtttttcatgttgtattatataattttagtttatgtatctatttctcatccagatactcatctcactaaggtcaggcattgtcttttcaaatttgtatctaacactttactatggtagcacataatagatactcaataagtatgttgaaaggttgagtaaattaatgatatacttctagtatacttctagcacctttactgtttgcctggcacatgaacacttaaatgtcaacttttattattatacataggggatactttatatactttttaagtaacaaaaatgtaaattaattataactaaattttatatttttccttaagtgagacttagttcattttttttttttctattatttgtagagacagggtctccgtatgttgcccaggctggtcttgaactcctgggcttaagtgatcctcctgcctcggtttccaaaagtgctgagattacaggcatgagccaccatgcccgactgagacatagttcttaaaattgttattccaggctgggcgcagtggctcacgcctgtaatcccagcactttgggaggccgagatgggcggatcacgaggtcaagagatacagaccatcctggccaacataatgaaaccctatctctactaaaaatacaaaaattagctgggcatggtggcgtgcacctctagtcctagctacttgggaggctgaggcaggaggagaatcagttgaaccaggaggcgggggttgcagtcagctgagatggcgccactgcactccagcctggcgacagagcaagactccatctcaaaaaaaataaaattattattccatatgctgtgtatttttgccttgttatttatttttatttcagtagtgtttgacagtattagaattttagaaatgttacacttctagagctagtagacataattgatttttaaaatttaattcctgcttatgaaaaatatagcatgataatatcttcttggttaagaatgaaattctcattacacacctactgattttagggttaaaggagtgatatttctttctaaaggtagattaaacatttaacataaaaaggaaggggctgggcacggtggctcacacctgtaatcccagcactttgggaggctgaggtgcgcagatcacgagttcaggagatcaagaccatcctggctaacagggtgaaactccgtctctactaaaaatacaaaaaattagccgggcatggtggcgggcgcctgtagtcccagctactcgggaggctgagacgggagaatggcgtgaacccgggaggcggagcttgcagggagccaagctcacatcactgcactccagcctgggtgacagagtgagactccatctcaaaaaaaaaacaaaaaacaaaaaaaaaaaaacataaaaaggaaggagaacaggagaacagttattaccttatattttgactaactacaaagtgaaattttaaactagtttaagaggaatttgagagaagtcgattggtctcatgcttccttccgttagtttctgcaaatgttaaaactgagtatcaggccaggcacggccactcacacctgtaatcccaacactgggggcccaaggtgggtggatcacttgaggtcaggagttccagaccaccttggccaacatggtgaaaccccgtctctactaaaaatacaaaacttagccaggcatggtggtgcatgcctgtaatcctagctgcttgggaggctgaggcgttagaatctcttgaaccctggaggcagaggctgcagtgagccaagatcacaacactgcactctaacctgggcgacagagtgagactctgtctcaaacaaaacaaacaaaactgagtatcaattttgacattacagaataaaacactgcattttgtattatagaatgatatgtatctattaaaatgcctacagcaagcattatcctaaataagagaaatatcagaaacattcgctttgaagttaagaatgagaaaccaaggcacacttttaccacttgtattcaacatcgtagtgaaggtcatagccagagcagtgagcattgtagccagtgtacagtaagaccccccaaaaagtagaggcataggattgaaaaatgaggaaataaaactataattatttgaaattattatagtgataacccaaaagatatataaatggattatttagataagtttaaaagagtgagctttgtgcattggcagtatagccaagtgaggtttatcttaggagtggttattgttaattgaaaactttttcctaatatcctgctgtcatgacttgcagtatagtcagcattggcaatttttgacagtctttttggagactgaataaaaaataaagtttaaaagggttagtggatgtaaaattaatatataaaggtcagtcatatttccatatctcagcagcaaataactggaaaacatcattaaaacaaatattgtcaggagatatgaagtatgtagaaacaaatcaaagaaatgataagatttctttagggaaaattataaaattttattatgagatcttagagaatacttaaataaatggagaggtattccgtgttctctaatagtaatattgtaaaaatgtcattttcccaggccgggcgtggtagctcacacctgtaatcccagcactttgggaggccgaggcgggcggatcacaaggtcaagaggttgagaccatcctggccaagatgatgaaaccccatctctacttaaaatacaaaattagctgggcgtggtggcacaggcctgtagtcccagctactcgggaggctgaggcaggagaatcacttgaacccgggaggcggaggttgcagtgagctgagatcgtgccactgcactccagcctgggcaaagagcaagactgtctcaaaaaaaaaaaaaaaaaaaaaaaaagtcattttcccccaattgataagtagattcaatgcaactccatattaaatgtgataattctaaacaggaacagaatatagaaaaagaacaatgaggagaaattgacctcatcagatagaagtattaatactaattaaggcagtgtcatattgggataagaatagatagattgactcattggagtagaattgagagcccagaagagactccaatcacctgtgaccctgaactggaataattgggtaaatcattatcttaacttgtttttattaatctttcttaaatgtatgtatagctcagatttatttcaatatttaatattgcaagcgttttggtcttataaatttagtgatgtttttgtgacccatagtctgccgtagaaacttaactcttattaatattgattagcctatggtaaaattggttttattatggtgttgtttcgcttgaagttgcaatttccaagaacctatagacatcatcctagaagacattaagtgaagacttactgtgtatataagcagatttgaaattaaaaatataaaagatcttctgaagttgcaacagtgctcagaagtattataaaatagaaataaatcatttccaaaagagagatttcatttttgcccaaaatctttcttctaagctataaaagacaaaactgttcaatacacagttttgtcaatttaaatctacatattcacccaatttttataagataaaataaaaatgtataattattgaaaaaagaattgagagcccagaaacagagctaaggaaatatgcgactttagtgtatgacagaggtggcatgtcatatcaagaggaaaggaggaaatgtttgagaaatgaagcttgaaaaaaaaatagttatttaattaagtcggattccctacctcacatcatatacaaatatcagctgaagatggattaaaggctttaaaagtgaatcaacattttaaaaacttttggtagactatgttggtaaacattttaatccttgaggtataaaaagacaagacacaaagtgttttctataaaacttttgataaatttgattatattcttaatttcaatttattatatttttcagttctagaatttgattcctttttttcagtttcaagttctccagtaaactctcaatcttaattccttgaatatattaagtatagttactttaaattatatgtctgaaaacttcattatttggatcctttgtggtatgtttttattgcctgttgctttcttttaaaaaaaaattttttattttgcctcctcatatgtgtggttatttaagataaaataccagtcattttctgtgaaaaagagtaaagattttaggcctacaatattatctccctgcagaaaattttcttctggctagtggccgggtacactagcaatcccaggtcacctaaaatcagtgaatgatttaggttatttgaagttgggctttcatccctgaaatctgatatgtttccagttcacccttactcctagggtatagctctttcagacctcaaatcccccaaagccttgggtatttatcagatcccacatccttggcaaactctcaactcctttattttttccctatagtttattgagagttcatctcaatcttcttaaccatctcttagaaaattgtcaggctatattcagataaaagtggcctctcattctgaactgtgggttttcttctctcatatcttggtcgcatggtttttcatgaccttgttagctctctaatgtcattagagaaattttgtttcatattttgtccactttattctcatggttgaattggtccagtttacagattatcatctatcattaccaaagtagaacttctttttattaacgtttactttatgctttcttcagtaacttgtaaaagtatctaaatgtttggttgttcaataggactttaagtaattcttcagtcatttatgttaattgagaaaatgtataataaatatcactactaggttcaacacctagtggagatacatcagacatcccttctgacttcatttgaaactttgtctaataggatagaagaggcatacataaatgattatcatgtaagattttaaaacttttaagggcataagaaaggtataggtcaagtcttgcactgatttagagaggagaaatattccctccattgcagaggatgaagttaggctttatagaaaagaagctttgagctggggtttcagccttacactgaatcttgcattgggtaaaaacgggtatctgtcatgattcttgcctgtcagtagtttttaaccatgttgtgcagagatgaaagtaattctgatgcagtagtaattgtatttccacacattgagaagattcaaagcaaaatctcataaacagtgattttttttgagaagtaagtagaatttcttccctgtagtagaactattatgtgactaaatgtttttgaactttggcttattgaccagtttgtttatttttcttttatgtgccatttaaaaatatttaaaataaacttttattgagatacaataaaatctacccgaatatgtcctgctacataaccacaatcaagctatggaacatttccatcaccccctaaaatttccctggtccccttctcgctcagttccctaccctgcctctgcctcaggcaattactaatctgccttctgtcactggagattaatcttttctaaaactgcatgtaaatggaagcatacagtatacttttgtatctggtttcttttgctcaacatggttttgagatacattcatttgggagtgtatacccatagcttgtttttttgtttttttttttttttttgagatggagtcttgctctgtcgcccaggctggagtgcagtggcacaatttcggctcactgcaagctctgcctctcgggttcaccattctcctgcctcagcctcccaagtagctgggattataggcgcccgccaccacgcctggctaattttttgtatttttagtagaggcggggtttcaccgtgttagccaggatggtctcgatctcccaacctcatgatccacccacctcggcctcccaaagtgctgggattacaggtgtgagccaccacgcctggccagtttgttctcttttattgctgagtttattccattgtaggtctataccacactttgtttatccattcacagagttcacataggtttgtttttaaacttaccaggaacatctagctacaaatttatcttttttgcatattgattactcatctttgcaattgagagacactaatatcttgaatgctacatttataatgctgtaaaaatggattttgaagaggtagctctcatattgcctacacaatagtgccagtagagtatgctgctgtaacacaagtgttggtatcataacattttgacctttcagttgtacagagtacagatgtgtttttatgcactgtttcaaagattaagcataagaatgctaatactgggatacttataaatgttgtgatagctaagtagactctcaatgtcattaaataaaaacagtacaaaatacattatcagttttattagttattgcctgtaaaataaggaatttgggcttaactatgtttctaaatttagtgtttcaaaatttaatactttgcaaagtaaaattgttatgtaaataatgtgcatgtcttgctttttaaaaatatgacttattgctatagcttatggcatttgaaaaggcaatattttcttttggaactggatttctggttcaaatactaatttaacaaactattatactatattctatcatgagcttttctagttttatagaactgtaaaatttttaattaaaacattttttaagtttgcacgtaaaatttcttatggaaactagctatcttaacatttttttgtttcttggtatttcatccttaaaatgttgatccacatttagtagatactcttgtgtatgtcatttttatgtacaacacatgtacaattttctaatagatttcaatttttaaaagcataggctctaaatttaatgacttgagttcacatttccaccctgtcactgtgaaactttgggcaagtaattcatctctttacagtcagttccaggccaggctcagtggctcacgcccataatcccaacactttgggaggccaaggtgggtggatcacttgagcctgggagtttgagaccaccctgggcaacatagtgaaaccccatctctacaaaaaaatagaaaaattagctgggcgtggtggcatgtgcctgtagtcccagctactcaggaggctgagatgggaagatcacttgagcctgggaggcggaggttgaggtgaaccaaaatcgcatcactgcactccagcctgggcaacagagtgagacccccatgtcaaaaaaacgaactaaactcagttcctcgtttgtaaaatggggatgaaagtaattcttgtacagatttaggagataatttacagagtccttaacacaacaactggaccaaatacatacttgttgaatgaatgggtaaatgccattctttgttgtgtacaaacctgcaactattttttaaaactttgatttgttattaatgtcaacttgggattttgctttaaatcccaggtgaggggatagttacttcctgaacatggctataatttatcaaatactgttagatagtgattacttgataagaatgataaaaggcattcttgagattgtatactgttctatttttattcatacatatttggatgctattcaaggttattggctataatgggcagggaggaggacctagcaagtctttaggtctatgtgactattacatttaaaaaattttttttttctattcagtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtaagtacttcattttcttatatttgtagtcttaacttgttttttgtaatagtttaattcttaaaattattttggtaattaggaaaacaatatattcatgataggaaaacttccagacattagagaaatatataacagaaaggaaatcttctctaatctcatcctccagagataatcactatccttaggtgcatattttaccagtttcttcttcctgtatatacacagatacattgtcatcatcatcatttttgacacagtacaattttggcaacttaaaatcataagtgatgattgttttaaaaactaactttcttcttaccatatatcttggacattttccttttaatcaccttattcttttcagtagcagcatattttattatgtagttatatcataattttattaattaccctcttacaaggcatttggtttgtttcttttctcattttttctttttggcctagcaaactgtactgcaatacatattcttgtatatttttttttattggttttttttttttttttggagacagggtctcactctgtcacccaggctggagtgcagtggtgcagtcatggctcactgcatggcaaatgctggctcaaaggatatggatatatctcattttgaaagattatgaaactttcccccaaaatactgtgtgtgtgtgtgtgtgtgtgtgtgtgtgtgtatgtgtgtgtgtgtgtacatagacttagatatacgtccaccaatggtgtatgatatacctgttttatgtgtagaaggatagagagacttagggctataaaggaagcatgaaagttgtattgccatagggagatgtattgccatagggaaaattgtattgccatggggatgtggtcatgatttatgaagattaatctggtgacagtgggtaggattgattggcggaatcagaatttagaagcagggagatgtaattagagaatatgtcattacctagaaatgaagccacaaagtctaaagtaaagcagttagaaaggaagtggacagataaatagatgattaatgtatttagtgtcatttatctatacactaaaacttttattctgtgaatgcttttcctcaaattcttccctgcaaaaagaaataaaatattactaaggtagcaactcatttttttgaaaatcctttatatttaggtgctccaaatactgcagaattaaggatttgtcgtgtaaacaagaattgtggaagtgtcagaggaggagatgaaatatttctactttgtgacaaagttcagaaaggtatttatttatttcattgaatttagaataaattttagattaatagatgcagttactttgttttcccatttttttttttttggtttcttattgactagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaaggtatgacattttgctggtaataatttatatatttcttgaagtggtcctgctaataacatcttcttgtaatattcatttgagtacagttatgtatattcataatttatgtttcttttcctggaagctttctgttggttttttctttatgctctttgcatctctttatttgttgggttgttttttgttttgttttgttttgtttttgagacagagtctcactgtcacccaggctagagtgcagtggcgcaatcttagctcactgtaacctcctcctcccgggttcaagcgattcttctgcctcagcctcctgagtagctgggactataggcacgtgccaccacgctgggctactacttttgtatttttagtagagacagggtttcaccatgttggctaggctggtctctgcatctctttcttcaagaagaggtttgattagtatggaataatttcaaagtatctaaactgcttactaaaatttctattttatttttgaaggtctgttttagtctttgtgcacttaccactcagagagtagtctctatattggtttcttatcaaaccttattgcattagttgacattattgacttgtgtgataagaaaacaagatgaatattttaaacagcttgttttgggttttttttgagacagggtctcactctgtcactcaagctggagtacagtggcatgatcgtggctcaccagagcctcagcctcctgggctcaggtgatcatcccacctcagcctcgtgagtacctgggactataggtgcgcaccaccacacttggctaatttttgtggggtttttttgtttttttgtttttttgtttttgagatggagtcttgctctgtcttgcccaggctggagtacagtggcgcaatcctggctcactgcagcttctgcctcctgggttcaagcaattctcctgtctcagcctcccaggtagctgggactacaggcatgcgccaccacacccgactcattttgtatttttagtagagatggggtttcaccatgttggccaggctggtctcaaactcctgacctcaggtgattcacccacctcagcctcccaaagtgctgggattgcaggtatgagccactgcgcctggccaatttttctgtttttttatggagacagggttttgtcatgttgcttaggttggcctcaaactcctgcgctcaagtgatccacctgcctcagcctcccaaagtgctgagattactttaaacaattttttactaagagaaaaatatccttttctactgatactactgatttgggacatattctataatacttattaaatccaacttacatacatatttattgaaaacattttctatatgtgaataaaatatttgtttattaaaggagaggatacaatcctataattttttatctgctttcctggtttctttctaatcagatacttacggcaataaagcaaagaaacaaaagacaactctgcttttccagaaactgtgccaggatcacggtaagaatagtttggatcgattcatatttaaataggttttgttttatttactttattcagtttttcaaattttattatttttgttttgttttgttgtttgtttgttttttgagatagcatctctctctgtcacccaggctggagtgcagtagggcaatctcaactcactgcaacctctgccccccaggttcaacaattctcctgcctcagcctcccgggtagctgagattacaggcatgtgccaccacacccggctaatttttgtatttttagtagaaacagggtttcgccatgttgaccaggatggtcttgaactcctgacatcaggtgatccacccaccttggcctcccaaagtgctgggattacaggtgggagccaccacgcccggccagtttttcagattttaactgataatgttatttttcaaatgacatttaataatggaaaaactttatcctaacagttaattttcctgagagaccaagacctggtctcctcggttcaattggagaaggaagatacttcaaaaaaggtattttatttcctatagcatatttcttgtgatcagaaagaccagtactttgcacaatatattggaattctatttttaggaatgaataactgcttctttgaaaattttctctccagatttttcatgctttcagtatagaatgaattaagcatggcttctgaaggttgtgttagaaactgattatgtttttgggatttattgttcaagaaattacatgttgttcatatggtagcaattttattaattacattgcgttatgaaaaaatgttactgatttggttagttacctgtttttataaataacattttactggaacacggccatgaatatttgattaaatattatctctaaactgctttttttttttaacactatggcaacagggttgaatagttccaacagaggctgtatatagctcacaaagcctaaaatatttacaatctgactttttacagaaaaaaaaattgccaatccctagtttaggtaattcaaccgagggctaattagaagaagtcttttttcccccacgtacattcttaaatcattgctttttcctggtttagtttgtaaagcatttgtataatatgtaaatagatacagaattaattttttctgtaatttttttctgactgtgaattttatagtctcttagggttctgttgtaatatatcttaaaagttatgtgtattttcttatccctaatgagtgttgtctccatccttccattttctcctaaaagtgaagagtaagagatgattttggctatttggaatcccattaattgtaattctaatatttatcttttagttttcaaaaatacctttatagagcctcagaaactagattttcatatttaattgaagtgaaattacatatgccaaagtaacttgccaaaatcattttacctgtatttgtaaaatggtatatacgttacagaatttcattttggattcgtgtaataattttagtgctttttacatttttttatttgaaatgttacattggtttccttgacatttttctttatatatatttgtgtgcttatgcaattttaatttagaaatgctttttataattttgttcattttaatttcgtaaaataaatttttcctcccacagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctcaaaaaaaaaaaaacaaaaaaaacacacttttttatatttctttttataatgttttaatgtattcttaaatttcaagcaaatttaagataaaacttgtaatggctatgccattgaaaaacttaattttttatttttgaggcccatgggccaaggtaacccctaaggggttttcttaggcttcttggagcttagatttgtatgtatatcaaaatgtctttaaaatgttaagttgggcagaaggcagttgaagtgagctttcaaggtatgggaggttttctacattttatactatttcaatctatgcctttaaagttgcttatgattttagctgtacactcattttttaaggggaagaagtttccttggaccattcgcctttcttagatgtcctcactccctgtgatctcataaaactgcctatttgacatctctatctagaaatctaattaaagctcacactcagcatatccaaaactgaattcttggtcttccctcccaaacttgcttctccttcagtcttctccaactcagtaaatggcaatgccatacttctggttgctcaggccaaaaaccctgaagtcatccttgattcttcttttagcacccatatccaatccattagcaaatctggtagaccctaccttcacaatatatctaaagctgaccacctcttttgacctctactattaacgccctattccaagccaccatcatctcttccctggattgaagctgtcatctacaaaaattcttcttatatccttgcattcctacagtctgttccccataaagtagccagaatgattatttttaaaacaagtcaactcataccattcatctgctcaaaaccattcattggcttctcatctcactcagagcagtcaaagtccttaaaagttgcaggcctagactccctgtcctacctcaggtaccaccatatcccacctcctcatgcagctccaggcaccttggcctcagtgctcctcaaagcatcaagtatgcacttgccttggacagtctgtacttggtattccctctgccttgaatgttgttctcccagaaaaatgcatagttcactcttacatccttcaggtgtcactccactgttacctgagcaggtcgtccttgaatatatacatcagcattccctttcccccctgctttatgtatgtccatagcactcaccacgatctgactttactaagtatttattcatttactgtttgttttcccataccgaaatataaactttctaaggacagaaatttttgtgctttattgttgaatctccaatttgtagaaaaatgcctaccttatattaaacactcagtaaatgtttattgaacattaaaagtattactaatagaactttggtttttgaaagaaataataactttaattataagacgtatatgatttttgcagttttacttagtgtgacattgggtttatgagaatcgtgtacattcaagtccaggaataataatggtcatccaaattgtttgaaaggaaaataatcccagtggcaaaatgatggtagaatttgggtaatcttttttttccttttatgaaaagagattttattgaaggtaaaacattagaggttcattgagaatctctaaatccatgttttgacattgtcaagctcattgcaacttccagattgagtaacacttataacacatttccttttcaaagtgcaagatttttaaaagagacttgtcacatattcatttggctggtttcaaatggtgagctgaatgctgggtaatctctactagctccttaatcagatttaaaattctcagtgtttcctagttgtttctgcatactttatgtgagttgttatagctgtaacattacactttatttgctgtttgtgtttcgtgacttttggtaattctggcatttagaaacctttcactttgcttcaaaacgtagttatattttggagttttcatttgatatataattatttattttgcccttttatttcccaaagacattgtaagggttaattagatcattatattttattattacagattaaagttgggcagtaatcttaattatgatggaattatcattatgctaagtaattaactttacctagtttgttttacaactagaacctgccctaaatgttgaatatcttcctagcaagaaacagtctgtcattttacttacacgatgtctaaccaaaccataactttacataaactagtcgtttcggtcaaatagaaaaatgtgtgaatgccataaaaacaaaaattctcagttaaatgatactgggaaatagggaagacagcaaagtgagacttgggctcaggatggttcaggaagaaaaaaaaagaaagacccctgagtaccattaatattcctcagaaattattatttcaaaaggaaatatttctgtattataaatttttcatgagcagccattatgaaatctcacaagaatcatagaattcaataaaaaaggtagaaagtaatttttttacttaaaaatataaattaaaataaatttttaaaatcataagcacataaatagaacttaccagggagaaagaaaaacctgaaggcacaatttcttttctgttcaaaatgtgaacccaggatgtctctagatgatgatggatgataggtggggagattttttttttttttaatacagaatctcatagttttggattaattagcaccaatcagtttaaacactgactgttagaatagctgcatgggtttttttctttaaactaattaagcgttggctacttagtataagtaagtataagccgaattaaggttctgctacatctgtgtttagaatatttttttaaaactaaataagtgttggctagttttgcggtgtaagcagaattaaggttctgctacctctgtgtttagaatattcccaatggatttttcatttttcaggtgctattttttgaccctgtatagactttaatttaaaatgaatttggtaacgtttctcctctgtctctacatatattcatgctttcacctgctcttttaacacctgcttttagtatctgaggcactttttctgaactctacttgtgcactggatccctcctcctttctctgccaggctgtgtttactttatccttacatcaccacttagtgattcctttctttgtataaacatggtaaatgtcttcattagcctaaaaggaaagaccaaataaaacctttcctaccacttggatgcatttgcatcctgacttctgaaatgcctccagcctccattttctcccttcccagttattccttagcccagccatctctgtctttagctcctacaattttcttaggatattctgggaaagatgagcggagactgcccgccttgtcaaatctagtgtctttttttcagtcctcacactgcttgacctatgtataacctcctatacttccctctttgcatactcctctgggttttctgtggtagtcaagattcctccctgagatttatttcccatgagtcttgacccctcccctcagttggtgctatttccccctacccgccctccgatgatcttatcagagcccacaggttcagttttctttcatgctacctgaatgtcctgataaactggctcgctctcttctttaccttccataatggcattaccatttaccacgccacccaagatacttactaggaacctcaaagtattgtattctttttctccatcacactcatacttaatcatcaagtccttttgagcttgtctcctcttgaatatgtcccttcttaattcctgctgccttcttagtaaaggccttcattcttttttccctagtaataatcttttccatatgttccagttaaaataccatgttctccctattccttattacatagctagcattccttgaaaaaaaacaattctctcaggcctccatacctttagcatgttacccactctgcctctgctcttctggaactagaacactcatccttgaaggctgggcttctgtatgaaggttggtcctgcctccttacttgaggtgaagctttgtacatgcctgtattacggacatcctcttatttaagtgtttgtctctttcgtcattgggactccagcacccagcatagtccctagtatactagttggtgccgaataaatagtagctattattagaaaaggaagggtgaaattgacatgggagttagtaaaatgtatatggaaatgatttttaaagggaaaggtaatgattttctggcaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtagaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaaaaaagaggatacaaccaaatggaagaacattccatgctcatgggtaggaagaatcaatatcgtgaaaatggccatactgcccaaggtaatttacagattcagtgccatccccatcaagctaccaatgcctttcttcacagaattggaaaaaactactttaaagttcatatggaaccaaaaaagagcccatatcgccaagtcaatcctaagccaaaagaacaaagctggaggcatcacactacctgacttcaaactatactacaaggctacagtaaccaaaacagcatggtactggtaccaaaacagagatatagatcactggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagctgctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatgactggccatcagagaaatgcaaatcaaaaccacaatgagataccatctcacaccagttagaatggcaatcattaaaaagtcaggagacaacaggtgctggagaggatgtggagaaataggaacacttttacactgttggtgggactgtaaactagttcaaccattgtggaagtcagtgtggcgattcctcagggatgtagaactggaaataccgtttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgaattcatgtcctttgtagggacatggatgaaattggaaaacatcattctcagtaaactatcgcaagaacaagaaaccaaacaccacatattctcactcataggtgggaattgaacaatgagaacacatggacacaggaaggggaatatcacactggggactgttgtggggtggggggaggggggagggatagcattgggagatatacctaatgctagatgacgagttagtgggtgcagtgcaccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcaaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaaaaatcattatggattaggttctttagtaagaaacctgagatggacttctcattagcattaactagttattgcccagctttggagagccttcttttggcttatcatttattataagcccagaaataggtgactaatcagagataaatgtatgggttgtctgtatctagttttatgccttttttttgcctaagacgtagtcaaattaatattttaactaatacatcttagcagagtttagttaagcacaaagttaacagtgggtaggattgaatcttgaaagtaatcatgtctgtaatgtttttcatgcatgcaaaaagcacagacaaaaccactcatgccctattaataaacaaaatacagatcaaagttttcaaaagtaatcactctatttattctaaatgtctgtggctttaggaaaataccaccagctagtacttacctatttaaagatgtagaatttattatcctctaatattcttatcagttgtttccacaactttagtttactattggactttcaaaaatttaaagaattacaagtaaaattcattaaacacttgtgtgtgaatagtaatacacagtaattagtacagcatgttgcttcttcaacaaattgagttttcagggaaatcagcaagtaaatgaaatataaatttttggtaaaagtatcaaacattcatcttgcccatttttcctcttaaactttattatctaatcaaacatagttttccataagatgtaataaaatatagataaggttggaatatttgaggatccatttgtggaactgaatttaatgagacttcattggtgatacactcaatttttactgggtaattagctaataatgttggtcactgtctcacagttcaagtagctttaagatgatgtggcaaggaaaacacaaagcttttgggtaaccagcgttcttaaatgtatggtttttgaccaggtgaaccctttagaagtgatttctgttttaaaagtatgtacttaaaatacctttggctgtgatgaatgtagatcccagcagaataccaaaatcctattttttttgactgagtatttgtagatgcttaatgactgaaatgaatttggaggcactgatgaaagtgatttttttaaagttctcaggtactgttcaattatttaatgttaagtttagtatcaagatacagttgtttttaaaatgccaaaatgctgtttattatacagaatattttattacatttgcaatatctttgtatatagtgatttttttcttgataataaatggaaaaattctaaaacacttgctgaaattttgttgctatttaacttttaaaatatcagattttcttcatatttatagcatcttcctaacaggaaaaggtagttttagttgcttagaaacattagacatttttatggaatgctgttgctgaatatggttgcatttgtaactgtcctttgaaataattttgtagagtactgaagtgcctttttacaagatttttttcctttttccttttctggcttaaccaacaaaaatctgttttcagagtcctggaggctgaaagtccgagatcaggggtactaggacggtttctgctgaggctctcctcctggcttgcagagggctgccttcccatcatcctcacatggtagagagagagaaggatggagatctagggtgtctcttctcttttttgagacagagtctcactctgtcatcaaggctggagtgcagtggcacaatcacatctcactgcaacttctgcctcctgggctcaagagatcctcccgcctcagcctcccaagtagctgggactacaggcgcatgccaccatgcctggccaatttttgtattttttgtcagagtttcatcatgttacccaggctggtctcaaactcttgggctcaagtgattcacccgccttggcctcccaaagtgctgggattacaagcgtgagtcaccatagctggcctggcctcctcttttcttaaatccttttttttttaattgacaaaactgtatatattaatatttatcttgttcaacatgatgttttgaaatatgcatacgttgtggaatggctaaactgagctaatgaacatgtattacttcacttagttattttgtaagaacacttaagatctactcttagcaactttgaagaatatatttgttattaactatagtcaccatgttgtacagtagatctcttaaacttattcctatcaagctgaaattttaaatcctttgaccaacatctccccaactccgcaacccctatcccactctcacctccgcagttctagtaacaaccattctaccctacttctatgagttcaactattttagattccacatataggtgagatcatgcagtagttgtctttctgtgcctgacttatttcacttaacataatgttcttcaggttcatccacgttgtttcaaatgacagaatttcctttcttatgggtgaataatatttcattgtacatatacaccacattttcttcatttatct

SEQ ID NO: 1101 - DNA, 2337 bp, Homo sapiens
  misc_feature (61)..(61): "n" at position 61 can be any base
  misc_feature (2277)..(2277): "n" at position 2277 can be any base
cggaaggtgtgagccgcaaacccagcggagggcgggaagaaggaggaggcctctagggtgntcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggngctcacacctgtaatcctagcactttgggaggccaaggcgggtggatcacttgagaccag

SEQ ID NO: 1102 - DNA, 1860 bp, Homo sapiens
atggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataa

(The sequence listing continues in the following parts.)

We claim:

1. A method for diagnosing colon cancer comprising comparing levels of PPP3CC protein in a patient colon sample to that of a non-cancerous colon control sample, wherein the PPP3CC protein is encoded by a nucleic acid having the nucleotide sequence set forth in SEQ ID NO: 1587, wherein an increase in the level of PPP3CC protein in the patient colon sample of at least 50% relative to said non-cancerous colon control is indicative of colon cancer.

2. A method for diagnosing colon cancer comprising comparing levels of a polypeptide encoded for by a nucleic acid comprising a nucleotide sequence at least 98% identical to SEQ ID NO:1587 in a patient colon sample to a non-cancerous colon control sample, wherein an increase in the level of the polypeptide in the patient colon sample of at least 50% relative to said non-cancerous colon control is indicative of colon cancer, said polypeptide having protein phosphatase activity.

* * * * *